United States Patent 10,329,575 (REGULATORY SEQUENCE FOR PLANTS) - sequence listing, part 27

SEQ ID NO: 175948 - DNA, 13 bp, Unknown
  misc_feature (1)..( 13): Result.005 file - promoters50/1572151
ttttaattaaaaa

SEQ ID NO: 175949 - DNA, 13 bp, Unknown
  misc_feature (1)..( 13): Result.005 file - promoters50/1572151
ttttaattttgtt

SEQ ID NO: 175950 - DNA, 13 bp, Unknown
  misc_feature (1)..( 13): Result.005 file - promoters50/1572151
ttttaaatcttag

SEQ ID NO: 175951 - DNA, 13 bp, Unknown
  misc_feature (1)..( 13): Result.005 file - promoters50/1572151
tattaattattat

SEQ ID NO: 175952 - DNA, 13 bp, Unknown
  misc_feature (1)..( 13): Result.005 file - promoters50/1572151
tagtaatttaaaa

SEQ ID NO: 175953 - DNA, 13 bp, Unknown
  misc_feature (1)..( 13): Result.005 file - promoters50/1572151
atataattttaga

SEQ ID NO: 175954 - DNA, 13 bp, Unknown
  misc_feature (1)..( 13): Result.005 file - promoters50/1572151
catctatttttat

SEQ ID NO: 175955 - DNA, 13 bp, Unknown
  misc_feature (1)..( 13): Result.005 file - promoters50/1572151
catttatttatat

SEQ ID NO: 175956 - DNA, 13 bp, Unknown
  misc_feature (1)..( 13): Result.005 file - promoters50/1572151
agtgtatatatat

SEQ ID NO: 175957 - DNA, 13 bp, Unknown
  misc_feature (1)..( 13): Result.005 file - promoters50/1572151
tttgtatatatat

SEQ ID NO: 175958 - DNA, 13 bp, Unknown
  misc_feature (1)..( 13): Result.005 file - promoters50/1572151
ccactatatatat

SEQ ID NO: 175959 - DNA, 13 bp, Unknown
  misc_feature (1)..( 13): Result.005 file - promoters50/1572151
gtagtatataagc

SEQ ID NO: 175960 - DNA, 10 bp, Unknown
  misc_feature (1)..( 10): Result.005 file - promoters50/1572151
aaagtttgga

SEQ ID NO: 175961 - DNA, 10 bp, Unknown
  misc_feature (1)..( 10): Result.005 file - promoters50/1572151
ttagtttgag

SEQ ID NO: 175962 - DNA, 10 bp, Unknown
  misc_feature (1)..( 10): Result.005 file - promoters50/1572151
ttaattttgt

SEQ ID NO: 175963 - DNA, 11 bp, Unknown
  misc_feature (1)..( 11): Result.005 file - promoters50/1572151
tgaatgttgat

SEQ ID NO: 175964 - DNA, 11 bp, Unknown
  misc_feature (1)..( 11): Result.005 file - promoters50/1572151
tttattttacc

SEQ ID NO: 175965 - DNA, 11 bp, Unknown
  misc_feature (1)..( 11): Result.005 file - promoters50/1572151
tatatgatgat

SEQ ID NO: 175966 - DNA, 11 bp, Unknown
  misc_feature (1)..( 11): Result.005 file - promoters50/1572151
ctaattttaat

SEQ ID NO: 175967 - DNA, 11 bp, Unknown
  misc_feature (1)..( 11): Result.005 file - promoters50/1572151
ttgaatattcc

SEQ ID NO: 175968 - DNA, 11 bp, Unknown
  misc_feature (1)..( 11): Result.005 file - promoters50/1572151
ttgaatatttt

SEQ ID NO: 175969 - DNA, 11 bp, Unknown
  misc_feature (1)..( 11): Result.005 file - promoters50/1572151
taaaattttca

SEQ ID NO: 175970 - DNA, 11 bp, Unknown
  misc_feature (1)..( 11): Result.005 file - promoters50/1572151
tataattttag

SEQ ID NO: 175971 - DNA, 11 bp, Unknown
  misc_feature (1)..( 11): Result.005 file - promoters50/1572151
ccttattttat

SEQ ID NO: 175972 - DNA, 11 bp, Unknown
  misc_feature (1)..( 11): Result.005 file - promoters50/1572151
tagtatatttc

SEQ ID NO: 175973 - DNA, 11 bp, Unknown
  misc_feature (1)..( 11): Result.005 file - promoters50/1572151
acgtacatttg

SEQ ID NO: 175974 - DNA, 11 bp, Unknown
  misc_feature (1)..( 11): Result.005 file - promoters50/1572151
ctcaattttaa

SEQ ID NO: 175975 - DNA, 15 bp, Unknown
  misc_feature (1)..( 15): Result.005 file - promoters50/1572151
agagaaagtgtctag

SEQ ID NO: 175976 - DNA, 15 bp, Unknown
  misc_feature (1)..( 15): Result.005 file - promoters50/1572151
ccaaaaaatgtacat

SEQ ID NO: 175977 - DNA, 16 bp, Unknown
  misc_feature (1)..( 16): Result.005 file - promoters50/1572151
tccaaacaatcatttt

SEQ ID NO: 175978 - DNA, 16 bp, Unknown
  misc_feature (1)..( 16): Result.005 file - promoters50/1572151
cgtttacaatttacct

SEQ ID NO: 175979 - DNA, 16 bp, Unknown
  misc_feature (1)..( 16): Result.005 file - promoters50/1572151
gtgatactatttacat

SEQ ID NO: 175980 - DNA, 16 bp, Unknown
  misc_feature (1)..( 16): Result.005 file - promoters50/1572151
tttttagacttttcat

SEQ ID NO: 175981 - DNA, 9 bp, Unknown
  misc_feature (1)..( 9): Result.005 file - promoters50/1572151
agtatataa

SEQ ID NO: 175982 - DNA, 9 bp, Unknown
  misc_feature (1)..( 9): Result.005 file - promoters50/1572151
agtatattt

SEQ ID NO: 175983 - DNA, 9 bp, Unknown
  misc_feature (1)..( 9): Result.005 file - promoters50/1572151
catatatta

SEQ ID NO: 175984 - DNA, 9 bp, Unknown
  misc_feature (1)..( 9): Result.005 file - promoters50/1572151
cgtacattt

SEQ ID NO: 175985 - DNA, 9 bp, Unknown
  misc_feature (1)..( 9): Result.005 file - promoters50/1572151
tatatatca

SEQ ID NO: 175986 - DNA, 9 bp, Unknown
  misc_feature (1)..( 9): Result.005 file - promoters50/1572151
agtatataa

SEQ ID NO: 175987 - DNA, 10 bp, Unknown
  misc_feature (1)..( 10): Result.005 file - promoters50/1572151
ataattttag

SEQ ID NO: 175988 - DNA, 10 bp, Unknown
  misc_feature (1)..( 10): Result.005 file - promoters50/1572151
aaaatattac

SEQ ID NO: 175989 - DNA, 10 bp, Unknown
  misc_feature (1)..( 10): Result.005 file - promoters50/1572151
atatttttag

SEQ ID NO: 175990 - DNA, 10 bp, Unknown
  misc_feature (1)..( 10): Result.005 file - promoters50/1572151
cttattttat

SEQ ID NO: 175991 - DNA, 10 bp, Unknown
  misc_feature (1)..( 10): Result.005 file - promoters50/1572151
aaaatattat

SEQ ID NO: 175992 - DNA, 10 bp, Unknown
  misc_feature (1)..( 10): Result.005 file - promoters50/1572151
tcaattttaa

SEQ ID NO: 175993 - DNA, 10 bp, Unknown
  misc_feature (1)..( 10): Result.005 file - promoters50/1572151
gcaatgttaa

SEQ ID NO: 175994 - DNA, 12 bp, Unknown
  misc_feature (1)..( 12): Result.005 file - promoters50/1572236
gtaaattaacca

SEQ ID NO: 175995 - DNA, 12 bp, Unknown
  misc_feature (1)..( 12): Result.005 file - promoters50/1572236
taaaattaaaaa

SEQ ID NO: 175996 - DNA, 12 bp, Unknown
  misc_feature (1)..( 12): Result.005 file - promoters50/1572236
agttattaactt

SEQ ID NO: 175997 - DNA, 12 bp, Unknown
  misc_feature (1)..( 12): Result.005 file - promoters50/1572236
taaaaataaaaa

SEQ ID NO: 175998 - DNA, 7 bp, Unknown
  misc_feature (1)..( 7): Result.005 file - promoters50/1572796
aatttca

SEQ ID NO: 175999 - DNA, 7 bp, Unknown
  misc_feature (1)..( 7): Result.005 file - promoters50/1572796
gatttca

SEQ ID NO: 176000 - DNA, 7 bp, Unknown
  misc_feature (1)..( 7): Result.005 file - promoters50/1572796
aatttcg

SEQ ID NO: 176001 - DNA, 8 bp, Unknown
  misc_feature (1)..( 8): Result.005 file - promoters50/1572796
tacagtaa

SEQ ID NO: 176002 - DNA, 8 bp, Unknown
  misc_feature (1)..( 8): Result.005 file - promoters50/1572796
tactgtat

SEQ ID NO: 176003 - DNA, 8 bp, Unknown
  misc_feature (1)..( 8): Result.005 file - promoters50/1572796
cgctgtat

SEQ ID NO: 176004 - DNA, 10 bp, Unknown
  misc_feature (1)..( 10): Result.005 file - promoters50/1573594
ttaaaaaaaa

SEQ ID NO: 176005 - DNA, 10 bp, Unknown
  misc_feature (1)..( 10): Result.005 file - promoters50/1573594
ttaaaacaag

SEQ ID NO: 176006 - DNA, 11 bp, Unknown
  misc_feature (1)..( 11): Result.005 file - promoters50/1573594
ttagaaaactc

SEQ ID NO: 176007 - DNA, 11 bp, Unknown
  misc_feature (1)..( 11): Result.005 file - promoters50/1573594
ttaaaacgtaa

SEQ ID NO: 176008 - DNA, 11 bp, Unknown
  misc_feature (1)..( 11): Result.005 file - promoters50/1573594
tgaaaatcgta

SEQ ID NO: 176009 - DNA, 11 bp, Unknown
  misc_feature (1)..( 11): Result.005 file - promoters50/1573594
ctaacacaccg

SEQ ID NO: 176010 - DNA, 7 bp, Unknown
  misc_feature (1)..( 7): Result.005 file - promoters50/1573651
ctacaaa

SEQ ID NO: 176011 - DNA, 7 bp, Unknown
  misc_feature (1)..( 7): Result.005 file - promoters50/1573651
ctacaat

SEQ ID NO: 176012 - DNA, 7 bp, Unknown
  misc_feature (1)..( 7): Result.005 file - promoters50/1573651
ctataaa

SEQ ID NO: 176013 - DNA, 7 bp, Unknown
  misc_feature (1)..( 7): Result.005 file - promoters50/1573651
ctacaaa

SEQ ID NO: 176014 - DNA, 8 bp, Unknown
  misc_feature (1)..( 8): Result.005 file - promoters50/1573651
caaactca

SEQ ID NO: 176015 - DNA, 8 bp, Unknown
  misc_feature (1)..( 8): Result.005 file - promoters50/1573651
caatctct

SEQ ID NO: 176016 - DNA, 8 bp, Unknown
  misc_feature (1)..( 8): Result.005 file - promoters50/1573651
caaactca

SEQ ID NO: 176017 - DNA, 8 bp, Unknown
  misc_feature (1)..( 8): Result.005 file - promoters50/1573651
taatctct

SEQ ID NO: 176018 - DNA, 9 bp, Unknown
  misc_feature (1)..( 9): Result.005 file - promoters50/1573651
aatcataac

SEQ ID NO: 176019 - DNA, 9 bp, Unknown
  misc_feature (1)..( 9): Result.005 file - promoters50/1573651
aatcataaa

SEQ ID NO: 176020 - DNA, 9 bp, Unknown
  misc_feature (1)..( 9): Result.005 file - promoters50/1573651
aatcataac

SEQ ID NO: 176021 - DNA, 9 bp, Unknown
  misc_feature (1)..( 9): Result.005 file - promoters50/1573651
aatcaaaaa

SEQ ID NO: 176022 - DNA, 8 bp, Unknown
  misc_feature (1)..( 8): Result.005 file - promoters50/1573713
taaacata

SEQ ID NO: 176023 - DNA, 8 bp, Unknown
  misc_feature (1)..( 8): Result.005 file - promoters50/1573713
gaaatata

SEQ ID NO: 176024 - DNA, 8 bp, Unknown
  misc_feature (1)..( 8): Result.005 file - promoters50/1573713
taaaaata

SEQ ID NO: 176025 - DNA, 8 bp, Unknown
  misc_feature (1)..( 8): Result.005 file - promoters50/1573713
tatatata

SEQ ID NO: 176026 - DNA, 10 bp, Unknown
  misc_feature (1)..( 10): Result.005 file - promoters50/1573713
ataaacgaca

SEQ ID NO: 176027 - DNA, 10 bp, Unknown
  misc_feature (1)..( 10): Result.005 file - promoters50/1573713
ataagcgaca

SEQ ID NO: 176028 - DNA, 10 bp, Unknown
  misc_feature (1)..( 10): Result.005 file - promoters50/1573713
ccaaacgatt

SEQ ID NO: 176029 - DNA, 10 bp, Unknown
  misc_feature (1)..( 10): Result.005 file - promoters50/1573713
taaaacaatt

SEQ ID NO: 176030 - DNA, 9 bp, Unknown
  misc_feature (1)..( 9): Result.005 file - promoters50/1573713
tttatatga

SEQ ID NO: 176031 - DNA, 9 bp, Unknown
  misc_feature (1)..( 9): Result.005 file - promoters50/1573713
tttatttga

SEQ ID NO: 176032 - DNA, 9 bp, Unknown
  misc_feature (1)..( 9): Result.005 file - promoters50/1573713
tttatatta

SEQ ID NO: 176033 - DNA, 7 bp, Unknown
  misc_feature (1)..( 7): Result.005 file - promoters50/1573713
taatctc

SEQ ID NO: 176034 - DNA, 7 bp, Unknown
  misc_feature (1)..( 7): Result.005 file - promoters50/1573713
taatctt

SEQ ID NO: 176035 - DNA, 7 bp, Unknown
  misc_feature (1)..( 7): Result.005 file - promoters50/1573713
aaatctc

SEQ ID NO: 176036 - DNA, 10 bp, Unknown
  misc_feature (1)..( 10): Result.005 file - promoters50/1573713
attaataatt

SEQ ID NO: 176037 - DNA, 10 bp, Unknown
  misc_feature (1)..( 10): Result.005 file - promoters50/1573713
attagtaatt

SEQ ID NO: 176038 - DNA, 10 bp, Unknown
  misc_feature (1)..( 10): Result.005 file - promoters50/1573713
gttattaagg

SEQ ID NO: 176039 - DNA, 10 bp, Unknown
  misc_feature (1)..( 10): Result.005 file - promoters50/1573713
tagagttatt

SEQ ID NO: 176040 - DNA, 14 bp, Unknown
  misc_feature (1)..( 14): Result.005 file - promoters50/1573980
aaaccaatagaaaa

SEQ ID NO: 176041 - DNA, 14 bp, Unknown
  misc_feature (1)..( 14): Result.005 file - promoters50/1573980
gttaaaatataaac

SEQ ID NO: 176042 - DNA, 15 bp, Unknown
  misc_feature (1)..( 15): Result.005 file - promoters50/1573980
tgtaaaattatatct

SEQ ID NO: 176043 - DNA, 15 bp, Unknown
  misc_feature (1)..( 15): Result.005 file - promoters50/1573980
tttaaagttaatcac

SEQ ID NO: 176044 - DNA, 15 bp, Unknown
  misc_feature (1)..( 15): Result.005 file - promoters50/1573980
cagtagcatacaaac

SEQ ID NO: 176045 - DNA, 15 bp, Unknown
  misc_feature (1)..( 15): Result.005 file - promoters50/1573980
ttttcctttacaaaa

SEQ ID NO: 176046 - DNA, 11 bp, Unknown
  misc_feature (1)..( 11): Result.005 file - promoters50/1573980
taattttgtta

SEQ ID NO: 176047 - DNA, 11 bp, Unknown
  misc_feature (1)..( 11): Result.005 file - promoters50/1573980
gaaatttgttc

SEQ ID NO: 176048 - DNA, 11 bp, Unknown
  misc_feature (1)..( 11): Result.005 file - promoters50/1573980
tctttttcttc

SEQ ID NO: 176049 - DNA, 11 bp, Unknown
  misc_feature (1)..( 11): Result.005 file - promoters50/1573980
aaaattagttt

SEQ ID NO: 176050 - DNA, 11 bp, Unknown
  misc_feature (1)..( 11): Result.005 file - promoters50/1573980
aaagttatgcg

SEQ ID NO: 176051 - DNA, 11 bp, Unknown
  misc_feature (1)..( 11): Result.005 file - promoters50/1573980
ttatttatttt

SEQ ID NO: 176052 - DNA, 11 bp, Unknown
  misc_feature (1)..( 11): Result.005 file - promoters50/1573980
aaagttatgaa

SEQ ID NO: 176053 - DNA, 10 bp, Unknown
  misc_feature (1)..( 10): Result.005 file - promoters50/1573980
ggaaatgact

SEQ ID NO: 176054 - DNA, 10 bp, Unknown
  misc_feature (1)..( 10): Result.005 file - promoters50/1573980
ttttatgact

SEQ ID NO: 176055 - DNA, 10 bp, Unknown
  misc_feature (1)..( 10): Result.005 file - promoters50/1573980
ttaaaagact

SEQ ID NO: 176056 - DNA, 10 bp, Unknown
  misc_feature (1)..( 10): Result.005 file - promoters50/1573980
ccaaaagaga

SEQ ID NO: 176057 - DNA, 10 bp, Unknown
  misc_feature (1)..( 10): Result.005 file - promoters50/1573980
ggaaatgact

SEQ ID NO: 176058 - DNA, 10 bp, Unknown
  misc_feature (1)..( 10): Result.005 file - promoters50/1573980
ggagatgtgc

SEQ ID NO: 176059 - DNA, 9 bp, Unknown
  misc_feature (1)..( 9): Result.005 file - promoters50/1573982
atatttttt

SEQ ID NO: 176060 - DNA, 9 bp, Unknown
  misc_feature (1)..( 9): Result.005 file - promoters50/1573982
atatctttt

SEQ ID NO: 176061 - DNA, 9 bp, Unknown
  misc_feature (1)..( 9): Result.005 file - promoters50/1573982
aagtttttg

SEQ ID NO: 176062 - DNA, 8 bp, Unknown
  misc_feature (1)..( 8): Result.005 file - promoters50/1573982
gattcatt

SEQ ID NO: 176063 - DNA, 8 bp, Unknown
  misc_feature (1)..( 8): Result.005 file - promoters50/1573982
aattgatt

SEQ ID NO: 176064 - DNA, 8 bp, Unknown
  misc_feature (1)..( 8): Result.005 file - promoters50/1573982
aattgatc

SEQ ID NO: 176065 - DNA, 9 bp, Unknown
  misc_feature (1)..( 9): Result.005 file - promoters50/1574021
gttaaataa

SEQ ID NO: 176066 - DNA, 9 bp, Unknown
  misc_feature (1)..( 9): Result.005 file - promoters50/1574021
cttagataa

SEQ ID NO: 176067 - DNA, 9 bp, Unknown
  misc_feature (1)..( 9): Result.005 file - promoters50/1574021
tataaatac

SEQ ID NO: 176068 - DNA, 9 bp, Unknown
  misc_feature (1)..( 9): Result.005 file - promoters50/1574021
gtttaatat

SEQ ID NO: 176069 - DNA, 13 bp, Unknown
  misc_feature (1)..( 13): Result.005 file - promoters50/1574021
tgttatctattgt

SEQ ID NO: 176070 - DNA, 13 bp, Unknown
  misc_feature (1)..( 13): Result.005 file - promoters50/1574021
acctatgtatcct

SEQ ID NO: 176071 - DNA, 13 bp, Unknown
  misc_feature (1)..( 13): Result.005 file - promoters50/1574021
tgttatcaattgt

SEQ ID NO: 176072 - DNA, 13 bp, Unknown
  misc_feature (1)..( 13): Result.005 file - promoters50/1574021
aattataaataat

SEQ ID NO: 176073 - DNA, 7 bp, Unknown
  misc_feature (1)..( 7): Result.005 file - promoters50/1574029
atgagga

SEQ ID NO: 176074 - DNA, 7 bp, Unknown
  misc_feature (1)..( 7): Result.005 file - promoters50/1574029
atgtgga

SEQ ID NO: 176075 - DNA, 7 bp, Unknown
  misc_feature (1)..( 7): Result.005 file - promoters50/1574029
atgtggt

SEQ ID NO: 176076 - DNA, 7 bp, Unknown
  misc_feature (1)..( 7): Result.005 file - promoters50/1574044
taataca

SEQ ID NO: 176077 - DNA, 7 bp, Unknown
  misc_feature (1)..( 7): Result.005 file - promoters50/1574044
taaaaca

SEQ ID NO: 176078 - DNA, 7 bp, Unknown
  misc_feature (1)..( 7): Result.005 file - promoters50/1574044
taagaca

SEQ ID NO: 176079 - DNA, 10 bp, Unknown
  misc_feature (1)..( 10): Result.005 file - promoters50/1574044
ttaattaaaa

SEQ ID NO: 176080 - DNA, 10 bp, Unknown
  misc_feature (1)..( 10): Result.005 file - promoters50/1574044
ataaataaaa

SEQ ID NO: 176081 - DNA, 10 bp, Unknown
  misc_feature (1)..( 10): Result.005 file - promoters50/1574044
ttaactaaac

SEQ ID NO: 176082 - DNA, 10 bp, Unknown
  misc_feature (1)..( 10): Result.005 file - promoters50/1574044
atacatagca

SEQ ID NO: 176083 - DNA, 12 bp, Unknown
  misc_feature (1)..( 12): Result.005 file - promoters50/1574044
tgtctaaaacaa

SEQ ID NO: 176084 - DNA, 12 bp, Unknown
  misc_feature (1)..( 12): Result.005 file - promoters50/1574044
tgtgtaaaagtt

SEQ ID NO: 176085 - DNA, 12 bp, Unknown
  misc_feature (1)..( 12): Result.005 file - promoters50/1574044
ccactaaaccaa

SEQ ID NO: 176086 - DNA, 11 bp, Unknown
  misc_feature (1)..( 11): Result.005 file - promoters50/1574044
atagtaaataa

SEQ ID NO: 176087 - DNA, 11 bp, Unknown
  misc_feature (1)..( 11): Result.005 file - promoters50/1574044
atagtcaataa

SEQ ID NO: 176088 - DNA, 11 bp, Unknown
  misc_feature (1)..( 11): Result.005 file - promoters50/1574044
ataataattgg

SEQ ID NO: 176089 - DNA, 7 bp, Unknown
  misc_feature (1)..( 7): Result.005 file - promoters50/1574059
ctaaaac

SEQ ID NO: 176090 - DNA, 7 bp, Unknown
  misc_feature (1)..( 7): Result.005 file - promoters50/1574059
gtaaaac

SEQ ID NO: 176091 - DNA, 7 bp, Unknown
  misc_feature (1)..( 7): Result.005 file - promoters50/1574059
gtaaaac

SEQ ID NO: 176092 - DNA, 11 bp, Unknown
  misc_feature (1)..( 11): Result.005 file - promoters50/1580171
aaaaaattcag

SEQ ID NO: 176093 - DNA, 11 bp, Unknown
  misc_feature (1)..( 11): Result.005 file - promoters50/1580171
gtaaaattccc

SEQ ID NO: 176094 - DNA, 11 bp, Unknown
  misc_feature (1)..( 11): Result.005 file - promoters50/1580171
tttaaattctt

SEQ ID NO: 176095 - DNA, 11 bp, Unknown
  misc_feature (1)..( 11): Result.005 file - promoters50/1580171
gacaaataaat

SEQ ID NO: 176096 - DNA, 11 bp, Unknown
  misc_feature (1)..( 11): Result.005 file - promoters50/1580171
cttatattttt

SEQ ID NO: 176097 - DNA, 11 bp, Unknown
  misc_feature (1)..( 11): Result.005 file - promoters50/1580171
tttgaattgtg

SEQ ID NO: 176098 - DNA, 10 bp, Unknown
  misc_feature (1)..( 10): Result.005 file - promoters50/1580171
aatttgtaaa

SEQ ID NO: 176099 - DNA, 10 bp, Unknown
  misc_feature (1)..( 10): Result.005 file - promoters50/1580171
tttttataat

SEQ ID NO: 176100 - DNA, 10 bp, Unknown
  misc_feature (1)..( 10): Result.005 file - promoters50/1580171
aatatgttaa

SEQ ID NO: 176101 - DNA, 11 bp, Unknown
  misc_feature (1)..( 11): Result.005 file - promoters50/1580171
cgtttgatata

SEQ ID NO: 176102 - DNA, 11 bp, Unknown
  misc_feature (1)..( 11): Result.005 file - promoters50/1580171
acattgatata

SEQ ID NO: 176103 - DNA, 11 bp, Unknown
  misc_feature (1)..( 11): Result.005 file - promoters50/1580171
acagtgatcac

SEQ ID NO: 176104 - DNA, 12 bp, Unknown
  misc_feature (1)..( 12): Result.005 file - promoters50/1580171
ttgggttgaaca

SEQ ID NO: 176105 - DNA, 12 bp, Unknown
  misc_feature (1)..( 12): Result.005 file - promoters50/1580171
ttggattgatga

SEQ ID NO: 176106 - DNA, 12 bp, Unknown
  misc_feature (1)..( 12): Result.005 file - promoters50/1580171
ctctgttaaacc

SEQ ID NO: 176107 - DNA, 12 bp, Unknown
  misc_feature (1)..( 12): Result.005 file - promoters50/1580171
ctttattgaatt

SEQ ID NO: 176108 - DNA, 12 bp, Unknown
  misc_feature (1)..( 12): Result.005 file - promoters50/1580171
agctgtcaaaac

SEQ ID NO: 176109 - DNA, 12 bp, Unknown
  misc_feature (1)..( 12): Result.005 file - promoters50/1580171
ttttgtgaaaaa

SEQ ID NO: 176110 - DNA, 10 bp, Unknown
  misc_feature (1)..( 10): Result.005 file - promoters50/1580263
ctaattttag

SEQ ID NO: 176111 - DNA, 10 bp, Unknown
  misc_feature (1)..( 10): Result.005 file - promoters50/1580263
ctaattaaat

SEQ ID NO: 176112 - DNA, 10 bp, Unknown
  misc_feature (1)..( 10): Result.005 file - promoters50/1580263
ttaatgaaat

SEQ ID NO: 176113 - DNA, 15 bp, Unknown
  misc_feature (1)..( 15): Result.005 file - promoters50/1580298
tgaaaacatttttag

SEQ ID NO: 176114 - DNA, 15 bp, Unknown
  misc_feature (1)..( 15): Result.005 file - promoters50/1580298
tgtaaacattacata

SEQ ID NO: 176115 - DNA, 16 bp, Unknown
  misc_feature (1)..( 16): Result.005 file - promoters50/1580298
atgaaatcatgtattt

SEQ ID NO: 176116 - DNA, 16 bp, Unknown
  misc_feature (1)..( 16): Result.005 file - promoters50/1580298
tcgaaatcatcacccc

SEQ ID NO: 176117 - DNA, 16 bp, Unknown
  misc_feature (1)..( 16): Result.005 file - promoters50/1580298
cacatgacattacata

SEQ ID NO: 176118 - DNA, 16 bp, Unknown
  misc_feature (1)..( 16): Result.005 file - promoters50/1580298
aaaaggttattccatg

SEQ ID NO: 176119 - DNA, 8 bp, Unknown
  misc_feature (1)..( 8): Result.005 file - promoters50/1580481
tttataca

SEQ ID NO: 176120 - DNA, 8 bp, Unknown
  misc_feature (1)..( 8): Result.005 file - promoters50/1580481
tttataaa

SEQ ID NO: 176121 - DNA, 8 bp, Unknown
  misc_feature (1)..( 8): Result.005 file - promoters50/1580481
attatact

SEQ ID NO: 176122 - DNA, 8 bp, Unknown
  misc_feature (1)..( 8): Result.005 file - promoters50/1580481
tttgtaaa

SEQ ID NO: 176123 - DNA, 8 bp, Unknown
  misc_feature (1)..( 8): Result.005 file - promoters50/1580481
tttgtatt

SEQ ID NO: 176124 - DNA, 10 bp, Unknown
  misc_feature (1)..( 10): Result.005 file - promoters50/1580481
tttctttaac

SEQ ID NO: 176125 - DNA, 10 bp, Unknown
  misc_feature (1)..( 10): Result.005 file - promoters50/1580481
tttctttatt

SEQ ID NO: 176126 - DNA, 10 bp, Unknown
  misc_feature (1)..( 10): Result.005 file - promoters50/1580481
cttcatttgt

SEQ ID NO: 176127 - DNA, 10 bp, Unknown
  misc_feature (1)..( 10): Result.005 file - promoters50/1580481
tttcatttgt

SEQ ID NO: 176128 - DNA, 10 bp, Unknown
  misc_feature (1)..( 10): Result.005 file - promoters50/1580481
ttttatctca

SEQ ID NO: 176129 - DNA, 11 bp, Unknown
  misc_feature (1)..( 11): Result.005 file - promoters50/1580481
ttcatttgtta

SEQ ID NO: 176130 - DNA, 11 bp, Unknown
  misc_feature (1)..( 11): Result.005 file - promoters50/1580481
tagctttttta

SEQ ID NO: 176131 - DNA, 11 bp, Unknown
  misc_feature (1)..( 11): Result.005 file - promoters50/1580481
ttcatttgtaa

SEQ ID NO: 176132 - DNA, 11 bp, Unknown
  misc_feature (1)..( 11): Result.005 file - promoters50/1580481
tcttgttgtta

SEQ ID NO: 176133 - DNA, 11 bp, Unknown
  misc_feature (1)..( 11): Result.005 file - promoters50/1580481
cttgtttgtat

SEQ ID NO: 176134 - DNA, 19 bp, Unknown
  misc_feature (1)..( 19): Result.005 file - promoters50/1580500
tgtaaagcatataaattgt

SEQ ID NO: 176135 - DNA, 19 bp, Unknown
  misc_feature (1)..( 19): Result.005 file - promoters50/1580500
agaaaatcattaacaaata

SEQ ID NO: 176136 - DNA, 19 bp, Unknown
  misc_feature (1)..( 19): Result.005 file - promoters50/1580500
tttaaatcatatagaatgg

SEQ ID NO: 176137 - DNA, 19 bp, Unknown
  misc_feature (1)..( 19): Result.005 file - promoters50/1580500
gtttaatccttaaccaata

SEQ ID NO: 176138 - DNA, 19 bp, Unknown
  misc_feature (1)..( 19): Result.005 file - promoters50/1580500
ttatcttcatataggaatt

SEQ ID NO: 176139 - DNA, 19 bp, Unknown
  misc_feature (1)..( 19): Result.005 file - promoters50/1580500
aacaaattttttttttaga

SEQ ID NO: 176140 - DNA, 14 bp, Unknown
  misc_feature (1)..( 14): Result.005 file - promoters50/1580500
taaagcatataaat

SEQ ID NO: 176141 - DNA, 14 bp, Unknown
  misc_feature (1)..( 14): Result.005 file - promoters50/1580500
gtcattatagaaaa

SEQ ID NO: 176142 - DNA, 14 bp, Unknown
  misc_feature (1)..( 14): Result.005 file - promoters50/1580500
atcttcatatagga

SEQ ID NO: 176143 - DNA, 14 bp, Unknown
  misc_feature (1)..( 14): Result.005 file - promoters50/1580500
agaagataataaat

SEQ ID NO: 176144 - DNA, 14 bp, Unknown
  misc_feature (1)..( 14): Result.005 file - promoters50/1580500
tattttttataaag

SEQ ID NO: 176145 - DNA, 14 bp, Unknown
  misc_feature (1)..( 14): Result.005 file - promoters50/1580500
taaatcatatagaa

SEQ ID NO: 176146 - DNA, 14 bp, Unknown
  misc_feature (1)..( 14): Result.005 file - promoters50/1580500
tttgacatttagtt

SEQ ID NO: 176147 - DNA, 11 bp, Unknown
  misc_feature (1)..( 11): Result.005 file - promoters50/1580511
tttcatttaat

SEQ ID NO: 176148 - DNA, 11 bp, Unknown
  misc_feature (1)..( 11): Result.005 file - promoters50/1580511
tttgatttgat

SEQ ID NO: 176149 - DNA, 11 bp, Unknown
  misc_feature (1)..( 11): Result.005 file - promoters50/1580511
tttgattaaaa

SEQ ID NO: 176150 - DNA, 11 bp, Unknown
  misc_feature (1)..( 11): Result.005 file - promoters50/1580511
tttaattgaca

SEQ ID NO: 176151 - DNA, 11 bp, Unknown
  misc_feature (1)..( 11): Result.005 file - promoters50/1580511
tttcattgaaa

SEQ ID NO: 176152 - DNA, 11 bp, Unknown
  misc_feature (1)..( 11): Result.005 file - promoters50/1580511
tattattcaaa

SEQ ID NO: 176153 - DNA, 15 bp, Unknown
  misc_feature (1)..( 15): Result.005 file - promoters50/1580511
gcaatttgtcttatg

SEQ ID NO: 176154 - DNA, 15 bp, Unknown
  misc_feature (1)..( 15): Result.005 file - promoters50/1580511
ttgatttgtatttgt

SEQ ID NO: 176155 - DNA, 15 bp, Unknown
  misc_feature (1)..( 15): Result.005 file - promoters50/1580511
gcaatttgtcttatg

SEQ ID NO: 176156 - DNA, 15 bp, Unknown
  misc_feature (1)..( 15): Result.005 file - promoters50/1580511
ttgttttgtttgtgg

SEQ ID NO: 176157 - DNA, 15 bp, Unknown
  misc_feature (1)..( 15): Result.005 file - promoters50/1580511
cacttttgtttttgg

SEQ ID NO: 176158 - DNA, 15 bp, Unknown
  misc_feature (1)..( 15): Result.005 file - promoters50/1580511
cttccatgtttttgc

SEQ ID NO: 176159 - DNA, 9 bp, Unknown
  misc_feature (1)..( 9): Result.005 file - promoters50/1580787
gatccttct

SEQ ID NO: 176160 - DNA, 9 bp, Unknown
  misc_feature (1)..( 9): Result.005 file - promoters50/1580787
catccatct

SEQ ID NO: 176161 - DNA, 9 bp, Unknown
  misc_feature (1)..( 9): Result.005 file - promoters50/1580787
catccacat

SEQ ID NO: 176162 - DNA, 9 bp, Unknown
  misc_feature (1)..( 9): Result.005 file - promoters50/1580870
tttccaaac

SEQ ID NO: 176163 - DNA, 9 bp, Unknown
  misc_feature (1)..( 9): Result.005 file - promoters50/1580870
tttctaaaa

SEQ ID NO: 176164 - DNA, 9 bp, Unknown
  misc_feature (1)..( 9): Result.005 file - promoters50/1580870
attctaact

SEQ ID NO: 176165 - DNA, 10 bp, Unknown
  misc_feature (1)..( 10): Result.005 file - promoters50/1580870
ggcctacaat

SEQ ID NO: 176166 - DNA, 9 bp, Unknown
  misc_feature (1)..( 9): Result.005 file - promoters50/1580870
aatgtctat

SEQ ID NO: 176167 - DNA, 9 bp, Unknown
  misc_feature (1)..( 9): Result.005 file - promoters50/1580870
cttgtatat

SEQ ID NO: 176168 - DNA, 9 bp, Unknown
  misc_feature (1)..( 9): Result.005 file - promoters50/1580870
aatatctga

SEQ ID NO: 176169 - DNA, 9 bp, Unknown
  misc_feature (1)..( 9): Result.005 file - promoters50/1580870
gaagtatat

SEQ ID NO: 176170 - DNA, 12 bp, Unknown
  misc_feature (1)..( 12): Result.005 file - promoters50/1580932
aattaaaataaa

SEQ ID NO: 176171 - DNA, 12 bp, Unknown
  misc_feature (1)..( 12): Result.005 file - promoters50/1580932
gatttaaattat

SEQ ID NO: 176172 - DNA, 12 bp, Unknown
  misc_feature (1)..( 12): Result.005 file - promoters50/1580932
aatgaaatttcc

SEQ ID NO: 176173 - DNA, 12 bp, Unknown
  misc_feature (1)..( 12): Result.005 file - promoters50/1580932
ggataaaaaaaa

SEQ ID NO: 176174 - DNA, 12 bp, Unknown
  misc_feature (1)..( 12): Result.005 file - promoters50/1580932
aatgaaatcatg

SEQ ID NO: 176175 - DNA, 12 bp, Unknown
  misc_feature (1)..( 12): Result.005 file - promoters50/1580932
tctgagatcggc

SEQ ID NO: 176176 - DNA, 12 bp, Unknown
  misc_feature (1)..( 12): Result.005 file - promoters50/1580932
tatgaaacgaag

SEQ ID NO: 176177 - DNA, 9 bp, Unknown
  misc_feature (1)..( 9): Result.005 file - promoters50/1580932
gaactaata

SEQ ID NO: 176178 - DNA, 9 bp, Unknown
  misc_feature (1)..( 9): Result.005 file - promoters50/1580932
aaactaatc

SEQ ID NO: 176179 - DNA, 9 bp, Unknown
  misc_feature (1)..( 9): Result.005 file - promoters50/1580932
aaacaaatt

SEQ ID NO: 176180 - DNA, 9 bp, Unknown
  misc_feature (1)..( 9): Result.005 file - promoters50/1580932
ccacttata

SEQ ID NO: 176181 - DNA, 9 bp, Unknown
  misc_feature (1)..( 9): Result.005 file - promoters50/1580932
gaaccaata

SEQ ID NO: 176182 - DNA, 9 bp, Unknown
  misc_feature (1)..( 9): Result.005 file - promoters50/1580932
caaccaact

SEQ ID NO: 176183 - DNA, 9 bp, Unknown
  misc_feature (1)..( 9): Result.005 file - promoters50/1580983
tatttttta

SEQ ID NO: 176184 - DNA, 9 bp, Unknown
  misc_feature (1)..( 9): Result.005 file - promoters50/1580983
aatttttgt

SEQ ID NO: 176185 - DNA, 9 bp, Unknown
  misc_feature (1)..( 9): Result.005 file - promoters50/1580983
tgtttttta

SEQ ID NO: 176186 - DNA, 9 bp, Unknown
  misc_feature (1)..( 9): Result.005 file - promoters50/1580983
gattttttt

SEQ ID NO: 176187 - DNA, 9 bp, Unknown
  misc_feature (1)..( 9): Result.005 file - promoters50/1580983
aattttaat

SEQ ID NO: 176188 - DNA, 12 bp, Unknown
  misc_feature (1)..( 12): Result.005 file - promoters50/1580983
tattcgacagaa

SEQ ID NO: 176189 - DNA, 12 bp, Unknown
  misc_feature (1)..( 12): Result.005 file - promoters50/1580983
ttttcaacattt

SEQ ID NO: 176190 - DNA, 12 bp, Unknown
  misc_feature (1)..( 12): Result.005 file - promoters50/1580983
tttttaactttt

SEQ ID NO: 176191 - DNA, 12 bp, Unknown
  misc_feature (1)..( 12): Result.005 file - promoters50/1580983
ctcacaacatgt

SEQ ID NO: 176192 - DNA, 12 bp, Unknown
  misc_feature (1)..( 12): Result.005 file - promoters50/1580983
aagtcaacagct

SEQ ID NO: 176193 - DNA, 14 bp, Unknown
  misc_feature (1)..( 14): Result.005 file - promoters50/1581038
ccaagaatattagt

SEQ ID NO: 176194 - DNA, 14 bp, Unknown
  misc_feature (1)..( 14): Result.005 file - promoters50/1581038
attcatatattagt

SEQ ID NO: 176195 - DNA, 14 bp, Unknown
  misc_feature (1)..( 14): Result.005 file - promoters50/1581038
atataaatatttaa

SEQ ID NO: 176196 - DNA, 14 bp, Unknown
  misc_feature (1)..( 14): Result.005 file - promoters50/1581038
tttaaaatctttca

SEQ ID NO: 176197 - DNA, 14 bp, Unknown
  misc_feature (1)..( 14): Result.005 file - promoters50/1581038
tctaaaatcttcca

SEQ ID NO: 176198 - DNA, 14 bp, Unknown
  misc_feature (1)..( 14): Result.005 file - promoters50/1581038
tttataatcatgct

SEQ ID NO: 176199 - DNA, 11 bp, Unknown
  misc_feature (1)..( 11): Result.005 file - promoters50/1581038
aataaataact

SEQ ID NO: 176200 - DNA, 11 bp, Unknown
  misc_feature (1)..( 11): Result.005 file - promoters50/1581038
tttaattaaaa

SEQ ID NO: 176201 - DNA, 11 bp, Unknown
  misc_feature (1)..( 11): Result.005 file - promoters50/1581038
aatatatatat

SEQ ID NO: 176202 - DNA, 11 bp, Unknown
  misc_feature (1)..( 11): Result.005 file - promoters50/1581038
tatatatatgt

SEQ ID NO: 176203 - DNA, 11 bp, Unknown
  misc_feature (1)..( 11): Result.005 file - promoters50/1581038
cctaattaacc

SEQ ID NO: 176204 - DNA, 11 bp, Unknown
  misc_feature (1)..( 11): Result.005 file - promoters50/1581038
gaactttaatt

SEQ ID NO: 176205 - DNA, 11 bp, Unknown
  misc_feature (1)..( 11): Result.005 file - promoters50/1581038
agaaattataa

SEQ ID NO: 176206 - DNA, 11 bp, Unknown
  misc_feature (1)..( 11): Result.005 file - promoters50/1581038
agaaattctat

SEQ ID NO: 176207 - DNA, 10 bp, Unknown
  misc_feature (1)..( 10): Result.005 file - promoters50/1581038
tatatataat

SEQ ID NO: 176208 - DNA, 10 bp, Unknown
  misc_feature (1)..( 10): Result.005 file - promoters50/1581038
tatttataac

SEQ ID NO: 176209 - DNA, 10 bp, Unknown
  misc_feature (1)..( 10): Result.005 file - promoters50/1581038
tatataaatc

SEQ ID NO: 176210 - DNA, 10 bp, Unknown
  misc_feature (1)..( 10): Result.005 file - promoters50/1581038
tataaataga

SEQ ID NO: 176211 - DNA, 10 bp, Unknown
  misc_feature (1)..( 10): Result.005 file - promoters50/1581038
gatataatac

SEQ ID NO: 176212 - DNA, 10 bp, Unknown
  misc_feature (1)..( 10): Result.005 file - promoters50/1581038
tgtttaaaac

SEQ ID NO: 176213 - DNA, 12 bp, Unknown
  misc_feature (1)..( 12): Result.005 file - promoters50/1581038
tatgtatttttc

SEQ ID NO: 176214 - DNA, 12 bp, Unknown
  misc_feature (1)..( 12): Result.005 file - promoters50/1581038
gttccatttttg

SEQ ID NO: 176215 - DNA, 12 bp, Unknown
  misc_feature (1)..( 12): Result.005 file - promoters50/1581038
cttatatttttc

SEQ ID NO: 176216 - DNA, 12 bp, Unknown
  misc_feature (1)..( 12): Result.005 file - promoters50/1581038
gtggtaatttga

SEQ ID NO: 176217 - DNA, 12 bp, Unknown
  misc_feature (1)..( 12): Result.005 file - promoters50/1581038
tagacattttat

SEQ ID NO: 176218 - DNA, 12 bp, Unknown
  misc_feature (1)..( 12): Result.005 file - promoters50/1581038
gtgttaattgtc

SEQ ID NO: 176219 - DNA, 9 bp, Unknown
  misc_feature (1)..( 9): Result.005 file - promoters50/1581165
taaaatacc

SEQ ID NO: 176220 - DNA, 9 bp, Unknown
  misc_feature (1)..( 9): Result.005 file - promoters50/1581165
aaaaataag

SEQ ID NO: 176221 - DNA, 9 bp, Unknown
  misc_feature (1)..( 9): Result.005 file - promoters50/1581165
taaaattag

SEQ ID NO: 176222 - DNA, 9 bp, Unknown
  misc_feature (1)..( 9): Result.005 file - promoters50/1581165
taaaataat

SEQ ID NO: 176223 - DNA, 9 bp, Unknown
  misc_feature (1)..( 9): Result.005 file - promoters50/1581165
acaaataaa

SEQ ID NO: 176224 - DNA, 9 bp, Unknown
  misc_feature (1)..( 9): Result.005 file - promoters50/1581165
ataaataag

SEQ ID NO: 176225 - DNA, 7 bp, Unknown
  misc_feature (1)..( 7): Result.005 file - promoters50/1581165
gaaaaaa

SEQ ID NO: 176226 - DNA, 7 bp, Unknown
  misc_feature (1)..( 7): Result.005 file - promoters50/1581165
caaaaaa

SEQ ID NO: 176227 - DNA, 8 bp, Unknown
  misc_feature (1)..( 8): Result.005 file - promoters50/1581165
taaataaa

SEQ ID NO: 176228 - DNA, 8 bp, Unknown
  misc_feature (1)..( 8): Result.005 file - promoters50/1581165
taaaaacg

SEQ ID NO: 176229 - DNA, 8 bp, Unknown
  misc_feature (1)..( 8): Result.005 file - promoters50/1581165
caaataaa

SEQ ID NO: 176230 - DNA, 8 bp, Unknown
  misc_feature (1)..( 8): Result.005 file - promoters50/1581165
caaacaaa

SEQ ID NO: 176231 - DNA, 8 bp, Unknown
  misc_feature (1)..( 8): Result.005 file - promoters50/1581165
aaattaaa

SEQ ID NO: 176232 - DNA, 12 bp, Unknown
  misc_feature (1)..( 12): Result.005 file - promoters50/1581165
tctatctctaag

SEQ ID NO: 176233 - DNA, 12 bp, Unknown
  misc_feature (1)..( 12): Result.005 file - promoters50/1581165
tctttctttttt

SEQ ID NO: 176234 - DNA, 12 bp, Unknown
  misc_feature (1)..( 12): Result.005 file - promoters50/1581165
tatatctccaag

SEQ ID NO: 176235 - DNA, 12 bp, Unknown
  misc_feature (1)..( 12): Result.005 file - promoters50/1581165
tttatttcggta

SEQ ID NO: 176236 - DNA, 12 bp, Unknown
  misc_feature (1)..( 12): Result.005 file - promoters50/1581165
catatttcagag

SEQ ID NO: 176237 - DNA, 12 bp, Unknown
  misc_feature (1)..( 12): Result.005 file - promoters50/1581165
tttatttactct

SEQ ID NO: 176238 - DNA, 12 bp, Unknown
  misc_feature (1)..( 12): Result.005 file - promoters50/1581165
cttcttttgtag

SEQ ID NO: 176239 - DNA, 9 bp, Unknown
  misc_feature (1)..( 9): Result.005 file - promoters50/1581165
aaaaaaaaa

SEQ ID NO: 176240 - DNA, 9 bp, Unknown
  misc_feature (1)..( 9): Result.005 file - promoters50/1581165
aaataaatg

SEQ ID NO: 176241 - DNA, 9 bp, Unknown
  misc_feature (1)..( 9): Result.005 file - promoters50/1581165
aaataaacc

SEQ ID NO: 176242 - DNA, 9 bp, Unknown
  misc_feature (1)..( 9): Result.005 file - promoters50/1581165
atatacatg

SEQ ID NO: 176243 - DNA, 9 bp, Unknown
  misc_feature (1)..( 9): Result.005 file - promoters50/1581165
acatatatg

SEQ ID NO: 176244 - DNA, 9 bp, Unknown
  misc_feature (1)..( 9): Result.005 file - promoters50/1581165
aaacacata

SEQ ID NO: 176245 - DNA, 9 bp, Unknown
  misc_feature (1)..( 9): Result.005 file - promoters50/1581165
aaataaggt

SEQ ID NO: 176246 - DNA, 8 bp, Unknown
  misc_feature (1)..( 8): Result.005 file - promoters50/1581223
tttaaatt

SEQ ID NO: 176247 - DNA, 8 bp, Unknown
  misc_feature (1)..( 8): Result.005 file - promoters50/1581223
tttgaatt

SEQ ID NO: 176248 - DNA, 9 bp, Unknown
  misc_feature (1)..( 9): Result.005 file - promoters50/1581223
tttcgaaat

SEQ ID NO: 176249 - DNA, 10 bp, Unknown
  misc_feature (1)..( 10): Result.005 file - promoters50/1581223
tcctagataa

SEQ ID NO: 176250 - DNA, 10 bp, Unknown
  misc_feature (1)..( 10): Result.005 file - promoters50/1581223
atctaaataa

SEQ ID NO: 176251 - DNA, 10 bp, Unknown
  misc_feature (1)..( 10): Result.005 file - promoters50/1581223
atcgaaatgt

SEQ ID NO: 176252 - DNA, 10 bp, Unknown
  misc_feature (1)..( 10): Result.005 file - promoters50/1581454
aagtaaaaaa

SEQ ID NO: 176253 - DNA, 10 bp, Unknown
  misc_feature (1)..( 10): Result.005 file - promoters50/1581454
tgtgaaaaaa

SEQ ID NO: 176254 - DNA, 10 bp, Unknown
  misc_feature (1)..( 10): Result.005 file - promoters50/1581454
acataaaaag

SEQ ID NO: 176255 - DNA, 10 bp, Unknown
  misc_feature (1)..( 10): Result.005 file - promoters50/1581454
cgtgagaaat

SEQ ID NO: 176256 - DNA, 10 bp, Unknown
  misc_feature (1)..( 10): Result.005 file - promoters50/1581454
cattaaacta

SEQ ID NO: 176257 - DNA, 12 bp, Unknown
  misc_feature (1)..( 12): Result.005 file - promoters50/1581987
atgtgtttctca

SEQ ID NO: 176258 - DNA, 12 bp, Unknown
  misc_feature (1)..( 12): Result.005 file - promoters50/1581987
ttatgtttctcg

SEQ ID NO: 176259 - DNA, 12 bp, Unknown
  misc_feature (1)..( 12): Result.005 file - promoters50/1581987
atgggtttgaaa

SEQ ID NO: 176260 - DNA, 12 bp, Unknown
  misc_feature (1)..( 12): Result.005 file - promoters50/1581987
gggcttttctcg

SEQ ID NO: 176261 - DNA, 12 bp, Unknown
  misc_feature (1)..( 12): Result.005 file - promoters50/1581987
tagtgattccac

SEQ ID NO: 176262 - DNA, 12 bp, Unknown
  misc_feature (1)..( 12): Result.005 file - promoters50/1581987
gattgattctca

SEQ ID NO: 176263 - DNA, 10 bp, Unknown
  misc_feature (1)..( 10): Result.005 file - promoters50/1582293
acatacatta

SEQ ID NO: 176264 - DNA, 10 bp, Unknown
  misc_feature (1)..( 10): Result.005 file - promoters50/1582293
atataaatta

SEQ ID NO: 176265 - DNA, 10 bp, Unknown
  misc_feature (1)..( 10): Result.005 file - promoters50/1582293
atatgaatca

SEQ ID NO: 176266 - DNA, 11 bp, Unknown
  misc_feature (1)..( 11): Result.005 file - promoters50/1582293
aaattacttac

SEQ ID NO: 176267 - DNA, 11 bp, Unknown
  misc_feature (1)..( 11): Result.005 file - promoters50/1582293
atattactata

SEQ ID NO: 176268 - DNA, 11 bp, Unknown
  misc_feature (1)..( 11): Result.005 file - promoters50/1582293
atagtacaata

SEQ ID NO: 176269 - DNA, 9 bp, Unknown
  misc_feature (1)..( 9): Result.005 file - promoters50/1582293
actaatgat

SEQ ID NO: 176270 - DNA, 9 bp, Unknown
  misc_feature (1)..( 9): Result.005 file - promoters50/1582293
tataatgat

SEQ ID NO: 176271 - DNA, 9 bp, Unknown
  misc_feature (1)..( 9): Result.005 file - promoters50/1582293
aataattac

SEQ ID NO: 176272 - DNA, 11 bp, Unknown
  misc_feature (1)..( 11): Result.005 file - promoters50/1582322
cacctttctct

SEQ ID NO: 176273 - DNA, 11 bp, Unknown
  misc_feature (1)..( 11): Result.005 file - promoters50/1582322
aatttttttct

SEQ ID NO: 176274 - DNA, 11 bp, Unknown
  misc_feature (1)..( 11): Result.005 file - promoters50/1582322
tctatttatct

SEQ ID NO: 176275 - DNA, 12 bp, Unknown
  misc_feature (1)..( 12): Result.005 file - promoters50/1582322
atgattgttttg

SEQ ID NO: 176276 - DNA, 10 bp, Unknown
  misc_feature (1)..( 10): Result.005 file - promoters50/1582322
aatatttata

SEQ ID NO: 176277 - DNA, 10 bp, Unknown
  misc_feature (1)..( 10): Result.005 file - promoters50/1582322
aatatatatg

SEQ ID NO: 176278 - DNA, 10 bp, Unknown
  misc_feature (1)..( 10): Result.005 file - promoters50/1582322
ggtatttgtt

SEQ ID NO: 176279 - DNA, 7 bp, Unknown
  misc_feature (1)..( 7): Result.005 file - promoters50/1582322
atttttt

SEQ ID NO: 176280 - DNA, 7 bp, Unknown
  misc_feature (1)..( 7): Result.005 file - promoters50/1582322
atttttc

SEQ ID NO: 176281 - DNA, 8 bp, Unknown
  misc_feature (1)..( 8): Result.005 file - promoters50/1582322
attgtttt

SEQ ID NO: 176282 - DNA, 10 bp, Unknown
  misc_feature (1)..( 10): Result.005 file - promoters50/1582322
ggtgtttgca

SEQ ID NO: 176283 - DNA, 10 bp, Unknown
  misc_feature (1)..( 10): Result.005 file - promoters50/1582322
ggtatttgtt

SEQ ID NO: 176284 - DNA, 10 bp, Unknown
  misc_feature (1)..( 10): Result.005 file - promoters50/1582322
tatatatgtt

SEQ ID NO: 176285 - DNA, 10 bp, Unknown
  misc_feature (1)..( 10): Result.005 file - promoters50/1582322
ttataattat

SEQ ID NO: 176286 - DNA, 10 bp, Unknown
  misc_feature (1)..( 10): Result.005 file - promoters50/1582322
ttacaataat

SEQ ID NO: 176287 - DNA, 10 bp, Unknown
  misc_feature (1)..( 10): Result.005 file - promoters50/1582322
aaataattat

SEQ ID NO: 176288 - DNA, 12 bp, Unknown
  misc_feature (1)..( 12): Result.005 file - promoters50/1582322
ccggaattttaa

SEQ ID NO: 176289 - DNA, 12 bp, Unknown
  misc_feature (1)..( 12): Result.005 file - promoters50/1582322
ataaaattataa

SEQ ID NO: 176290 - DNA, 12 bp, Unknown
  misc_feature (1)..( 12): Result.005 file - promoters50/1582322
atacaatgatat

SEQ ID NO: 176291 - DNA, 10 bp, Unknown
  misc_feature (1)..( 10): Result.005 file - promoters50/1582322
cttgaatcaa

SEQ ID NO: 176292 - DNA, 10 bp, Unknown
  misc_feature (1)..( 10): Result.005 file - promoters50/1582322
cttaaatatt

SEQ ID NO: 176293 - DNA, 10 bp, Unknown
  misc_feature (1)..( 10): Result.005 file - promoters50/1582322
aataaaaatt

SEQ ID NO: 176294 - DNA, 10 bp, Unknown
  misc_feature (1)..( 10): Result.005 file - promoters50/1582322
tcaatatttt

SEQ ID NO: 176295 - DNA, 10 bp, Unknown
  misc_feature (1)..( 10): Result.005 file - promoters50/1582322
taaatatttt

SEQ ID NO: 176296 - DNA, 10 bp, Unknown
  misc_feature (1)..( 10): Result.005 file - promoters50/1582322
taaaaattat

SEQ ID NO: 176297 - DNA, 12 bp, Unknown
  misc_feature (1)..( 12): Result.005 file - promoters50/1582339
cgaaagattaag

SEQ ID NO: 176298 - DNA, 12 bp, Unknown
  misc_feature (1)..( 12): Result.005 file - promoters50/1582339
agaaatattatt

SEQ ID NO: 176299 - DNA, 12 bp, Unknown
  misc_feature (1)..( 12): Result.005 file - promoters50/1582339
gaaaatgttatt

SEQ ID NO: 176300 - DNA, 12 bp, Unknown
  misc_feature (1)..( 12): Result.005 file - promoters50/1582339
atatatatgatt

SEQ ID NO: 176301 - DNA, 12 bp, Unknown
  misc_feature (1)..( 12): Result.005 file - promoters50/1582339
agaaatctcgac

SEQ ID NO: 176302 - DNA, 12 bp, Unknown
  misc_feature (1)..( 12): Result.005 file - promoters50/1582339
tatctaatatat

SEQ ID NO: 176303 - DNA, 12 bp, Unknown
  misc_feature (1)..( 12): Result.005 file - promoters50/1582339
cttttaatatta

SEQ ID NO: 176304 - DNA, 12 bp, Unknown
  misc_feature (1)..( 12): Result.005 file - promoters50/1582339
tatctaatttta

SEQ ID NO: 176305 - DNA, 12 bp, Unknown
  misc_feature (1)..( 12): Result.005 file - promoters50/1582339
ctttttataaat

SEQ ID NO: 176306 - DNA, 15 bp, Unknown
  misc_feature (1)..( 15): Result.005 file - promoters50/1582339
aaaaaaaactatcta

SEQ ID NO: 176307 - DNA, 15 bp, Unknown
  misc_feature (1)..( 15): Result.005 file - promoters50/1582339
attataaaatattat

SEQ ID NO: 176308 - DNA, 15 bp, Unknown
  misc_feature (1)..( 15): Result.005 file - promoters50/1582339
aaataaaacttctca

SEQ ID NO: 176309 - DNA, 15 bp, Unknown
  misc_feature (1)..( 15): Result.005 file - promoters50/1582339
ttttataaataaact

SEQ ID NO: 176310 - DNA, 9 bp, Unknown
  misc_feature (1)..( 9): Result.005 file - promoters50/1582349
atgttttta

SEQ ID NO: 176311 - DNA, 9 bp, Unknown
  misc_feature (1)..( 9): Result.005 file - promoters50/1582349
atgtttgct

SEQ ID NO: 176312 - DNA, 9 bp, Unknown
  misc_feature (1)..( 9): Result.005 file - promoters50/1582349
ttgttgtta

SEQ ID NO: 176313 - DNA, 10 bp, Unknown
  misc_feature (1)..( 10): Result.005 file - promoters50/1582349
ggtattattt

SEQ ID NO: 176314 - DNA, 10 bp, Unknown
  misc_feature (1)..( 10): Result.005 file - promoters50/1582349
tcaatttttt

SEQ ID NO: 176315 - DNA, 10 bp, Unknown
  misc_feature (1)..( 10): Result.005 file - promoters50/1582349
tcaagttttt

SEQ ID NO: 176316 - DNA, 11 bp, Unknown
  misc_feature (1)..( 11): Result.005 file - promoters50/1582551
aaaaaaaaaag

SEQ ID NO: 176317 - DNA, 11 bp, Unknown
  misc_feature (1)..( 11): Result.005 file - promoters50/1582551
aaaaagaaaag

SEQ ID NO: 176318 - DNA, 11 bp, Unknown
  misc_feature (1)..( 11): Result.005 file - promoters50/1582551
ttaaagtaaag

SEQ ID NO: 176319 - DNA, 9 bp, Unknown
  misc_feature (1)..( 9): Result.005 file - promoters50/1582551
aacacaaaa

SEQ ID NO: 176320 - DNA, 9 bp, Unknown
  misc_feature (1)..( 9): Result.005 file - promoters50/1582551
cccactaaa

SEQ ID NO: 176321 - DNA, 9 bp, Unknown
  misc_feature (1)..( 9): Result.005 file - promoters50/1582551
cccactaga

SEQ ID NO: 176322 - DNA, 9 bp, Unknown
  misc_feature (1)..( 9): Result.005 file - promoters50/1582576
aaagtaaaa

SEQ ID NO: 176323 - DNA, 9 bp, Unknown
  misc_feature (1)..( 9): Result.005 file - promoters50/1582576
agagtgaaa

SEQ ID NO: 176324 - DNA, 9 bp, Unknown
  misc_feature (1)..( 9): Result.005 file - promoters50/1582576
agagagaaa

SEQ ID NO: 176325 - DNA, 12 bp, Unknown
  misc_feature (1)..( 12): Result.005 file - promoters50/1582576
aaattaaaatat

SEQ ID NO: 176326 - DNA, 12 bp, Unknown
  misc_feature (1)..( 12): Result.005 file - promoters50/1582576
taattaatgggc

SEQ ID NO: 176327 - DNA, 12 bp, Unknown
  misc_feature (1)..( 12): Result.005 file - promoters50/1582576
aaaataatatat

SEQ ID NO: 176328 - DNA, 12 bp, Unknown
  misc_feature (1)..( 12): Result.005 file - promoters50/1582576
gaaaaaatgtat

SEQ ID NO: 176329 - DNA, 8 bp, Unknown
  misc_feature (1)..( 8): Result.005 file - promoters50/1582576
aataaaag

SEQ ID NO: 176330 - DNA, 8 bp, Unknown
  misc_feature (1)..( 8): Result.005 file - promoters50/1582576
aataaaaa

SEQ ID NO: 176331 - DNA, 8 bp, Unknown
  misc_feature (1)..( 8): Result.005 file - promoters50/1582576
aataaata

SEQ ID NO: 176332 - DNA, 8 bp, Unknown
  misc_feature (1)..( 8): Result.005 file - promoters50/1582576
aatagata

SEQ ID NO: 176333 - DNA, 7 bp, Unknown
  misc_feature (1)..( 7): Result.005 file - promoters50/1582576
aaagact

SEQ ID NO: 176334 - DNA, 7 bp, Unknown
  misc_feature (1)..( 7): Result.005 file - promoters50/1582576
aaaaact

SEQ ID NO: 176335 - DNA, 8 bp, Unknown
  misc_feature (1)..( 8): Result.005 file - promoters50/1582576
aaatgaca

SEQ ID NO: 176336 - DNA, 8 bp, Unknown
  misc_feature (1)..( 8): Result.005 file - promoters50/1582576
aaaataaa

SEQ ID NO: 176337 - DNA, 8 bp, Unknown
  misc_feature (1)..( 8): Result.005 file - promoters50/1582576
aaagtaaa

SEQ ID NO: 176338 - DNA, 8 bp, Unknown
  misc_feature (1)..( 8): Result.005 file - promoters50/1582576
aaaacaaa

SEQ ID NO: 176339 - DNA, 7 bp, Unknown
  misc_feature (1)..( 7): Result.005 file - promoters50/1582576
tatttag

SEQ ID NO: 176340 - DNA, 7 bp, Unknown
  misc_feature (1)..( 7): Result.005 file - promoters50/1582576
tatgtag

SEQ ID NO: 176341 - DNA, 7 bp, Unknown
  misc_feature (1)..( 7): Result.005 file - promoters50/1582576
tatttaa

SEQ ID NO: 176342 - DNA, 11 bp, Unknown
  misc_feature (1)..( 11): Result.005 file - promoters50/1582576
ttaaaatatat

SEQ ID NO: 176343 - DNA, 11 bp, Unknown
  misc_feature (1)..( 11): Result.005 file - promoters50/1582576
aaaaaatgtat

SEQ ID NO: 176344 - DNA, 11 bp, Unknown
  misc_feature (1)..( 11): Result.005 file - promoters50/1582576
ctaaaataata

SEQ ID NO: 176345 - DNA, 11 bp, Unknown
  misc_feature (1)..( 11): Result.005 file - promoters50/1582576
ctacaattttg

SEQ ID NO: 176346 - DNA, 8 bp, Unknown
  misc_feature (1)..( 8): Result.005 file - promoters50/1582576
gaataaat

SEQ ID NO: 176347 - DNA, 8 bp, Unknown
  misc_feature (1)..( 8): Result.005 file - promoters50/1582576
taattaat

SEQ ID NO: 176348 - DNA, 8 bp, Unknown
  misc_feature (1)..( 8): Result.005 file - promoters50/1582576
taactaat

SEQ ID NO: 176349 - DNA, 7 bp, Unknown
  misc_feature (1)..( 7): Result.005 file - promoters50/1582576
ttaaaat

SEQ ID NO: 176350 - DNA, 7 bp, Unknown
  misc_feature (1)..( 7): Result.005 file - promoters50/1582576
ctaaaat

SEQ ID NO: 176351 - DNA, 7 bp, Unknown
  misc_feature (1)..( 7): Result.005 file - promoters50/1582576
ctacaat

SEQ ID NO: 176352 - DNA, 7 bp, Unknown
  misc_feature (1)..( 7): Result.005 file - promoters50/1582576
taataat

SEQ ID NO: 176353 - DNA, 7 bp, Unknown
  misc_feature (1)..( 7): Result.005 file - promoters50/1582576
aaataat

SEQ ID NO: 176354 - DNA, 7 bp, Unknown
  misc_feature (1)..( 7): Result.005 file - promoters50/1582576
aaataac

SEQ ID NO: 176355 - DNA, 8 bp, Unknown
  misc_feature (1)..( 8): Result.005 file - promoters50/1582654
aaacaaag

SEQ ID NO: 176356 - DNA, 8 bp, Unknown
  misc_feature (1)..( 8): Result.005 file - promoters50/1582654
aaagaaag

SEQ ID NO: 176357 - DNA, 9 bp, Unknown
  misc_feature (1)..( 9): Result.005 file - promoters50/1582654
aaatcaacg

SEQ ID NO: 176358 - DNA, 8 bp, Unknown
  misc_feature (1)..( 8): Result.005 file - promoters50/1582654
aaaacaat

SEQ ID NO: 176359 - DNA, 8 bp, Unknown
  misc_feature (1)..( 8): Result.005 file - promoters50/1582654
taaacaaa

SEQ ID NO: 176360 - DNA, 8 bp, Unknown
  misc_feature (1)..( 8): Result.005 file - promoters50/1582654
aaaaaaaa

SEQ ID NO: 176361 - DNA, 8 bp, Unknown
  misc_feature (1)..( 8): Result.005 file - promoters50/1582654
taatcaat

SEQ ID NO: 176362 - DNA, 10 bp, Unknown
  misc_feature (1)..( 10): Result.005 file - promoters50/1582654
taaaaagaat

SEQ ID NO: 176363 - DNA, 10 bp, Unknown
  misc_feature (1)..( 10): Result.005 file - promoters50/1582654
aaaaaaaaat

SEQ ID NO: 176364 - DNA, 10 bp, Unknown
  misc_feature (1)..( 10): Result.005 file - promoters50/1582654
caaataaagg

SEQ ID NO: 176365 - DNA, 8 bp, Unknown
  misc_feature (1)..( 8): Result.005 file - promoters50/1582654
tgttttgt

SEQ ID NO: 176366 - DNA, 8 bp, Unknown
  misc_feature (1)..( 8): Result.005 file - promoters50/1582654
tgtttttg

SEQ ID NO: 176367 - DNA, 9 bp, Unknown
  misc_feature (1)..( 9): Result.005 file - promoters50/1582654
tgttcttgg

SEQ ID NO: 176368 - DNA, 11 bp, Unknown
  misc_feature (1)..( 11): Result.005 file - promoters50/1582658
cagcccagtca

SEQ ID NO: 176369 - DNA, 11 bp, Unknown
  misc_feature (1)..( 11): Result.005 file - promoters50/1582658
aataccaatca

SEQ ID NO: 176370 - DNA, 11 bp, Unknown
  misc_feature (1)..( 11): Result.005 file - promoters50/1582658
aatacaaatct

SEQ ID NO: 176371 - DNA, 11 bp, Unknown
  misc_feature (1)..( 11): Result.005 file - promoters50/1582658
gctacaaataa

SEQ ID NO: 176372 - DNA, 11 bp, Unknown
  misc_feature (1)..( 11): Result.005 file - promoters50/1582658
aaaacacataa

SEQ ID NO: 176373 - DNA, 11 bp, Unknown
  misc_feature (1)..( 11): Result.005 file - promoters50/1582658
tatacaaaaga

SEQ ID NO: 176374 - DNA, 8 bp, Unknown
  misc_feature (1)..( 8): Result.005 file - promoters50/1582786
ttcttttt

SEQ ID NO: 176375 - DNA, 8 bp, Unknown
  misc_feature (1)..( 8): Result.005 file - promoters50/1582786
atctattt

SEQ ID NO: 176376 - DNA, 8 bp, Unknown
  misc_feature (1)..( 8): Result.005 file - promoters50/1582786
ttcttttg

SEQ ID NO: 176377 - DNA, 8 bp, Unknown
  misc_feature (1)..( 8): Result.005 file - promoters50/1582786
ttcttttg

SEQ ID NO: 176378 - DNA, 8 bp, Unknown
  misc_feature (1)..( 8): Result.005 file - promoters50/1582786
gttttttg

SEQ ID NO: 176379 - DNA, 8 bp, Unknown
  misc_feature (1)..( 8): Result.005 file - promoters50/1583044
ttgtgtat

SEQ ID NO: 176380 - DNA, 8 bp, Unknown
  misc_feature (1)..( 8): Result.005 file - promoters50/1583044
ttgtatat

SEQ ID NO: 176381 - DNA, 8 bp, Unknown
  misc_feature (1)..( 8): Result.005 file - promoters50/1583044
aagtatat

SEQ ID NO: 176382 - DNA, 8 bp, Unknown
  misc_feature (1)..( 8): Result.005 file - promoters50/1583044
aaggatat

SEQ ID NO: 176383 - DNA, 9 bp, Unknown
  misc_feature (1)..( 9): Result.005 file - promoters50/1583350
tatagtttt

SEQ ID NO: 176384 - DNA, 9 bp, Unknown
  misc_feature (1)..( 9): Result.005 file - promoters50/1583350
catattttt

SEQ ID NO: 176385 - DNA, 9 bp, Unknown
  misc_feature (1)..( 9): Result.005 file - promoters50/1583350
tatatttaa

SEQ ID NO: 176386 - DNA, 13 bp, Unknown
  misc_feature (1)..( 13): Result.005 file - promoters50/1595585
attaaataattaa

SEQ ID NO: 176387 - DNA, 13 bp, Unknown
  misc_feature (1)..( 13): Result.005 file - promoters50/1595585
cccaaaaaatctg

SEQ ID NO: 176388 - DNA, 13 bp, Unknown
  misc_feature (1)..( 13): Result.005 file - promoters50/1595585
taaaaataattag

SEQ ID NO: 176389 - DNA, 13 bp, Unknown
  misc_feature (1)..( 13): Result.005 file - promoters50/1595585
aaaacaaaatcat

SEQ ID NO: 176390 - DNA, 13 bp, Unknown
  misc_feature (1)..( 13): Result.005 file - promoters50/1595585
taagaaaaaccat

SEQ ID NO: 176391 - DNA, 13 bp, Unknown
  misc_feature (1)..( 13): Result.005 file - promoters50/1595585
aaaaaaaaattat

SEQ ID NO: 176392 - DNA, 14 bp, Unknown
  misc_feature (1)..( 14): Result.005 file - promoters50/1595585
tgtgaaaaacgtgt

SEQ ID NO: 176393 - DNA, 14 bp, Unknown
  misc_feature (1)..( 14): Result.005 file - promoters50/1595585
taagaaaaaccata

SEQ ID NO: 176394 - DNA, 14 bp, Unknown
  misc_feature (1)..( 14): Result.005 file - promoters50/1595585
aaacaaaatcatta

SEQ ID NO: 176395 - DNA, 14 bp, Unknown
  misc_feature (1)..( 14): Result.005 file - promoters50/1595585
aaagataaattgtc

SEQ ID NO: 176396 - DNA, 14 bp, Unknown
  misc_feature (1)..( 14): Result.005 file - promoters50/1595585
gtaaaaaaaaaaat

SEQ ID NO: 176397 - DNA, 14 bp, Unknown
  misc_feature (1)..( 14): Result.005 file - promoters50/1595585
aaataaaaattggg

SEQ ID NO: 176398 - DNA, 9 bp, Unknown
  misc_feature (1)..( 9): Result.005 file - promoters50/1595635
acctgaatc

SEQ ID NO: 176399 - DNA, 9 bp, Unknown
  misc_feature (1)..( 9): Result.005 file - promoters50/1595635
accagaaaa

SEQ ID NO: 176400 - DNA, 9 bp, Unknown
  misc_feature (1)..( 9): Result.005 file - promoters50/1595635
tgctggatc

SEQ ID NO: 176401 - DNA, 7 bp, Unknown
  misc_feature (1)..( 7): Result.005 file - promoters50/1595635
caaactg

SEQ ID NO: 176402 - DNA, 7 bp, Unknown
  misc_feature (1)..( 7): Result.005 file - promoters50/1595635
aaaactg

SEQ ID NO: 176403 - DNA, 8 bp, Unknown
  misc_feature (1)..( 8): Result.005 file - promoters50/1595635
taacactc

SEQ ID NO: 176404 - DNA, 8 bp, Unknown
  misc_feature (1)..( 8): Result.005 file - promoters50/1595635
aaacatat

SEQ ID NO: 176405 - DNA, 8 bp, Unknown
  misc_feature (1)..( 8): Result.005 file - promoters50/1595635
aaatatag

SEQ ID NO: 176406 - DNA, 8 bp, Unknown
  misc_feature (1)..( 8): Result.005 file - promoters50/1595635
taacttat

SEQ ID NO: 176407 - DNA, 7 bp, Unknown
  misc_feature (1)..( 7): Result.005 file - promoters50/1595663
atctaac

SEQ ID NO: 176408 - DNA, 7 bp, Unknown
  misc_feature (1)..( 7): Result.005 file - promoters50/1595663
ttctaac

SEQ ID NO: 176409 - DNA, 7 bp, Unknown
  misc_feature (1)..( 7): Result.005 file - promoters50/1595663
ttctaaa

SEQ ID NO: 176410 - DNA, 7 bp, Unknown
  misc_feature (1)..( 7): Result.005 file - promoters50/1595663
tttcagt

SEQ ID NO: 176411 - DNA, 7 bp, Unknown
  misc_feature (1)..( 7): Result.005 file - promoters50/1595663
cttcagt

SEQ ID NO: 176412 - DNA, 7 bp, Unknown
  misc_feature (1)..( 7): Result.005 file - promoters50/1595663
cttcaga

SEQ ID NO: 176413 - DNA, 7 bp, Unknown
  misc_feature (1)..( 7): Result.005 file - promoters50/1595663
caatatg

SEQ ID NO: 176414 - DNA, 7 bp, Unknown
  misc_feature (1)..( 7): Result.005 file - promoters50/1595663
caatatt

SEQ ID NO: 176415 - DNA, 7 bp, Unknown
  misc_feature (1)..( 7): Result.005 file - promoters50/1595663
caaaatt

SEQ ID NO: 176416 - DNA, 9 bp, Unknown
  misc_feature (1)..( 9): Result.005 file - promoters50/1595663
caaacttat

SEQ ID NO: 176417 - DNA, 9 bp, Unknown
  misc_feature (1)..( 9): Result.005 file - promoters50/1595663
caaaattat

SEQ ID NO: 176418 - DNA, 9 bp, Unknown
  misc_feature (1)..( 9): Result.005 file - promoters50/1595663
caatatttg

SEQ ID NO: 176419 - DNA, 7 bp, Unknown
  misc_feature (1)..( 7): Result.005 file - promoters50/1595663
tttaatt

SEQ ID NO: 176420 - DNA, 7 bp, Unknown
  misc_feature (1)..( 7): Result.005 file - promoters50/1595663
tttgatt

SEQ ID NO: 176421 - DNA, 7 bp, Unknown
  misc_feature (1)..( 7): Result.005 file - promoters50/1595663
attaatt

SEQ ID NO: 176422 - DNA, 9 bp, Unknown
  misc_feature (1)..( 9): Result.005 file - promoters50/1595674
caaacataa

SEQ ID NO: 176423 - DNA, 9 bp, Unknown
  misc_feature (1)..( 9): Result.005 file - promoters50/1595674
taaagataa

SEQ ID NO: 176424 - DNA, 9 bp, Unknown
  misc_feature (1)..( 9): Result.005 file - promoters50/1595674
taaagacta

SEQ ID NO: 176425 - DNA, 9 bp, Unknown
  misc_feature (1)..( 9): Result.005 file - promoters50/1595678
aatgatttt

SEQ ID NO: 176426 - DNA, 9 bp, Unknown
  misc_feature (1)..( 9): Result.005 file - promoters50/1595678
tctgagttt

SEQ ID NO: 176427 - DNA, 9 bp, Unknown
  misc_feature (1)..( 9): Result.005 file - promoters50/1595678
aattattgc

SEQ ID NO: 176428 - DNA, 8 bp, Unknown
  misc_feature (1)..( 8): Result.005 file - promoters50/1595678
ctacaaaa

SEQ ID NO: 176429 - DNA, 8 bp, Unknown
  misc_feature (1)..( 8): Result.005 file - promoters50/1595678
tcacaaaa

SEQ ID NO: 176430 - DNA, 8 bp, Unknown
  misc_feature (1)..( 8): Result.005 file - promoters50/1595678
acacaaat

SEQ ID NO: 176431 - DNA, 8 bp, Unknown
  misc_feature (1)..( 8): Result.005 file - promoters50/1595678
ttataaat

SEQ ID NO: 176432 - DNA, 8 bp, Unknown
  misc_feature (1)..( 8): Result.005 file - promoters50/1595678
ttacaaaa

SEQ ID NO: 176433 - DNA, 9 bp, Unknown
  misc_feature (1)..( 9): Result.005 file - promoters50/1595678
ttacacaaa

SEQ ID NO: 176434 - DNA, 9 bp, Unknown
  misc_feature (1)..( 9): Result.005 file - promoters50/1595687
ttttgaaat

SEQ ID NO: 176435 - DNA, 9 bp, Unknown
  misc_feature (1)..( 9): Result.005 file - promoters50/1595687
tttggaaaa

SEQ ID NO: 176436 - DNA, 9 bp, Unknown
  misc_feature (1)..( 9): Result.005 file - promoters50/1595687
aaatgaaat

SEQ ID NO: 176437 - DNA, 9 bp, Unknown
  misc_feature (1)..( 9): Result.005 file - promoters50/1595687
caaggaaac

SEQ ID NO: 176438 - DNA, 9 bp, Unknown
  misc_feature (1)..( 9): Result.005 file - promoters50/1595687
aaagtaaag

SEQ ID NO: 176439 - DNA, 9 bp, Unknown
  misc_feature (1)..( 9): Result.005 file - promoters50/1595687
aaagaaaag

SEQ ID NO: 176440 - DNA, 10 bp, Unknown
  misc_feature (1)..( 10): Result.005 file - promoters50/1595703
aataatacaa

SEQ ID NO: 176441 - DNA, 10 bp, Unknown
  misc_feature (1)..( 10): Result.005 file - promoters50/1595703
cttaattcaa

SEQ ID NO: 176442 - DNA, 10 bp, Unknown
  misc_feature (1)..( 10): Result.005 file - promoters50/1595703
ctttatttta

SEQ ID NO: 176443 - DNA, 11 bp, Unknown
  misc_feature (1)..( 11): Result.005 file - promoters50/1595707
aataccaatca

SEQ ID NO: 176444 - DNA, 11 bp, Unknown
  misc_feature (1)..( 11): Result.005 file - promoters50/1595707
aatacaaatct

SEQ ID NO: 176445 - DNA, 11 bp, Unknown
  misc_feature (1)..( 11): Result.005 file - promoters50/1595707
cagcccagtca

SEQ ID NO: 176446 - DNA, 11 bp, Unknown
  misc_feature (1)..( 11): Result.005 file - promoters50/1595707
aatacaaatct

SEQ ID NO: 176447 - DNA, 11 bp, Unknown
  misc_feature (1)..( 11): Result.005 file - promoters50/1595707
tttactaatag

SEQ ID NO: 176448 - DNA, 11 bp, Unknown
  misc_feature (1)..( 11): Result.005 file - promoters50/1595707
tttactaatag

SEQ ID NO: 176449 - DNA, 11 bp, Unknown
  misc_feature (1)..( 11): Result.005 file - promoters50/1595707
gttattaactt

SEQ ID NO: 176450 - DNA, 12 bp, Unknown
  misc_feature (1)..( 12): Result.005 file - promoters50/1595707
attttcatttga

SEQ ID NO: 176451 - DNA, 12 bp, Unknown
  misc_feature (1)..( 12): Result.005 file - promoters50/1595707
actttcttttta

SEQ ID NO: 176452 - DNA, 12 bp, Unknown
  misc_feature (1)..( 12): Result.005 file - promoters50/1595707
attttaattttg

SEQ ID NO: 176453 - DNA, 12 bp, Unknown
  misc_feature (1)..( 12): Result.005 file - promoters50/1595707
tgattctttgac

SEQ ID NO: 176454 - DNA, 12 bp, Unknown
  misc_feature (1)..( 12): Result.005 file - promoters50/1595707
ctattctaaccc

SEQ ID NO: 176455 - DNA, 12 bp, Unknown
  misc_feature (1)..( 12): Result.005 file - promoters50/1595707
tatataatttta

SEQ ID NO: 176456 - DNA, 11 bp, Unknown
  misc_feature (1)..( 11): Result.005 file - promoters50/1595741
aatttcaataa

SEQ ID NO: 176457 - DNA, 11 bp, Unknown
  misc_feature (1)..( 11): Result.005 file - promoters50/1595741
aatttcatttg

SEQ ID NO: 176458 - DNA, 11 bp, Unknown
  misc_feature (1)..( 11): Result.005 file - promoters50/1595741
ttttttaataa

SEQ ID NO: 176459 - DNA, 11 bp, Unknown
  misc_feature (1)..( 11): Result.005 file - promoters50/1595741
tgtctaaaaag

SEQ ID NO: 176460 - DNA, 11 bp, Unknown
  misc_feature (1)..( 11): Result.005 file - promoters50/1595741
tattttattgt

SEQ ID NO: 176461 - DNA, 11 bp, Unknown
  misc_feature (1)..( 11): Result.005 file - promoters50/1595741
gctttcgtttt

SEQ ID NO: 176462 - DNA, 11 bp, Unknown
  misc_feature (1)..( 11): Result.005 file - promoters50/1595741
gtatttttgat

SEQ ID NO: 176463 - DNA, 11 bp, Unknown
  misc_feature (1)..( 11): Result.005 file - promoters50/1595741
ctattttccta

SEQ ID NO: 176464 - DNA, 11 bp, Unknown
  misc_feature (1)..( 11): Result.005 file - promoters50/1595741
ctattttattg

SEQ ID NO: 176465 - DNA, 11 bp, Unknown
  misc_feature (1)..( 11): Result.005 file - promoters50/1595741
ctatttgtaat

SEQ ID NO: 176466 - DNA, 11 bp, Unknown
  misc_feature (1)..( 11): Result.005 file - promoters50/1595741
taatttcattt

SEQ ID NO: 176467 - DNA, 11 bp, Unknown
  misc_feature (1)..( 11): Result.005 file - promoters50/1595741
agctttcgttt

SEQ ID NO: 176468 - DNA, 7 bp, Unknown
  misc_feature (1)..( 7): Result.005 file - promoters50/1595752
ataattt

SEQ ID NO: 176469 - DNA, 7 bp, Unknown
  misc_feature (1)..( 7): Result.005 file - promoters50/1595752
atatttt

SEQ ID NO: 176470 - DNA, 7 bp, Unknown
  misc_feature (1)..( 7): Result.005 file - promoters50/1595752
atatttc

SEQ ID NO: 176471 - DNA, 8 bp, Unknown
  misc_feature (1)..( 8): Result.005 file - promoters50/1595752
aaatctat

SEQ ID NO: 176472 - DNA, 8 bp, Unknown
  misc_feature (1)..( 8): Result.005 file - promoters50/1595752
aaatctaa

SEQ ID NO: 176473 - DNA, 8 bp, Unknown
  misc_feature (1)..( 8): Result.005 file - promoters50/1595752
acatctaa

SEQ ID NO: 176474 - DNA, 9 bp, Unknown
  misc_feature (1)..( 9): Result.005 file - promoters50/1595752
acaaccata

SEQ ID NO: 176475 - DNA, 9 bp, Unknown
  misc_feature (1)..( 9): Result.005 file - promoters50/1595752
acaaccacc

SEQ ID NO: 176476 - DNA, 9 bp, Unknown
  misc_feature (1)..( 9): Result.005 file - promoters50/1595752
ataaccacc

SEQ ID NO: 176477 - DNA, 9 bp, Unknown
  misc_feature (1)..( 9): Result.005 file - promoters50/1595752
atataaata

SEQ ID NO: 176478 - DNA, 9 bp, Unknown
  misc_feature (1)..( 9): Result.005 file - promoters50/1595752
atatatata

SEQ ID NO: 176479 - DNA, 9 bp, Unknown
  misc_feature (1)..( 9): Result.005 file - promoters50/1595752
ctatatata

SEQ ID NO: 176480 - DNA, 9 bp, Unknown
  misc_feature (1)..( 9): Result.005 file - promoters50/1595752
gaatctctt

SEQ ID NO: 176481 - DNA, 9 bp, Unknown
  misc_feature (1)..( 9): Result.005 file - promoters50/1595752
aaatttctt

SEQ ID NO: 176482 - DNA, 10 bp, Unknown
  misc_feature (1)..( 10): Result.005 file - promoters50/1595752
taagtttgca

SEQ ID NO: 176483 - DNA, 8 bp, Unknown
  misc_feature (1)..( 8): Result.005 file - promoters50/1595772
ataatttc

SEQ ID NO: 176484 - DNA, 8 bp, Unknown
  misc_feature (1)..( 8): Result.005 file - promoters50/1595772
gaaatttc

SEQ ID NO: 176485 - DNA, 8 bp, Unknown
  misc_feature (1)..( 8): Result.005 file - promoters50/1595772
atagttta

SEQ ID NO: 176486 - DNA, 8 bp, Unknown
  misc_feature (1)..( 8): Result.005 file - promoters50/1595772
ctaatttt

SEQ ID NO: 176487 - DNA, 9 bp, Unknown
  misc_feature (1)..( 9): Result.005 file - promoters50/1595772
agaacttta

SEQ ID NO: 176488 - DNA, 9 bp, Unknown
  misc_feature (1)..( 9): Result.005 file - promoters50/1595772
tacaatttt

SEQ ID NO: 176489 - DNA, 11 bp, Unknown
  misc_feature (1)..( 11): Result.005 file - promoters50/1595772
cttataaatac

SEQ ID NO: 176490 - DNA, 11 bp, Unknown
  misc_feature (1)..( 11): Result.005 file - promoters50/1595772
aatataaataa

SEQ ID NO: 176491 - DNA, 11 bp, Unknown
  misc_feature (1)..( 11): Result.005 file - promoters50/1595772
tatataaacaa

SEQ ID NO: 176492 - DNA, 11 bp, Unknown
  misc_feature (1)..( 11): Result.005 file - promoters50/1595772
cttaaaaacca

SEQ ID NO: 176493 - DNA, 11 bp, Unknown
  misc_feature (1)..( 11): Result.005 file - promoters50/1595772
tatataagtgt

SEQ ID NO: 176494 - DNA, 11 bp, Unknown
  misc_feature (1)..( 11): Result.005 file - promoters50/1595772
tatacaaatcc

SEQ ID NO: 176495 - DNA, 11 bp, Unknown
  misc_feature (1)..( 11): Result.005 file - promoters50/1595772
tatttaagtaa

SEQ ID NO: 176496 - DNA, 15 bp, Unknown
  misc_feature (1)..( 15): Result.005 file - promoters50/1595772
tttaaataaaattaa

SEQ ID NO: 176497 - DNA, 15 bp, Unknown
  misc_feature (1)..( 15): Result.005 file - promoters50/1595772
aataattaaattaaa

SEQ ID NO: 176498 - DNA, 15 bp, Unknown
  misc_feature (1)..( 15): Result.005 file - promoters50/1595772
aaacaataaaattaa

SEQ ID NO: 176499 - DNA, 15 bp, Unknown
  misc_feature (1)..( 15): Result.005 file - promoters50/1595772
tttaattaaacatat

SEQ ID NO: 176500 - DNA, 15 bp, Unknown
  misc_feature (1)..( 15): Result.005 file - promoters50/1595772
ttttaatatgaagaa

SEQ ID NO: 176501 - DNA, 15 bp, Unknown
  misc_feature (1)..( 15): Result.005 file - promoters50/1595772
acattataaaataca

SEQ ID NO: 176502 - DNA, 11 bp, Unknown
  misc_feature (1)..( 11): Result.005 file - promoters50/1595772
atgcaaaatta

SEQ ID NO: 176503 - DNA, 11 bp, Unknown
  misc_feature (1)..( 11): Result.005 file - promoters50/1595772
ttttaaaatta

SEQ ID NO: 176504 - DNA, 11 bp, Unknown
  misc_feature (1)..( 11): Result.005 file - promoters50/1595772
caataaaaaaa

SEQ ID NO: 176505 - DNA, 11 bp, Unknown
  misc_feature (1)..( 11): Result.005 file - promoters50/1595772
aaataaatttt

SEQ ID NO: 176506 - DNA, 11 bp, Unknown
  misc_feature (1)..( 11): Result.005 file - promoters50/1595772
agttaaaaagt

SEQ ID NO: 176507 - DNA, 11 bp, Unknown
  misc_feature (1)..( 11): Result.005 file - promoters50/1595772
gtatatattaa

SEQ ID NO: 176508 - DNA, 11 bp, Unknown
  misc_feature (1)..( 11): Result.005 file - promoters50/1595772
taataagactt

SEQ ID NO: 176509 - DNA, 12 bp, Unknown
  misc_feature (1)..( 12): Result.005 file - promoters50/1595772
atctaataattt

SEQ ID NO: 176510 - DNA, 12 bp, Unknown
  misc_feature (1)..( 12): Result.005 file - promoters50/1595772
gtttaaaaatta

SEQ ID NO: 176511 - DNA, 12 bp, Unknown
  misc_feature (1)..( 12): Result.005 file - promoters50/1595772
gtctagtaacta

SEQ ID NO: 176512 - DNA, 12 bp, Unknown
  misc_feature (1)..( 12): Result.005 file - promoters50/1595772
gtgtaacaattc

SEQ ID NO: 176513 - DNA, 12 bp, Unknown
  misc_feature (1)..( 12): Result.005 file - promoters50/1595772
ttgtcacaagtt

SEQ ID NO: 176514 - DNA, 12 bp, Unknown
  misc_feature (1)..( 12): Result.005 file - promoters50/1595772
gttaaaaaattg

SEQ ID NO: 176515 - DNA, 12 bp, Unknown
  misc_feature (1)..( 12): Result.005 file - promoters50/1595772
atgcaaagatta

SEQ ID NO: 176516 - DNA, 12 bp, Unknown
  misc_feature (1)..( 12): Result.005 file - promoters50/1595772
atacaaagagta

SEQ ID NO: 176517 - DNA, 9 bp, Unknown
  misc_feature (1)..( 9): Result.005 file - promoters50/1595772
ataaaatta

SEQ ID NO: 176518 - DNA, 9 bp, Unknown
  misc_feature (1)..( 9): Result.005 file - promoters50/1595772
ttaatattt

SEQ ID NO: 176519 - DNA, 9 bp, Unknown
  misc_feature (1)..( 9): Result.005 file - promoters50/1595772
ataaaatac

SEQ ID NO: 176520 - DNA, 9 bp, Unknown
  misc_feature (1)..( 9): Result.005 file - promoters50/1595772
gtaatgttt

SEQ ID NO: 176521 - DNA, 9 bp, Unknown
  misc_feature (1)..( 9): Result.005 file - promoters50/1595772
caaatatta

SEQ ID NO: 176522 - DNA, 9 bp, Unknown
  misc_feature (1)..( 9): Result.005 file - promoters50/1595772
ttaatatga

SEQ ID NO: 176523 - DNA, 12 bp, Unknown
  misc_feature (1)..( 12): Result.005 file - promoters50/1595772
tagattattttt

SEQ ID NO: 176524 - DNA, 12 bp, Unknown
  misc_feature (1)..( 12): Result.005 file - promoters50/1595772
atgtttatttaa

SEQ ID NO: 176525 - DNA, 13 bp, Unknown
  misc_feature (1)..( 13): Result.005 file - promoters50/1595772
ttctttaattttc

SEQ ID NO: 176526 - DNA, 13 bp, Unknown
  misc_feature (1)..( 13): Result.005 file - promoters50/1595772
tactgtaatgttc

SEQ ID NO: 176527 - DNA, 13 bp, Unknown
  misc_feature (1)..( 13): Result.005 file - promoters50/1595772
ttcattaataaga

SEQ ID NO: 176528 - DNA, 13 bp, Unknown
  misc_feature (1)..( 13): Result.005 file - promoters50/1595772
aaatttaattaac

SEQ ID NO: 176529 - DNA, 10 bp, Unknown
  misc_feature (1)..( 10): Result.005 file - promoters50/1595772
taattttatt

SEQ ID NO: 176530 - DNA, 10 bp, Unknown
  misc_feature (1)..( 10): Result.005 file - promoters50/1595772
gaatttttat

SEQ ID NO: 176531 - DNA, 10 bp, Unknown
  misc_feature (1)..( 10): Result.005 file - promoters50/1595772
taatttgtat

SEQ ID NO: 176532 - DNA, 10 bp, Unknown
  misc_feature (1)..( 10): Result.005 file - promoters50/1595772
ctctttttat

SEQ ID NO: 176533 - DNA, 10 bp, Unknown
  misc_feature (1)..( 10): Result.005 file - promoters50/1595772
ttattttgca

SEQ ID NO: 176534 - DNA, 10 bp, Unknown
  misc_feature (1)..( 10): Result.005 file - promoters50/1595772
atcttcttag

SEQ ID NO: 176535 - DNA, 12 bp, Unknown
  misc_feature (1)..( 12): Result.005 file - promoters50/1595772
aattttattata

SEQ ID NO: 176536 - DNA, 12 bp, Unknown
  misc_feature (1)..( 12): Result.005 file - promoters50/1595772
atttttattgcc

SEQ ID NO: 176537 - DNA, 12 bp, Unknown
  misc_feature (1)..( 12): Result.005 file - promoters50/1595772
ctttttatttct

SEQ ID NO: 176538 - DNA, 12 bp, Unknown
  misc_feature (1)..( 12): Result.005 file - promoters50/1595772
ttatttatttac

SEQ ID NO: 176539 - DNA, 13 bp, Unknown
  misc_feature (1)..( 13): Result.005 file - promoters50/1595772
tctggttattaat

SEQ ID NO: 176540 - DNA, 13 bp, Unknown
  misc_feature (1)..( 13): Result.005 file - promoters50/1595772
aatttgtatctat

SEQ ID NO: 176541 - DNA, 13 bp, Unknown
  misc_feature (1)..( 13): Result.005 file - promoters50/1595772
tataattattttg

SEQ ID NO: 176542 - DNA, 12 bp, Unknown
  misc_feature (1)..( 12): Result.005 file - promoters50/1595794
cagctaaacttg

SEQ ID NO: 176543 - DNA, 12 bp, Unknown
  misc_feature (1)..( 12): Result.005 file - promoters50/1595794
taattaatcttt

SEQ ID NO: 176544 - DNA, 12 bp, Unknown
  misc_feature (1)..( 12): Result.005 file - promoters50/1595794
aatttattctga

SEQ ID NO: 176545 - DNA, 13 bp, Unknown
  misc_feature (1)..( 13): Result.005 file - promoters50/1595794
gaagatatcgttt

SEQ ID NO: 176546 - DNA, 13 bp, Unknown
  misc_feature (1)..( 13): Result.005 file - promoters50/1595794
aatttatttctgc

SEQ ID NO: 176547 - DNA, 13 bp, Unknown
  misc_feature (1)..( 13): Result.005 file - promoters50/1595794
cttttatttcctc

SEQ ID NO: 176548 - DNA, 13 bp, Unknown
  misc_feature (1)..( 13): Result.005 file - promoters50/1595794
catttatttgact

SEQ ID NO: 176549 - DNA, 10 bp, Unknown
  misc_feature (1)..( 10): Result.005 file - promoters50/1595794
acagtctttc

SEQ ID NO: 176550 - DNA, 10 bp, Unknown
  misc_feature (1)..( 10): Result.005 file - promoters50/1595794
tttgtctttt

SEQ ID NO: 176551 - DNA, 10 bp, Unknown
  misc_feature (1)..( 10): Result.005 file - promoters50/1595794
acattcttca

SEQ ID NO: 176552 - DNA, 10 bp, Unknown
  misc_feature (1)..( 10): Result.005 file - promoters50/1595794
ttagtctttg

SEQ ID NO: 176553 - DNA, 10 bp, Unknown
  misc_feature (1)..( 10): Result.005 file - promoters50/1595794
tgcttctttg

SEQ ID NO: 176554 - DNA, 11 bp, Unknown
  misc_feature (1)..( 11): Result.005 file - promoters50/1595794
tagttctcttg

SEQ ID NO: 176555 - DNA, 11 bp, Unknown
  misc_feature (1)..( 11): Result.005 file - promoters50/1595794
cataatgtctg

SEQ ID NO: 176556 - DNA, 11 bp, Unknown
  misc_feature (1)..( 11): Result.005 file - promoters50/1595794
taaaatgtctt

SEQ ID NO: 176557 - DNA, 11 bp, Unknown
  misc_feature (1)..( 11): Result.005 file - promoters50/1595794
gtaaatgtatc

SEQ ID NO: 176558 - DNA, 11 bp, Unknown
  misc_feature (1)..( 11): Result.005 file - promoters50/1595794
gtaaaagtact

SEQ ID NO: 176559 - DNA, 11 bp, Unknown
  misc_feature (1)..( 11): Result.005 file - promoters50/1595794
agaaaagtaat

SEQ ID NO: 176560 - DNA, 11 bp, Unknown
  misc_feature (1)..( 11): Result.005 file - promoters50/1595794
cgtcaagaaat

SEQ ID NO: 176561 - DNA, 15 bp, Unknown
  misc_feature (1)..( 15): Result.005 file - promoters50/1595794
ttaaaaaatcaaaat

SEQ ID NO: 176562 - DNA, 15 bp, Unknown
  misc_feature (1)..( 15): Result.005 file - promoters50/1595794
atttgaaatcaaata

SEQ ID NO: 176563 - DNA, 15 bp, Unknown
  misc_feature (1)..( 15): Result.005 file - promoters50/1595794
ttaacaaaacaattc

SEQ ID NO: 176564 - DNA, 15 bp, Unknown
  misc_feature (1)..( 15): Result.005 file - promoters50/1595794
aaagtaattcaaata

SEQ ID NO: 176565 - DNA, 15 bp, Unknown
  misc_feature (1)..( 15): Result.005 file - promoters50/1595794
tgtcattttccaatc

SEQ ID NO: 176566 - DNA, 15 bp, Unknown
  misc_feature (1)..( 15): Result.005 file - promoters50/1595794
gcatataaccaaagt

SEQ ID NO: 176567 - DNA, 13 bp, Unknown
  misc_feature (1)..( 13): Result.005 file - promoters50/1595794
tttcttaaaaaat

SEQ ID NO: 176568 - DNA, 13 bp, Unknown
  misc_feature (1)..( 13): Result.005 file - promoters50/1595794
gaaatcaaataat

SEQ ID NO: 176569 - DNA, 13 bp, Unknown
  misc_feature (1)..( 13): Result.005 file - promoters50/1595794
ttaacaaaacaat

SEQ ID NO: 176570 - DNA, 13 bp, Unknown
  misc_feature (1)..( 13): Result.005 file - promoters50/1595794
taattcaaatacg

SEQ ID NO: 176571 - DNA, 13 bp, Unknown
  misc_feature (1)..( 13): Result.005 file - promoters50/1595794
attttccaatcct

SEQ ID NO: 176572 - DNA, 13 bp, Unknown
  misc_feature (1)..( 13): Result.005 file - promoters50/1595794
ataaccaaagttg

SEQ ID NO: 176573 - DNA, 13 bp, Unknown
  misc_feature (1)..( 13): Result.005 file - promoters50/1595829
ctaattttaaaac

SEQ ID NO: 176574 - DNA, 13 bp, Unknown
  misc_feature (1)..( 13): Result.005 file - promoters50/1595829
tgtattttacagt

SEQ ID NO: 176575 - DNA, 13 bp, Unknown
  misc_feature (1)..( 13): Result.005 file - promoters50/1595829
acaatttgaaaac

SEQ ID NO: 176576 - DNA, 13 bp, Unknown
  misc_feature (1)..( 13): Result.005 file - promoters50/1595829
gaaatattactca

SEQ ID NO: 176577 - DNA, 13 bp, Unknown
  misc_feature (1)..( 13): Result.005 file - promoters50/1595829
taaattttaaatt

SEQ ID NO: 176578 - DNA, 13 bp, Unknown
  misc_feature (1)..( 13): Result.005 file - promoters50/1595829
aaaaaattcaagt

SEQ ID NO: 176579 - DNA, 10 bp, Unknown
  misc_feature (1)..( 10): Result.005 file - promoters50/1595829
acaatttata

SEQ ID NO: 176580 - DNA, 10 bp, Unknown
  misc_feature (1)..( 10): Result.005 file - promoters50/1595829
ataattaata

SEQ ID NO: 176581 - DNA, 10 bp, Unknown
  misc_feature (1)..( 10): Result.005 file - promoters50/1595829
aaaataaata

SEQ ID NO: 176582 - DNA, 10 bp, Unknown
  misc_feature (1)..( 10): Result.005 file - promoters50/1595829
tcaataaaac

SEQ ID NO: 176583 - DNA, 10 bp, Unknown
  misc_feature (1)..( 10): Result.005 file - promoters50/1595829
aaaataaaaa

SEQ ID NO: 176584 - DNA, 10 bp, Unknown
  misc_feature (1)..( 10): Result.005 file - promoters50/1595829
tcaatcaaat

SEQ ID NO: 176585 - DNA, 16 bp, Unknown
  misc_feature (1)..( 16): Result.005 file - promoters50/1595829
gatatcttagagtaat

SEQ ID NO: 176586 - DNA, 16 bp, Unknown
  misc_feature (1)..( 16): Result.005 file - promoters50/1595829
cgtatctaagacctaa

SEQ ID NO: 176587 - DNA, 16 bp, Unknown
  misc_feature (1)..( 16): Result.005 file - promoters50/1595829
gatttcttagaatata

SEQ ID NO: 176588 - DNA, 15 bp, Unknown
  misc_feature (1)..( 15): Result.005 file - promoters50/1595829
tttttttaaaatata

SEQ ID NO: 176589 - DNA, 16 bp, Unknown
  misc_feature (1)..( 16): Result.005 file - promoters50/1595829
attttcttcgttaagc

SEQ ID NO: 176590 - DNA, 16 bp, Unknown
  misc_feature (1)..( 16): Result.005 file - promoters50/1595829
ttttttttagatagat

SEQ ID NO: 176591 - DNA, 14 bp, Unknown
  misc_feature (1)..( 14): Result.005 file - promoters50/1595829
atataattttaatc

SEQ ID NO: 176592 - DNA, 14 bp, Unknown
  misc_feature (1)..( 14): Result.005 file - promoters50/1595829
catctattttatat

SEQ ID NO: 176593 - DNA, 14 bp, Unknown
  misc_feature (1)..( 14): Result.005 file - promoters50/1595829
ttctttttttaaca

SEQ ID NO: 176594 - DNA, 14 bp, Unknown
  misc_feature (1)..( 14): Result.005 file - promoters50/1595829
atataagtttaaat

SEQ ID NO: 176595 - DNA, 14 bp, Unknown
  misc_feature (1)..( 14): Result.005 file - promoters50/1595829
tgcaaatataatca

SEQ ID NO: 176596 - DNA, 15 bp, Unknown
  misc_feature (1)..( 15): Result.005 file - promoters50/1595829
ttgacattttcaaca

SEQ ID NO: 176597 - DNA, 18 bp, Unknown
  misc_feature (1)..( 18): Result.005 file - promoters50/1595829
cgactaattttaaaacac

SEQ ID NO: 176598 - DNA, 18 bp, Unknown
  misc_feature (1)..( 18): Result.005 file - promoters50/1595829
aaactaatatattttgga

SEQ ID NO: 176599 - DNA, 18 bp, Unknown
  misc_feature (1)..( 18): Result.005 file - promoters50/1595829
aaattaaaatattggtca

SEQ ID NO: 176600 - DNA, 18 bp, Unknown
  misc_feature (1)..( 18): Result.005 file - promoters50/1595829
aaaagaaaaaattcaagt

SEQ ID NO: 176601 - DNA, 18 bp, Unknown
  misc_feature (1)..( 18): Result.005 file - promoters50/1595829
aatctgaaatattactca

SEQ ID NO: 176602 - DNA, 18 bp, Unknown
  misc_feature (1)..( 18): Result.005 file - promoters50/1595829
ggaagtgaatgttgatca

SEQ ID NO: 176603 - DNA, 7 bp, Unknown
  misc_feature (1)..( 7): Result.005 file - promoters50/1662819
acttatc

SEQ ID NO: 176604 - DNA, 7 bp, Unknown
  misc_feature (1)..( 7): Result.005 file - promoters50/1662819
acttatt

SEQ ID NO: 176605 - DNA, 7 bp, Unknown
  misc_feature (1)..( 7): Result.005 file - promoters50/1662819
actgatt

SEQ ID NO: 176606 - DNA, 9 bp, Unknown
  misc_feature (1)..( 9): Result.005 file - promoters50/1662819
ttatctaaa

SEQ ID NO: 176607 - DNA, 9 bp, Unknown
  misc_feature (1)..( 9): Result.005 file - promoters50/1662819
ttatctaaa

SEQ ID NO: 176608 - DNA, 9 bp, Unknown
  misc_feature (1)..( 9): Result.005 file - promoters50/1662819
ttatataac

SEQ ID NO: 176609 - DNA, 12 bp, Unknown
  misc_feature (1)..( 12): Result.005 file - promoters50/1662827
aaactatttaaa

SEQ ID NO: 176610 - DNA, 12 bp, Unknown
  misc_feature (1)..( 12): Result.005 file - promoters50/1662827
cttctatataag

SEQ ID NO: 176611 - DNA, 12 bp, Unknown
  misc_feature (1)..( 12): Result.005 file - promoters50/1662827
tgactattatcc

SEQ ID NO: 176612 - DNA, 12 bp, Unknown
  misc_feature (1)..( 12): Result.005 file - promoters50/1662827
aattcatttaag

SEQ ID NO: 176613 - DNA, 12 bp, Unknown
  misc_feature (1)..( 12): Result.005 file - promoters50/1662827
tgattatccttg

SEQ ID NO: 176614 - DNA, 12 bp, Unknown
  misc_feature (1)..( 12): Result.005 file - promoters50/1662827
gaattatccaaa

SEQ ID NO: 176615 - DNA, 12 bp, Unknown
  misc_feature (1)..( 12): Result.005 file - promoters50/1662827
aaaatatgcaaa

SEQ ID NO: 176616 - DNA, 10 bp, Unknown
  misc_feature (1)..( 10): Result.005 file - promoters50/1662827
ttttattttt

SEQ ID NO: 176617 - DNA, 10 bp, Unknown
  misc_feature (1)..( 10): Result.005 file - promoters50/1662827
tttcattcaa

SEQ ID NO: 176618 - DNA, 10 bp, Unknown
  misc_feature (1)..( 10): Result.005 file - promoters50/1662827
cttaatttaa

SEQ ID NO: 176619 - DNA, 10 bp, Unknown
  misc_feature (1)..( 10): Result.005 file - promoters50/1662827
atttattatt

SEQ ID NO: 176620 - DNA, 10 bp, Unknown
  misc_feature (1)..( 10): Result.005 file - promoters50/1662827
tttgattttt

SEQ ID NO: 176621 - DNA, 10 bp, Unknown
  misc_feature (1)..( 10): Result.005 file - promoters50/1662827
aataatgtaa

SEQ ID NO: 176622 - DNA, 11 bp, Unknown
  misc_feature (1)..( 11): Result.005 file - promoters50/1662827
attttacatta

SEQ ID NO: 176623 - DNA, 11 bp, Unknown
  misc_feature (1)..( 11): Result.005 file - promoters50/1662827
tttttaccatc

SEQ ID NO: 176624 - DNA, 11 bp, Unknown
  misc_feature (1)..( 11): Result.005 file - promoters50/1662827
cttttcattaa

SEQ ID NO: 176625 - DNA, 11 bp, Unknown
  misc_feature (1)..( 11): Result.005 file - promoters50/1662827
tttttaaaaaa

SEQ ID NO: 176626 - DNA, 11 bp, Unknown
  misc_feature (1)..( 11): Result.005 file - promoters50/1662827
catttataaag

SEQ ID NO: 176627 - DNA, 11 bp, Unknown
  misc_feature (1)..( 11): Result.005 file - promoters50/1662827
attctcttctt

SEQ ID NO: 176628 - DNA, 9 bp, Unknown
  misc_feature (1)..( 9): Result.005 file - promoters50/1662827
tttttttgg

SEQ ID NO: 176629 - DNA, 9 bp, Unknown
  misc_feature (1)..( 9): Result.005 file - promoters50/1662827
tttttttaa

SEQ ID NO: 176630 - DNA, 9 bp, Unknown
  misc_feature (1)..( 9): Result.005 file - promoters50/1662827
tttatttgt

SEQ ID NO: 176631 - DNA, 9 bp, Unknown
  misc_feature (1)..( 9): Result.005 file - promoters50/1662827
cttatttca

SEQ ID NO: 176632 - DNA, 10 bp, Unknown
  misc_feature (1)..( 10): Result.005 file - promoters50/1662827
ttctgtttga

SEQ ID NO: 176633 - DNA, 10 bp, Unknown
  misc_feature (1)..( 10): Result.005 file - promoters50/1662827
ttatatctgt

SEQ ID NO: 176634 - DNA, 17 bp, Unknown
  misc_feature (1)..( 17): Result.005 file - promoters50/1662827
gtataccaaatttaatg

SEQ ID NO: 176635 - DNA, 17 bp, Unknown
  misc_feature (1)..( 17): Result.005 file - promoters50/1662827
ggctaccaaacttatct

SEQ ID NO: 176636 - DNA, 17 bp, Unknown
  misc_feature (1)..( 17): Result.005 file - promoters50/1662827
gtatcccaaaaattatt

SEQ ID NO: 176637 - DNA, 17 bp, Unknown
  misc_feature (1)..( 17): Result.005 file - promoters50/1662827
ttaaaacaaactcttat

SEQ ID NO: 176638 - DNA, 17 bp, Unknown
  misc_feature (1)..( 17): Result.005 file - promoters50/1662827
ggcttttctacttctct

SEQ ID NO: 176639 - DNA, 17 bp, Unknown
  misc_feature (1)..( 17): Result.005 file - promoters50/1662827
taaataataacctatct

SEQ ID NO: 176640 - DNA, 10 bp, Unknown
  misc_feature (1)..( 10): Result.005 file - promoters50/1662843
ttcacattat

SEQ ID NO: 176641 - DNA, 10 bp, Unknown
  misc_feature (1)..( 10): Result.005 file - promoters50/1662843
ttcacatggg

SEQ ID NO: 176642 - DNA, 10 bp, Unknown
  misc_feature (1)..( 10): Result.005 file - promoters50/1662843
atcacactat

SEQ ID NO: 176643 - DNA, 9 bp, Unknown
  misc_feature (1)..( 9): Result.005 file - promoters50/1662843
taaatagta

SEQ ID NO: 176644 - DNA, 9 bp, Unknown
  misc_feature (1)..( 9): Result.005 file - promoters50/1662843
taaatacgg

SEQ ID NO: 176645 - DNA, 9 bp, Unknown
  misc_feature (1)..( 9): Result.005 file - promoters50/1662843
caaagagta

SEQ ID NO: 176646 - DNA, 10 bp, Unknown
  misc_feature (1)..( 10): Result.005 file - promoters50/1662843
aattcaactc

SEQ ID NO: 176647 - DNA, 10 bp, Unknown
  misc_feature (1)..( 10): Result.005 file - promoters50/1662843
aatacaatta

SEQ ID NO: 176648 - DNA, 10 bp, Unknown
  misc_feature (1)..( 10): Result.005 file - promoters50/1662843
aattccactc

SEQ ID NO: 176649 - DNA, 7 bp, Unknown
  misc_feature (1)..( 7): Result.005 file - promoters50/1662872
ttttctt

SEQ ID NO: 176650 - DNA, 7 bp, Unknown
  misc_feature (1)..( 7): Result.005 file - promoters50/1662872
tttcctt

SEQ ID NO: 176651 - DNA, 7 bp, Unknown
  misc_feature (1)..( 7): Result.005 file - promoters50/1662872
cttcctt

SEQ ID NO: 176652 - DNA, 9 bp, Unknown
  misc_feature (1)..( 9): Result.005 file - promoters50/1662872
taagatctt

SEQ ID NO: 176653 - DNA, 9 bp, Unknown
  misc_feature (1)..( 9): Result.005 file - promoters50/1662872
ctagatctt

SEQ ID NO: 176654 - DNA, 9 bp, Unknown
  misc_feature (1)..( 9): Result.005 file - promoters50/1662872
ctagatcat

SEQ ID NO: 176655 - DNA, 9 bp, Unknown
  misc_feature (1)..( 9): Result.005 file - promoters50/1662895
attcgtaag

SEQ ID NO: 176656 - DNA, 9 bp, Unknown
  misc_feature (1)..( 9): Result.005 file - promoters50/1662895
tttcctaag

SEQ ID NO: 176657 - DNA, 9 bp, Unknown
  misc_feature (1)..( 9): Result.005 file - promoters50/1662895
tttcataat

SEQ ID NO: 176658 - DNA, 9 bp, Unknown
  misc_feature (1)..( 9): Result.005 file - promoters50/1662895
attgagaaa

SEQ ID NO: 176659 - DNA, 9 bp, Unknown
  misc_feature (1)..( 9): Result.005 file - promoters50/1662895
taagagaaa

SEQ ID NO: 176660 - DNA, 9 bp, Unknown
  misc_feature (1)..( 9): Result.005 file - promoters50/1662895
attgagaaa

SEQ ID NO: 176661 - DNA, 11 bp, Unknown
  misc_feature (1)..( 11): Result.005 file - promoters50/1662899
aacatttttca

SEQ ID NO: 176662 - DNA, 11 bp, Unknown
  misc_feature (1)..( 11): Result.005 file - promoters50/1662899
tgaattgttca

SEQ ID NO: 176663 - DNA, 11 bp, Unknown
  misc_feature (1)..( 11): Result.005 file - promoters50/1662899
acaatttaaaa

SEQ ID NO: 176664 - DNA, 11 bp, Unknown
  misc_feature (1)..( 11): Result.005 file - promoters50/1662899
ccaatttttgg

SEQ ID NO: 176665 - DNA, 11 bp, Unknown
  misc_feature (1)..( 11): Result.005 file - promoters50/1662899
gtaatagttat

SEQ ID NO: 176666 - DNA, 11 bp, Unknown
  misc_feature (1)..( 11): Result.005 file - promoters50/1662899
ttaattttgta

SEQ ID NO: 176667 - DNA, 9 bp, Unknown
  misc_feature (1)..( 9): Result.005 file - promoters50/1662899
tatatgttt

SEQ ID NO: 176668 - DNA, 9 bp, Unknown
  misc_feature (1)..( 9): Result.005 file - promoters50/1662899
catatgtgc

SEQ ID NO: 176669 - DNA, 9 bp, Unknown
  misc_feature (1)..( 9): Result.005 file - promoters50/1662899
tatatgcag

SEQ ID NO: 176670 - DNA, 9 bp, Unknown
  misc_feature (1)..( 9): Result.005 file - promoters50/1662899
tatatttta

SEQ ID NO: 176671 - DNA, 9 bp, Unknown
  misc_feature (1)..( 9): Result.005 file - promoters50/1662899
tttatgtgt

SEQ ID NO: 176672 - DNA, 9 bp, Unknown
  misc_feature (1)..( 9): Result.005 file - promoters50/1662899
tttttgtag

SEQ ID NO: 176673 - DNA, 10 bp, Unknown
  misc_feature (1)..( 10): Result.005 file - promoters50/1662917
aaattctctt

SEQ ID NO: 176674 - DNA, 10 bp, Unknown
  misc_feature (1)..( 10): Result.005 file - promoters50/1662917
aaatcctcca

SEQ ID NO: 176675 - DNA, 10 bp, Unknown
  misc_feature (1)..( 10): Result.005 file - promoters50/1662917
aaattcaaaa

SEQ ID NO: 176676 - DNA, 10 bp, Unknown
  misc_feature (1)..( 10): Result.005 file - promoters50/1662917
aaacccttat

SEQ ID NO: 176677 - DNA, 10 bp, Unknown
  misc_feature (1)..( 10): Result.005 file - promoters50/1662917
ggacccgtat

SEQ ID NO: 176678 - DNA, 11 bp, Unknown
  misc_feature (1)..( 11): Result.005 file - promoters50/1662917
tttataagtat

SEQ ID NO: 176679 - DNA, 11 bp, Unknown
  misc_feature (1)..( 11): Result.005 file - promoters50/1662917
tttgtaacttc

SEQ ID NO: 176680 - DNA, 11 bp, Unknown
  misc_feature (1)..( 11): Result.005 file - promoters50/1662917
cttataattat

SEQ ID NO: 176681 - DNA, 11 bp, Unknown
  misc_feature (1)..( 11): Result.005 file - promoters50/1662917
tttaaaagtaa

SEQ ID NO: 176682 - DNA, 11 bp, Unknown
  misc_feature (1)..( 11): Result.005 file - promoters50/1662917
tttttaaattt

SEQ ID NO: 176683 - DNA, 17 bp, Unknown
  misc_feature (1)..( 17): Result.005 file - promoters50/1662917
aatcttttgattctaaa

SEQ ID NO: 176684 - DNA, 17 bp, Unknown
  misc_feature (1)..( 17): Result.005 file - promoters50/1662917
taaattttgaaataatt

SEQ ID NO: 176685 - DNA, 17 bp, Unknown
  misc_feature (1)..( 17): Result.005 file - promoters50/1662917
ttgatttagataccgga

SEQ ID NO: 176686 - DNA, 17 bp, Unknown
  misc_feature (1)..( 17): Result.005 file - promoters50/1662917
taaattttaaaattatt

SEQ ID NO: 176687 - DNA, 17 bp, Unknown
  misc_feature (1)..( 17): Result.005 file - promoters50/1662917
aattttttaaaatatat

SEQ ID NO: 176688 - DNA, 17 bp, Unknown
  misc_feature (1)..( 17): Result.005 file - promoters50/1662917
aaaatgttagataggaa

SEQ ID NO: 176689 - DNA, 14 bp, Unknown
  misc_feature (1)..( 14): Result.005 file - promoters50/1662917
cccttgtgaatgtc

SEQ ID NO: 176690 - DNA, 14 bp, Unknown
  misc_feature (1)..( 14): Result.005 file - promoters50/1662917
ttttgatgaatgta

SEQ ID NO: 176691 - DNA, 14 bp, Unknown
  misc_feature (1)..( 14): Result.005 file - promoters50/1662917
atttgctgaataag

SEQ ID NO: 176692 - DNA, 14 bp, Unknown
  misc_feature (1)..( 14): Result.005 file - promoters50/1662917
ttttgaagaatttt

SEQ ID NO: 176693 - DNA, 14 bp, Unknown
  misc_feature (1)..( 14): Result.005 file - promoters50/1662917
ataataataatgta

SEQ ID NO: 176694 - DNA, 17 bp, Unknown
  misc_feature (1)..( 17): Result.005 file - promoters50/1662917
ttgattctaaaatattg

SEQ ID NO: 176695 - DNA, 17 bp, Unknown
  misc_feature (1)..( 17): Result.005 file - promoters50/1662917
taaattttaaaattatt

SEQ ID NO: 176696 - DNA, 17 bp, Unknown
  misc_feature (1)..( 17): Result.005 file - promoters50/1662917
aattttttaaaatatat

SEQ ID NO: 176697 - DNA, 17 bp, Unknown
  misc_feature (1)..( 17): Result.005 file - promoters50/1662917
ccgggtctaaaactccg

SEQ ID NO: 176698 - DNA, 17 bp, Unknown
  misc_feature (1)..( 17): Result.005 file - promoters50/1662917
taaattttgaaataatt

SEQ ID NO: 176699 - DNA, 17 bp, Unknown
  misc_feature (1)..( 17): Result.005 file - promoters50/1662917
tttccataaaaatgtta

SEQ ID NO: 176700 - DNA, 20 bp, Unknown
  misc_feature (1)..( 20): Result.005 file - promoters50/1662917
gattctaaaatattgttcat

SEQ ID NO: 176701 - DNA, 20 bp, Unknown
  misc_feature (1)..( 20): Result.005 file - promoters50/1662917
taaattttaaaattattcat

SEQ ID NO: 176702 - DNA, 20 bp, Unknown
  misc_feature (1)..( 20): Result.005 file - promoters50/1662917
taaattttgaaataatttca

SEQ ID NO: 176703 - DNA, 20 bp, Unknown
  misc_feature (1)..( 20): Result.005 file - promoters50/1662917
acaatttttaaattttttaa

SEQ ID NO: 176704 - DNA, 20 bp, Unknown
  misc_feature (1)..( 20): Result.005 file - promoters50/1662917
cggatcgggtcataattccg

SEQ ID NO: 176705 - DNA, 8 bp, Unknown
  misc_feature (1)..( 8): Result.005 file - promoters50/1662981
aatcttag

SEQ ID NO: 176706 - DNA, 8 bp, Unknown
  misc_feature (1)..( 8): Result.005 file - promoters50/1662981
gatcttaa

SEQ ID NO: 176707 - DNA, 8 bp, Unknown
  misc_feature (1)..( 8): Result.005 file - promoters50/1662981
aatcttag

SEQ ID NO: 176708 - DNA, 10 bp, Unknown
  misc_feature (1)..( 10): Result.005 file - promoters50/1662981
aaagacagcg

SEQ ID NO: 176709 - DNA, 10 bp, Unknown
  misc_feature (1)..( 10): Result.005 file - promoters50/1662981
aaaaacagta

SEQ ID NO: 176710 - DNA, 10 bp, Unknown
  misc_feature (1)..( 10): Result.005 file - promoters50/1662981
aaaaataaaa

SEQ ID NO: 176711 - DNA, 11 bp, Unknown
  misc_feature (1)..( 11): Result.005 file - promoters50/1663082
aaatatataca

SEQ ID NO: 176712 - DNA, 11 bp, Unknown
  misc_feature (1)..( 11): Result.005 file - promoters50/1663082
aaatatttgtc

SEQ ID NO: 176713 - DNA, 11 bp, Unknown
  misc_feature (1)..( 11): Result.005 file - promoters50/1663082
aaatctttatt

SEQ ID NO: 176714 - DNA, 11 bp, Unknown
  misc_feature (1)..( 11): Result.005 file - promoters50/1663082
aaatttttaaa

SEQ ID NO: 176715 - DNA, 11 bp, Unknown
  misc_feature (1)..( 11): Result.005 file - promoters50/1663082
cattcttgatt

SEQ ID NO: 176716 - DNA, 11 bp, Unknown
  misc_feature (1)..( 11): Result.005 file - promoters50/1663127
ccaaaaatggg

SEQ ID NO: 176717 - DNA, 11 bp, Unknown
  misc_feature (1)..( 11): Result.005 file - promoters50/1663127
tcaagaatctc

SEQ ID NO: 176718 - DNA, 11 bp, Unknown
  misc_feature (1)..( 11): Result.005 file - promoters50/1663127
ccaagaataat

SEQ ID NO: 176719 - DNA, 11 bp, Unknown
  misc_feature (1)..( 11): Result.005 file - promoters50/1663127
tgaagattaat

SEQ ID NO: 176720 - DNA, 7 bp, Unknown
  misc_feature (1)..( 7): Result.005 file - promoters50/1663135
tacatag

SEQ ID NO: 176721 - DNA, 7 bp, Unknown
  misc_feature (1)..( 7): Result.005 file - promoters50/1663135
aacatag

SEQ ID NO: 176722 - DNA, 7 bp, Unknown
  misc_feature (1)..( 7): Result.005 file - promoters50/1663135
aacataa

SEQ ID NO: 176723 - DNA, 8 bp, Unknown
  misc_feature (1)..( 8): Result.005 file - promoters50/1663135
acactttc

SEQ ID NO: 176724 - DNA, 8 bp, Unknown
  misc_feature (1)..( 8): Result.005 file - promoters50/1663135
acattttc

SEQ ID NO: 176725 - DNA, 8 bp, Unknown
  misc_feature (1)..( 8): Result.005 file - promoters50/1663135
atactttc

SEQ ID NO: 176726 - DNA, 7 bp, Unknown
  misc_feature (1)..( 7): Result.005 file - promoters50/1663135
tttttaa

SEQ ID NO: 176727 - DNA, 7 bp, Unknown
  misc_feature (1)..( 7): Result.005 file - promoters50/1663135
tttgtaa

SEQ ID NO: 176728 - DNA, 7 bp, Unknown
  misc_feature (1)..( 7): Result.005 file - promoters50/1663135
tttttaa

SEQ ID NO: 176729 - DNA, 9 bp, Unknown
  misc_feature (1)..( 9): Result.005 file - promoters50/1663135
aataaaatt

SEQ ID NO: 176730 - DNA, 9 bp, Unknown
  misc_feature (1)..( 9): Result.005 file - promoters50/1663135
aataaatga

SEQ ID NO: 176731 - DNA, 9 bp, Unknown
  misc_feature (1)..( 9): Result.005 file - promoters50/1663135
tataaaatt

SEQ ID NO: 176732 - DNA, 10 bp, Unknown
  misc_feature (1)..( 10): Result.005 file - promoters50/1663135
caaaactagt

SEQ ID NO: 176733 - DNA, 10 bp, Unknown
  misc_feature (1)..( 10): Result.005 file - promoters50/1663135
caaaacaaaa

SEQ ID NO: 176734 - DNA, 10 bp, Unknown
  misc_feature (1)..( 10): Result.005 file - promoters50/1663135
aaaaagaaaa

SEQ ID NO: 176735 - DNA, 9 bp, Unknown
  misc_feature (1)..( 9): Result.005 file - promoters50/1663147
ccatccact

SEQ ID NO: 176736 - DNA, 9 bp, Unknown
  misc_feature (1)..( 9): Result.005 file - promoters50/1663147
acatacact

SEQ ID NO: 176737 - DNA, 9 bp, Unknown
  misc_feature (1)..( 9): Result.005 file - promoters50/1663147
ccatttata

SEQ ID NO: 176738 - DNA, 12 bp, Unknown
  misc_feature (1)..( 12): Result.005 file - promoters50/1663147
taactccataca

SEQ ID NO: 176739 - DNA, 12 bp, Unknown
  misc_feature (1)..( 12): Result.005 file - promoters50/1663147
taaatccattta

SEQ ID NO: 176740 - DNA, 12 bp, Unknown
  misc_feature (1)..( 12): Result.005 file - promoters50/1663147
tctttccacaca

SEQ ID NO: 176741 - DNA, 10 bp, Unknown
  misc_feature (1)..( 10): Result.005 file - promoters50/1663217
acatgatata

SEQ ID NO: 176742 - DNA, 10 bp, Unknown
  misc_feature (1)..( 10): Result.005 file - promoters50/1663217
tgatgatata

SEQ ID NO: 176743 - DNA, 10 bp, Unknown
  misc_feature (1)..( 10): Result.005 file - promoters50/1663217
acacgatctc

SEQ ID NO: 176744 - DNA, 9 bp, Unknown
  misc_feature (1)..( 9): Result.005 file - promoters50/1663217
accaaataa

SEQ ID NO: 176745 - DNA, 9 bp, Unknown
  misc_feature (1)..( 9): Result.005 file - promoters50/1663217
tccaaatcg

SEQ ID NO: 176746 - DNA, 9 bp, Unknown
  misc_feature (1)..( 9): Result.005 file - promoters50/1663217
accaaacca

SEQ ID NO: 176747 - DNA, 9 bp, Unknown
  misc_feature (1)..( 9): Result.005 file - promoters50/1663217
accaatcca

SEQ ID NO: 176748 - DNA, 7 bp, Unknown
  misc_feature (1)..( 7): Result.005 file - promoters50/1663217
tcataaa

SEQ ID NO: 176749 - DNA, 7 bp, Unknown
  misc_feature (1)..( 7): Result.005 file - promoters50/1663217
tcacaaa

SEQ ID NO: 176750 - DNA, 7 bp, Unknown
  misc_feature (1)..( 7): Result.005 file - promoters50/1663217
tcataat

SEQ ID NO: 176751 - DNA, 9 bp, Unknown
  misc_feature (1)..( 9): Result.005 file - promoters50/1663217
tttaaataa

SEQ ID NO: 176752 - DNA, 9 bp, Unknown
  misc_feature (1)..( 9): Result.005 file - promoters50/1663217
attaagtaa

SEQ ID NO: 176753 - DNA, 9 bp, Unknown
  misc_feature (1)..( 9): Result.005 file - promoters50/1663217
attatgtag

SEQ ID NO: 176754 - DNA, 12 bp, Unknown
  misc_feature (1)..( 12): Result.005 file - promoters50/1663221
gtttttaatctg

SEQ ID NO: 176755 - DNA, 12 bp, Unknown
  misc_feature (1)..( 12): Result.005 file - promoters50/1663221
gtttttattgct

SEQ ID NO: 176756 - DNA, 12 bp, Unknown
  misc_feature (1)..( 12): Result.005 file - promoters50/1663221
tattttattttt

SEQ ID NO: 176757 - DNA, 12 bp, Unknown
  misc_feature (1)..( 12): Result.005 file - promoters50/1663221
acttttatgggc

SEQ ID NO: 176758 - DNA, 12 bp, Unknown
  misc_feature (1)..( 12): Result.005 file - promoters50/1663221
ccttgtatttac

SEQ ID NO: 176759 - DNA, 12 bp, Unknown
  misc_feature (1)..( 12): Result.005 file - promoters50/1663221
atttgtaattac

SEQ ID NO: 176760 - DNA, 12 bp, Unknown
  misc_feature (1)..( 12): Result.005 file - promoters50/1663261
attcttttttac

SEQ ID NO: 176761 - DNA, 12 bp, Unknown
  misc_feature (1)..( 12): Result.005 file - promoters50/1663261
attctttaaatt

SEQ ID NO: 176762 - DNA, 12 bp, Unknown
  misc_feature (1)..( 12): Result.005 file - promoters50/1663261
catctataaatt

SEQ ID NO: 176763 - DNA, 12 bp, Unknown
  misc_feature (1)..( 12): Result.005 file - promoters50/1663261
cacatatatctc

SEQ ID NO: 176764 - DNA, 8 bp, Unknown
  misc_feature (1)..( 8): Result.005 file - promoters50/1663261
aatgtaat

SEQ ID NO: 176765 - DNA, 8 bp, Unknown
  misc_feature (1)..( 8): Result.005 file - promoters50/1663261
aatataaa

SEQ ID NO: 176766 - DNA, 8 bp, Unknown
  misc_feature (1)..( 8): Result.005 file - promoters50/1663261
tatataaa

SEQ ID NO: 176767 - DNA, 8 bp, Unknown
  misc_feature (1)..( 8): Result.005 file - promoters50/1663261
tatataag

SEQ ID NO: 176768 - DNA, 8 bp, Unknown
  misc_feature (1)..( 8): Result.005 file - promoters50/1663261
agaaaatt

SEQ ID NO: 176769 - DNA, 8 bp, Unknown
  misc_feature (1)..( 8): Result.005 file - promoters50/1663261
ataaaatt

SEQ ID NO: 176770 - DNA, 8 bp, Unknown
  misc_feature (1)..( 8): Result.005 file - promoters50/1663261
agaaaata

SEQ ID NO: 176771 - DNA, 11 bp, Unknown
  misc_feature (1)..( 11): Result.005 file - promoters50/1663261
taaaaaaaaaa

SEQ ID NO: 176772 - DNA, 11 bp, Unknown
  misc_feature (1)..( 11): Result.005 file - promoters50/1663261
taacaaacaaa

SEQ ID NO: 176773 - DNA, 11 bp, Unknown
  misc_feature (1)..( 11): Result.005 file - promoters50/1663261
agacatacaat

SEQ ID NO: 176774 - DNA, 8 bp, Unknown
  misc_feature (1)..( 8): Result.005 file - promoters50/1663261
aattaatc

SEQ ID NO: 176775 - DNA, 8 bp, Unknown
  misc_feature (1)..( 8): Result.005 file - promoters50/1663261
aataaatt

SEQ ID NO: 176776 - DNA, 8 bp, Unknown
  misc_feature (1)..( 8): Result.005 file - promoters50/1663261
actaaatt

SEQ ID NO: 176777 - DNA, 9 bp, Unknown
  misc_feature (1)..( 9): Result.005 file - promoters50/1663261
ttaatcttc

SEQ ID NO: 176778 - DNA, 9 bp, Unknown
  misc_feature (1)..( 9): Result.005 file - promoters50/1663261
taaattttc

SEQ ID NO: 176779 - DNA, 9 bp, Unknown
  misc_feature (1)..( 9): Result.005 file - promoters50/1663261
taaatttga

SEQ ID NO: 176780 - DNA, 8 bp, Unknown
  misc_feature (1)..( 8): Result.005 file - promoters50/1663261
aaatatgc

SEQ ID NO: 176781 - DNA, 8 bp, Unknown
  misc_feature (1)..( 8): Result.005 file - promoters50/1663261
aaatatat

SEQ ID NO: 176782 - DNA, 8 bp, Unknown
  misc_feature (1)..( 8): Result.005 file - promoters50/1663261
caatatat

SEQ ID NO: 176783 - DNA, 12 bp, Unknown
  misc_feature (1)..( 12): Result.005 file - promoters50/1663278
tatttaaaacgt

SEQ ID NO: 176784 - DNA, 12 bp, Unknown
  misc_feature (1)..( 12): Result.005 file - promoters50/1663278
aattgaaacttt

SEQ ID NO: 176785 - DNA, 12 bp, Unknown
  misc_feature (1)..( 12): Result.005 file - promoters50/1663278
tattgaaaaaga

SEQ ID NO: 176786 - DNA, 12 bp, Unknown
  misc_feature (1)..( 12): Result.005 file - promoters50/1663278
gagggaaagaga

SEQ ID NO: 176787 - DNA, 12 bp, Unknown
  misc_feature (1)..( 12): Result.005 file - promoters50/1663278
acaagaaaaaca

SEQ ID NO: 176788 - DNA, 12 bp, Unknown
  misc_feature (1)..( 12): Result.005 file - promoters50/1663278
tttcgaagaagt

SEQ ID NO: 176789 - DNA, 14 bp, Unknown
  misc_feature (1)..( 14): Result.005 file - promoters50/1663278
cgtcgagatcagtc

SEQ ID NO: 176790 - DNA, 14 bp, Unknown
  misc_feature (1)..( 14): Result.005 file - promoters50/1663278
cgttgagttcaata

SEQ ID NO: 176791 - DNA, 14 bp, Unknown
  misc_feature (1)..( 14): Result.005 file - promoters50/1663278
tgataagtagtaac

SEQ ID NO: 176792 - DNA, 14 bp, Unknown
  misc_feature (1)..( 14): Result.005 file - promoters50/1663278
acatgggttcaaat

SEQ ID NO: 176793 - DNA, 14 bp, Unknown
  misc_feature (1)..( 14): Result.005 file - promoters50/1663278
tcgtcaattcaaat

SEQ ID NO: 176794 - DNA, 14 bp, Unknown
  misc_feature (1)..( 14): Result.005 file - promoters50/1663278
acttagattcaatt

SEQ ID NO: 176795 - DNA, 7 bp, Unknown
  misc_feature (1)..( 7): Result.005 file - promoters50/1663332
acttttt

SEQ ID NO: 176796 - DNA, 7 bp, Unknown
  misc_feature (1)..( 7): Result.005 file - promoters50/1663332
actttta

SEQ ID NO: 176797 - DNA, 7 bp, Unknown
  misc_feature (1)..( 7): Result.005 file - promoters50/1663332
actctta

SEQ ID NO: 176798 - DNA, 10 bp, Unknown
  misc_feature (1)..( 10): Result.005 file - promoters50/1663332
ttttgtcaaa

SEQ ID NO: 176799 - DNA, 10 bp, Unknown
  misc_feature (1)..( 10): Result.005 file - promoters50/1663332
ttttgacaaa

SEQ ID NO: 176800 - DNA, 10 bp, Unknown
  misc_feature (1)..( 10): Result.005 file - promoters50/1663332
aaatgacaat

SEQ ID NO: 176801 - DNA, 13 bp, Unknown
  misc_feature (1)..( 13): Result.005 file - promoters50/1663353
ctccatttaattt

SEQ ID NO: 176802 - DNA, 13 bp, Unknown
  misc_feature (1)..( 13): Result.005 file - promoters50/1663353
gtggagttacttt

SEQ ID NO: 176803 - DNA, 13 bp, Unknown
  misc_feature (1)..( 13): Result.005 file - promoters50/1663353
tctagactaattt

SEQ ID NO: 176804 - DNA, 13 bp, Unknown
  misc_feature (1)..( 13): Result.005 file - promoters50/1663353
gaaactttaatga

SEQ ID NO: 176805 - DNA, 13 bp, Unknown
  misc_feature (1)..( 13): Result.005 file - promoters50/1663353
taaacgttactgt

SEQ ID NO: 176806 - DNA, 13 bp, Unknown
  misc_feature (1)..( 13): Result.005 file - promoters50/1663353
gaaagtttaaaaa

SEQ ID NO: 176807 - DNA, 8 bp, Unknown
  misc_feature (1)..( 8): Result.005 file - promoters50/1664727
caagtaaa

SEQ ID NO: 176808 - DNA, 8 bp, Unknown
  misc_feature (1)..( 8): Result.005 file - promoters50/1664727
aaagaaaa

SEQ ID NO: 176809 - DNA, 8 bp, Unknown
  misc_feature (1)..( 8): Result.005 file - promoters50/1664727
aaagaata

SEQ ID NO: 176810 - DNA, 10 bp, Unknown
  misc_feature (1)..( 10): Result.005 file - promoters50/1664731
tttttagatt

SEQ ID NO: 176811 - DNA, 10 bp, Unknown
  misc_feature (1)..( 10): Result.005 file - promoters50/1664731
ggcttagatt

SEQ ID NO: 176812 - DNA, 10 bp, Unknown
  misc_feature (1)..( 10): Result.005 file - promoters50/1664731
ggctttgatg

SEQ ID NO: 176813 - DNA, 7 bp, Unknown
  misc_feature (1)..( 7): Result.005 file - promoters50/1664755
attattt

SEQ ID NO: 176814 - DNA, 7 bp, Unknown
  misc_feature (1)..( 7): Result.005 file - promoters50/1664755
tttattt

SEQ ID NO: 176815 - DNA, 8 bp, Unknown
  misc_feature (1)..( 8): Result.005 file - promoters50/1664755
tttaattt

SEQ ID NO: 176816 - DNA, 8 bp, Unknown
  misc_feature (1)..( 8): Result.005 file - promoters50/1664755
taaaattt

SEQ ID NO: 176817 - DNA, 8 bp, Unknown
  misc_feature (1)..( 8): Result.005 file - promoters50/1664755
caaaattc

SEQ ID NO: 176818 - DNA, 8 bp, Unknown
  misc_feature (1)..( 8): Result.005 file - promoters50/1664755
caaagttc

SEQ ID NO: 176819 - DNA, 11 bp, Unknown
  misc_feature (1)..( 11): Result.005 file - promoters50/1664797
aatccaatata

SEQ ID NO: 176820 - DNA, 11 bp, Unknown
  misc_feature (1)..( 11): Result.005 file - promoters50/1664797
aatcaaataga

SEQ ID NO: 176821 - DNA, 11 bp, Unknown
  misc_feature (1)..( 11): Result.005 file - promoters50/1664797
tgctcaatata

SEQ ID NO: 176822 - DNA, 11 bp, Unknown
  misc_feature (1)..( 11): Result.005 file - promoters50/1664797
ctttaaaaaga

SEQ ID NO: 176823 - DNA, 11 bp, Unknown
  misc_feature (1)..( 11): Result.005 file - promoters50/1664797
atttttttttt

SEQ ID NO: 176824 - DNA, 11 bp, Unknown
  misc_feature (1)..( 11): Result.005 file - promoters50/1664797
atttatttata

SEQ ID NO: 176825 - DNA, 11 bp, Unknown
  misc_feature (1)..( 11): Result.005 file - promoters50/1664797
ctttttttttt

SEQ ID NO: 176826 - DNA, 7 bp, Unknown
  misc_feature (1)..( 7): Result.005 file - promoters50/1664797
tttctac

SEQ ID NO: 176827 - DNA, 7 bp, Unknown
  misc_feature (1)..( 7): Result.005 file - promoters50/1664797
tttctaa

SEQ ID NO: 176828 - DNA, 7 bp, Unknown
  misc_feature (1)..( 7): Result.005 file - promoters50/1664797
tttttaa

SEQ ID NO: 176829 - DNA, 10 bp, Unknown
  misc_feature (1)..( 10): Result.005 file - promoters50/1664870
gtttctgtgg

SEQ ID NO: 176830 - DNA, 10 bp, Unknown
  misc_feature (1)..( 10): Result.005 file - promoters50/1664870
tattctgtga

SEQ ID NO: 176831 - DNA, 10 bp, Unknown
  misc_feature (1)..( 10): Result.005 file - promoters50/1664870
ttttttgttg

SEQ ID NO: 176832 - DNA, 10 bp, Unknown
  misc_feature (1)..( 10): Result.005 file - promoters50/1664870
tatactggat

SEQ ID NO: 176833 - DNA, 10 bp, Unknown
  misc_feature (1)..( 10): Result.005 file - promoters50/1664870
tcttttgttt

SEQ ID NO: 176834 - DNA, 12 bp, Unknown
  misc_feature (1)..( 12): Result.005 file - promoters50/1664870
tgtttaatgact

SEQ ID NO: 176835 - DNA, 12 bp, Unknown
  misc_feature (1)..( 12): Result.005 file - promoters50/1664870
attctaataact

SEQ ID NO: 176836 - DNA, 13 bp, Unknown
  misc_feature (1)..( 13): Result.005 file - promoters50/1664870
gttctaagtaaaa

SEQ ID NO: 176837 - DNA, 13 bp, Unknown
  misc_feature (1)..( 13): Result.005 file - promoters50/1664870
ctagtaatatcca

SEQ ID NO: 176838 - DNA, 13 bp, Unknown
  misc_feature (1)..( 13): Result.005 file - promoters50/1664870
atcttaaaaactc

SEQ ID NO: 176839 - DNA, 12 bp, Unknown
  misc_feature (1)..( 12): Result.005 file - promoters50/1664870
aacaaatccaaa

SEQ ID NO: 176840 - DNA, 12 bp, Unknown
  misc_feature (1)..( 12): Result.005 file - promoters50/1664870
tacaaatttgtt

SEQ ID NO: 176841 - DNA, 12 bp, Unknown
  misc_feature (1)..( 12): Result.005 file - promoters50/1664870
aacaaacatctt

SEQ ID NO: 176842 - DNA, 12 bp, Unknown
  misc_feature (1)..( 12): Result.005 file - promoters50/1664870
gacatacatctt

SEQ ID NO: 176843 - DNA, 12 bp, Unknown
  misc_feature (1)..( 12): Result.005 file - promoters50/1664870
aacagattcaat

SEQ ID NO: 176844 - DNA, 11 bp, Unknown
  misc_feature (1)..( 11): Result.005 file - promoters50/1664931
aaagaattttt

SEQ ID NO: 176845 - DNA, 11 bp, Unknown
  misc_feature (1)..( 11): Result.005 file - promoters50/1664931
gtataatttta

SEQ ID NO: 176846 - DNA, 11 bp, Unknown
  misc_feature (1)..( 11): Result.005 file - promoters50/1664931
taaaaattttt

SEQ ID NO: 176847 - DNA, 11 bp, Unknown
  misc_feature (1)..( 11): Result.005 file - promoters50/1664931
acctaagttta

SEQ ID NO: 176848 - DNA, 11 bp, Unknown
  misc_feature (1)..( 11): Result.005 file - promoters50/1664931
ataaaagtttg

SEQ ID NO: 176849 - DNA, 11 bp, Unknown
  misc_feature (1)..( 11): Result.005 file - promoters50/1664931
tctgaagtttc

SEQ ID NO: 176850 - DNA, 15 bp, Unknown
  misc_feature (1)..( 15): Result.005 file - promoters50/1664931
ataaaaaattttttt

SEQ ID NO: 176851 - DNA, 15 bp, Unknown
  misc_feature (1)..( 15): Result.005 file - promoters50/1664931
agaaaaaaaaaaaag

SEQ ID NO: 176852 - DNA, 15 bp, Unknown
  misc_feature (1)..( 15): Result.005 file - promoters50/1664931
atataaaatggtgtt

SEQ ID NO: 176853 - DNA, 15 bp, Unknown
  misc_feature (1)..( 15): Result.005 file - promoters50/1664931
atgaaatattttttt

SEQ ID NO: 176854 - DNA, 15 bp, Unknown
  misc_feature (1)..( 15): Result.005 file - promoters50/1664931
gataaatattcaact

SEQ ID NO: 176855 - DNA, 15 bp, Unknown
  misc_feature (1)..( 15): Result.005 file - promoters50/1664931
agaagaaacaaagta

SEQ ID NO: 176856 - DNA, 13 bp, Unknown
  misc_feature (1)..( 13): Result.005 file - promoters50/1664931
aataacatatgac

SEQ ID NO: 176857 - DNA, 13 bp, Unknown
  misc_feature (1)..( 13): Result.005 file - promoters50/1664931
gcaaacatttgaa

SEQ ID NO: 176858 - DNA, 13 bp, Unknown
  misc_feature (1)..( 13): Result.005 file - promoters50/1664931
aatgacataaatt

SEQ ID NO: 176859 - DNA, 13 bp, Unknown
  misc_feature (1)..( 13): Result.005 file - promoters50/1664931
cataacagttgta

SEQ ID NO: 176860 - DNA, 13 bp, Unknown
  misc_feature (1)..( 13): Result.005 file - promoters50/1664931
agtttaagttgta

SEQ ID NO: 176861 - DNA, 13 bp, Unknown
  misc_feature (1)..( 13): Result.005 file - promoters50/1664931
gtgaacttttaat

SEQ ID NO: 176862 - DNA, 15 bp, Unknown
  misc_feature (1)..( 15): Result.005 file - promoters50/1664931
caataatttacgaaa

SEQ ID NO: 176863 - DNA, 15 bp, Unknown
  misc_feature (1)..( 15): Result.005 file - promoters50/1664931
acttaagttactacc

SEQ ID NO: 176864 - DNA, 15 bp, Unknown
  misc_feature (1)..( 15): Result.005 file - promoters50/1664931
aaatagtttactatt

SEQ ID NO: 176865 - DNA, 15 bp, Unknown
  misc_feature (1)..( 15): Result.005 file - promoters50/1664931
aaaaaagtttttgta

SEQ ID NO: 176866 - DNA, 15 bp, Unknown
  misc_feature (1)..( 15): Result.005 file - promoters50/1664931
ctcgactttagtttt

SEQ ID NO: 176867 - DNA, 15 bp, Unknown
  misc_feature (1)..( 15): Result.005 file - promoters50/1664931
caaatttttactttt

SEQ ID NO: 176868 - DNA, 15 bp, Unknown
  misc_feature (1)..( 15): Result.005 file - promoters50/1664931
tttattgttacaaat

SEQ ID NO: 176869 - DNA, 11 bp, Unknown
  misc_feature (1)..( 11): Result.005 file - promoters50/1664931
caccaatcata

SEQ ID NO: 176870 - DNA, 11 bp, Unknown
  misc_feature (1)..( 11): Result.005 file - promoters50/1664931
tgagaatcatt

SEQ ID NO: 176871 - DNA, 11 bp, Unknown
  misc_feature (1)..( 11): Result.005 file - promoters50/1664931
caccactcatc

SEQ ID NO: 176872 - DNA, 11 bp, Unknown
  misc_feature (1)..( 11): Result.005 file - promoters50/1664931
aaagagtcaaa

SEQ ID NO: 176873 - DNA, 11 bp, Unknown
  misc_feature (1)..( 11): Result.005 file - promoters50/1664931
ttagactcatc

SEQ ID NO: 176874 - DNA, 11 bp, Unknown
  misc_feature (1)..( 11): Result.005 file - promoters50/1664931
tgccactcgac

SEQ ID NO: 176875 - DNA, 15 bp, Unknown
  misc_feature (1)..( 15): Result.005 file - promoters50/1664981
tcaaaaattgaacca

SEQ ID NO: 176876 - DNA, 15 bp, Unknown
  misc_feature (1)..( 15): Result.005 file - promoters50/1664981
ttagaaatcgaaaca

SEQ ID NO: 176877 - DNA, 15 bp, Unknown
  misc_feature (1)..( 15): Result.005 file - promoters50/1664981
tatcaaattgaatga

SEQ ID NO: 176878 - DNA, 15 bp, Unknown
  misc_feature (1)..( 15): Result.005 file - promoters50/1664981
aatcttcttgaacgt

SEQ ID NO: 176879 - DNA, 15 bp, Unknown
  misc_feature (1)..( 15): Result.005 file - promoters50/1664981
ttacaaatctatcct

SEQ ID NO: 176880 - DNA, 15 bp, Unknown
  misc_feature (1)..( 15): Result.005 file - promoters50/1664981
ctggtggttgattga

SEQ ID NO: 176881 - DNA, 16 bp, Unknown
  misc_feature (1)..( 16): Result.005 file - promoters50/1664981
aaaataaatcgaaaac

SEQ ID NO: 176882 - DNA, 16 bp, Unknown
  misc_feature (1)..( 16): Result.005 file - promoters50/1664981
ttatcaaattgaatga

SEQ ID NO: 176883 - DNA, 16 bp, Unknown
  misc_feature (1)..( 16): Result.005 file - promoters50/1664981
aaagtaaatcattttt

SEQ ID NO: 176884 - DNA, 16 bp, Unknown
  misc_feature (1)..( 16): Result.005 file - promoters50/1664981
gtggttgattgatagg

SEQ ID NO: 176885 - DNA, 16 bp, Unknown
  misc_feature (1)..( 16): Result.005 file - promoters50/1664981
tgtacatattgagagg

SEQ ID NO: 176886 - DNA, 16 bp, Unknown
  misc_feature (1)..( 16): Result.005 file - promoters50/1664981
gaagtaaagttgatta

SEQ ID NO: 176887 - DNA, 12 bp, Unknown
  misc_feature (1)..( 12): Result.005 file - promoters50/1664981
gaactttggttt

SEQ ID NO: 176888 - DNA, 12 bp, Unknown
  misc_feature (1)..( 12): Result.005 file - promoters50/1664981
gaagtttctggt

SEQ ID NO: 176889 - DNA, 12 bp, Unknown
  misc_feature (1)..( 12): Result.005 file - promoters50/1664981
gaattttgtttt

SEQ ID NO: 176890 - DNA, 12 bp, Unknown
  misc_feature (1)..( 12): Result.005 file - promoters50/1664981
aaagtttgttat

SEQ ID NO: 176891 - DNA, 12 bp, Unknown
  misc_feature (1)..( 12): Result.005 file - promoters50/1664981
taagtttaagtt

SEQ ID NO: 176892 - DNA, 12 bp, Unknown
  misc_feature (1)..( 12): Result.005 file - promoters50/1664981
aaagttgattaa

SEQ ID NO: 176893 - DNA, 14 bp, Unknown
  misc_feature (1)..( 14): Result.005 file - promoters50/1664981
taatatataaagga

SEQ ID NO: 176894 - DNA, 14 bp, Unknown
  misc_feature (1)..( 14): Result.005 file - promoters50/1664981
atttatatagataa

SEQ ID NO: 176895 - DNA, 14 bp, Unknown
  misc_feature (1)..( 14): Result.005 file - promoters50/1664981
acatatatacttag

SEQ ID NO: 176896 - DNA, 14 bp, Unknown
  misc_feature (1)..( 14): Result.005 file - promoters50/1664981
ctatataaagataa

SEQ ID NO: 176897 - DNA, 14 bp, Unknown
  misc_feature (1)..( 14): Result.005 file - promoters50/1664981
tactataaatctaa

SEQ ID NO: 176898 - DNA, 14 bp, Unknown
  misc_feature (1)..( 14): Result.005 file - promoters50/1664981
tactataaattctt

SEQ ID NO: 176899 - DNA, 12 bp, Unknown
  misc_feature (1)..( 12): Result.005 file - promoters50/1665056
caaagaaataac

SEQ ID NO: 176900 - DNA, 12 bp, Unknown
  misc_feature (1)..( 12): Result.005 file - promoters50/1665056
gaaaaaaataac

SEQ ID NO: 176901 - DNA, 12 bp, Unknown
  misc_feature (1)..( 12): Result.005 file - promoters50/1665056
gaaagaagaaaa

SEQ ID NO: 176902 - DNA, 12 bp, Unknown
  misc_feature (1)..( 12): Result.005 file - promoters50/1665056
ataaaaaattga

SEQ ID NO: 176903 - DNA, 12 bp, Unknown
  misc_feature (1)..( 12): Result.005 file - promoters50/1665056
agaagaaaacgt

SEQ ID NO: 176904 - DNA, 12 bp, Unknown
  misc_feature (1)..( 12): Result.005 file - promoters50/1665056
tatacaaaagct

SEQ ID NO: 176905 - DNA, 10 bp, Unknown
  misc_feature (1)..( 10): Result.005 file - promoters50/1665056
tatctataaa

SEQ ID NO: 176906 - DNA, 10 bp, Unknown
  misc_feature (1)..( 10): Result.005 file - promoters50/1665056
cgactaaaaa

SEQ ID NO: 176907 - DNA, 10 bp, Unknown
  misc_feature (1)..( 10): Result.005 file - promoters50/1665056
taacaaaaaa

SEQ ID NO: 176908 - DNA, 10 bp, Unknown
  misc_feature (1)..( 10): Result.005 file - promoters50/1665056
agagaaaaaa

SEQ ID NO: 176909 - DNA, 10 bp, Unknown
  misc_feature (1)..( 10): Result.005 file - promoters50/1665056
tggtaataaa

SEQ ID NO: 176910 - DNA, 10 bp, Unknown
  misc_feature (1)..( 10): Result.005 file - promoters50/1665056
tttctacaaa

SEQ ID NO: 176911 - DNA, 10 bp, Unknown
  misc_feature (1)..( 10): Result.005 file - promoters50/1665056
cgaagacaaa

SEQ ID NO: 176912 - DNA, 16 bp, Unknown
  misc_feature (1)..( 16): Result.005 file - promoters50/1665056
atagatttaattgggc

SEQ ID NO: 176913 - DNA, 16 bp, Unknown
  misc_feature (1)..( 16): Result.005 file - promoters50/1665056
ttttattttatttagg

SEQ ID NO: 176914 - DNA, 16 bp, Unknown
  misc_feature (1)..( 16): Result.005 file - promoters50/1665056
ataaatttaacgaatg

SEQ ID NO: 176915 - DNA, 16 bp, Unknown
  misc_feature (1)..( 16): Result.005 file - promoters50/1665056
gcaatgtttattaaaa

SEQ ID NO: 176916 - DNA, 16 bp, Unknown
  misc_feature (1)..( 16): Result.005 file - promoters50/1665056
tccaaatttcttaaaa

SEQ ID NO: 176917 - DNA, 16 bp, Unknown
  misc_feature (1)..( 16): Result.005 file - promoters50/1665056
ccagtgtttattttaa

SEQ ID NO: 176918 - DNA, 11 bp, Unknown
  misc_feature (1)..( 11): Result.005 file - promoters50/1665056
tacctttttac

SEQ ID NO: 176919 - DNA, 11 bp, Unknown
  misc_feature (1)..( 11): Result.005 file - promoters50/1665056
tgaatttgtac

SEQ ID NO: 176920 - DNA, 11 bp, Unknown
  misc_feature (1)..( 11): Result.005 file - promoters50/1665056
tatatttttaa

SEQ ID NO: 176921 - DNA, 11 bp, Unknown
  misc_feature (1)..( 11): Result.005 file - promoters50/1665056
aatctttttat

SEQ ID NO: 176922 - DNA, 11 bp, Unknown
  misc_feature (1)..( 11): Result.005 file - promoters50/1665056
tcccttattat

SEQ ID NO: 176923 - DNA, 11 bp, Unknown
  misc_feature (1)..( 11): Result.005 file - promoters50/1665056
aatatttctat

SEQ ID NO: 176924 - DNA, 7 bp, Unknown
  misc_feature (1)..( 7): Result.005 file - promoters50/1665080
tttctta

SEQ ID NO: 176925 - DNA, 7 bp, Unknown
  misc_feature (1)..( 7): Result.005 file - promoters50/1665080
tttgtta

SEQ ID NO: 176926 - DNA, 7 bp, Unknown
  misc_feature (1)..( 7): Result.005 file - promoters50/1665080
tttgttt

SEQ ID NO: 176927 - DNA, 10 bp, Unknown
  misc_feature (1)..( 10): Result.005 file - promoters50/1665080
tcccttttgg

SEQ ID NO: 176928 - DNA, 10 bp, Unknown
  misc_feature (1)..( 10): Result.005 file - promoters50/1665080
tccctttttt

SEQ ID NO: 176929 - DNA, 10 bp, Unknown
  misc_feature (1)..( 10): Result.005 file - promoters50/1665080
cttctttttt

SEQ ID NO: 176930 - DNA, 9 bp, Unknown
  misc_feature (1)..( 9): Result.005 file - promoters50/1665080
attaaacta

SEQ ID NO: 176931 - DNA, 9 bp, Unknown
  misc_feature (1)..( 9): Result.005 file - promoters50/1665080
attcaacta

SEQ ID NO: 176932 - DNA, 9 bp, Unknown
  misc_feature (1)..( 9): Result.005 file - promoters50/1665080
tttaaacca

SEQ ID NO: 176933 - DNA, 11 bp, Unknown
  misc_feature (1)..( 11): Result.005 file - promoters50/1665080
aatcttccaag

SEQ ID NO: 176934 - DNA, 11 bp, Unknown
  misc_feature (1)..( 11): Result.005 file - promoters50/1665080
tttcttccaag

SEQ ID NO: 176935 - DNA, 11 bp, Unknown
  misc_feature (1)..( 11): Result.005 file - promoters50/1665080
tttcttcaagg

SEQ ID NO: 176936 - DNA, 13 bp, Unknown
  misc_feature (1)..( 13): Result.005 file - promoters50/1665080
taaaaatatttat

SEQ ID NO: 176937 - DNA, 13 bp, Unknown
  misc_feature (1)..( 13): Result.005 file - promoters50/1665080
gaaaaatatatat

SEQ ID NO: 176938 - DNA, 13 bp, Unknown
  misc_feature (1)..( 13): Result.005 file - promoters50/1665080
taaaaaaagattc

SEQ ID NO: 176939 - DNA, 8 bp, Unknown
  misc_feature (1)..( 8): Result.005 file - promoters50/1665080
attccttg

SEQ ID NO: 176940 - DNA, 8 bp, Unknown
  misc_feature (1)..( 8): Result.005 file - promoters50/1665080
atttcttc

SEQ ID NO: 176941 - DNA, 8 bp, Unknown
  misc_feature (1)..( 8): Result.005 file - promoters50/1665080
ttttcttc

SEQ ID NO: 176942 - DNA, 9 bp, Unknown
  misc_feature (1)..( 9): Result.005 file - promoters50/1665080
tgtcatttc

SEQ ID NO: 176943 - DNA, 9 bp, Unknown
  misc_feature (1)..( 9): Result.005 file - promoters50/1665080
tgtgattta

SEQ ID NO: 176944 - DNA, 9 bp, Unknown
  misc_feature (1)..( 9): Result.005 file - promoters50/1665080
aatgactta

SEQ ID NO: 176945 - DNA, 9 bp, Unknown
  misc_feature (1)..( 9): Result.005 file - promoters50/1665243
attattttc

SEQ ID NO: 176946 - DNA, 9 bp, Unknown
  misc_feature (1)..( 9): Result.005 file - promoters50/1665243
atttttttg

SEQ ID NO: 176947 - DNA, 10 bp, Unknown
  misc_feature (1)..( 10): Result.005 file - promoters50/1665243
tttcagtttc

SEQ ID NO: 176948 - DNA, 10 bp, Unknown
  misc_feature (1)..( 10): Result.005 file - promoters50/1665243
caagattttt

SEQ ID NO: 176949 - DNA, 9 bp, Unknown
  misc_feature (1)..( 9): Result.005 file - promoters50/1665243
ttaaagagt

SEQ ID NO: 176950 - DNA, 9 bp, Unknown
  misc_feature (1)..( 9): Result.005 file - promoters50/1665243
ataaaaagt

SEQ ID NO: 176951 - DNA, 9 bp, Unknown
  misc_feature (1)..( 9): Result.005 file - promoters50/1665243
ataaaacaa

SEQ ID NO: 176952 - DNA, 9 bp, Unknown
  misc_feature (1)..( 9): Result.005 file - promoters50/1665243
atcaaaagt

SEQ ID NO: 176953 - DNA, 11 bp, Unknown
  misc_feature (1)..( 11): Result.005 file - promoters50/1665272
aatttgatttt

SEQ ID NO: 176954 - DNA, 11 bp, Unknown
  misc_feature (1)..( 11): Result.005 file - promoters50/1665272
attttgatcta

SEQ ID NO: 176955 - DNA, 11 bp, Unknown
  misc_feature (1)..( 11): Result.005 file - promoters50/1665272
catttgaaatt

SEQ ID NO: 176956 - DNA, 11 bp, Unknown
  misc_feature (1)..( 11): Result.005 file - promoters50/1665272
aattcgattct

SEQ ID NO: 176957 - DNA, 11 bp, Unknown
  misc_feature (1)..( 11): Result.005 file - promoters50/1665272
attttgattca

SEQ ID NO: 176958 - DNA, 11 bp, Unknown
  misc_feature (1)..( 11): Result.005 file - promoters50/1665272
ccgttgttcta

SEQ ID NO: 176959 - DNA, 11 bp, Unknown
  misc_feature (1)..( 11): Result.005 file - promoters50/1673798
gtaaactaaaa

SEQ ID NO: 176960 - DNA, 11 bp, Unknown
  misc_feature (1)..( 11): Result.005 file - promoters50/1673798
caaaaataaaa

SEQ ID NO: 176961 - DNA, 11 bp, Unknown
  misc_feature (1)..( 11): Result.005 file - promoters50/1673798
aaaaagtaaac

SEQ ID NO: 176962 - DNA, 11 bp, Unknown
  misc_feature (1)..( 11): Result.005 file - promoters50/1673798
ttaaacaaaat

SEQ ID NO: 176963 - DNA, 12 bp, Unknown
  misc_feature (1)..( 12): Result.005 file - promoters50/1673798
ttagcaataaat

SEQ ID NO: 176964 - DNA, 12 bp, Unknown
  misc_feature (1)..( 12): Result.005 file - promoters50/1673798
ttaacaataagg

SEQ ID NO: 176965 - DNA, 11 bp, Unknown
  misc_feature (1)..( 11): Result.005 file - promoters50/1673806
taaagaatttt

SEQ ID NO: 176966 - DNA, 11 bp, Unknown
  misc_feature (1)..( 11): Result.005 file - promoters50/1673806
taaaaaatgtt

SEQ ID NO: 176967 - DNA, 11 bp, Unknown
  misc_feature (1)..( 11): Result.005 file - promoters50/1673806
aaaataataat

SEQ ID NO: 176968 - DNA, 11 bp, Unknown
  misc_feature (1)..( 11): Result.005 file - promoters50/1673806
gaaataatttt

SEQ ID NO: 176969 - DNA, 11 bp, Unknown
  misc_feature (1)..( 11): Result.005 file - promoters50/1673806
gaaagaataat

SEQ ID NO: 176970 - DNA, 11 bp, Unknown
  misc_feature (1)..( 11): Result.005 file - promoters50/1673806
tgaaaaattca

SEQ ID NO: 176971 - DNA, 10 bp, Unknown
  misc_feature (1)..( 10): Result.005 file - promoters50/1673826
ataggttcca

SEQ ID NO: 176972 - DNA, 10 bp, Unknown
  misc_feature (1)..( 10): Result.005 file - promoters50/1673826
atagattcta

SEQ ID NO: 176973 - DNA, 10 bp, Unknown
  misc_feature (1)..( 10): Result.005 file - promoters50/1673826
ataagttagc

SEQ ID NO: 176974 - DNA, 10 bp, Unknown
  misc_feature (1)..( 10): Result.005 file - promoters50/1673826
ggagtttaga

SEQ ID NO: 176975 - DNA, 8 bp, Unknown
  misc_feature (1)..( 8): Result.005 file - promoters50/1673826
atcgttat

SEQ ID NO: 176976 - DNA, 8 bp, Unknown
  misc_feature (1)..( 8): Result.005 file - promoters50/1673826
atctttag

SEQ ID NO: 176977 - DNA, 8 bp, Unknown
  misc_feature (1)..( 8): Result.005 file - promoters50/1673826
ttctttaa

SEQ ID NO: 176978 - DNA, 8 bp, Unknown
  misc_feature (1)..( 8): Result.005 file - promoters50/1673826
ttctatag

SEQ ID NO: 176979 - DNA, 8 bp, Unknown
  misc_feature (1)..( 8): Result.005 file - promoters50/1673830
aaccaaat

SEQ ID NO: 176980 - DNA, 8 bp, Unknown
  misc_feature (1)..( 8): Result.005 file - promoters50/1673830
aacaaaaa

SEQ ID NO: 176981 - DNA, 8 bp, Unknown
  misc_feature (1)..( 8): Result.005 file - promoters50/1673830
aacaaaaa

SEQ ID NO: 176982 - DNA, 10 bp, Unknown
  misc_feature (1)..( 10): Result.005 file - promoters50/1673830
attaaagaaa

SEQ ID NO: 176983 - DNA, 10 bp, Unknown
  misc_feature (1)..( 10): Result.005 file - promoters50/1673830
attaaaggaa

SEQ ID NO: 176984 - DNA, 10 bp, Unknown
  misc_feature (1)..( 10): Result.005 file - promoters50/1673830
agtaagggaa

SEQ ID NO: 176985 - DNA, 10 bp, Unknown
  misc_feature (1)..( 10): Result.005 file - promoters50/1673830
ttcttgtttc

SEQ ID NO: 176986 - DNA, 10 bp, Unknown
  misc_feature (1)..( 10): Result.005 file - promoters50/1673830
ttcttcttta

SEQ ID NO: 176987 - DNA, 10 bp, Unknown
  misc_feature (1)..( 10): Result.005 file - promoters50/1673830
aagatcttta

SEQ ID NO: 176988 - DNA, 10 bp, Unknown
  misc_feature (1)..( 10): Result.005 file - promoters50/1673830
aaaacaaaat

SEQ ID NO: 176989 - DNA, 10 bp, Unknown
  misc_feature (1)..( 10): Result.005 file - promoters50/1673830
aaaacaaaaa

SEQ ID NO: 176990 - DNA, 10 bp, Unknown
  misc_feature (1)..( 10): Result.005 file - promoters50/1673830
tcaacaaaaa

SEQ ID NO: 176991 - DNA, 8 bp, Unknown
  misc_feature (1)..( 8): Result.005 file - promoters50/1673847
taatataa

SEQ ID NO: 176992 - DNA, 8 bp, Unknown
  misc_feature (1)..( 8): Result.005 file - promoters50/1673847
aaatttaa

SEQ ID NO: 176993 - DNA, 8 bp, Unknown
  misc_feature (1)..( 8): Result.005 file - promoters50/1673847
taatatta

SEQ ID NO: 176994 - DNA, 11 bp, Unknown
  misc_feature (1)..( 11): Result.005 file - promoters50/1673847
atacatcttta

SEQ ID NO: 176995 - DNA, 11 bp, Unknown
  misc_feature (1)..( 11): Result.005 file - promoters50/1673847
atagatcttat

SEQ ID NO: 176996 - DNA, 11 bp, Unknown
  misc_feature (1)..( 11): Result.005 file - promoters50/1673847
tctaatcttat

SEQ ID NO: 176997 - DNA, 11 bp, Unknown
  misc_feature (1)..( 11): Result.005 file - promoters50/1673847
tttgtatgatt

SEQ ID NO: 176998 - DNA, 11 bp, Unknown
  misc_feature (1)..( 11): Result.005 file - promoters50/1673847
tttgtatacca

SEQ ID NO: 176999 - DNA, 11 bp, Unknown
  misc_feature (1)..( 11): Result.005 file - promoters50/1673847
tttgtttgatt

SEQ ID NO: 177000 - DNA, 14 bp, Unknown
  misc_feature (1)..( 14): Result.005 file - promoters50/1673849
tattaaataatcca

SEQ ID NO: 177001 - DNA, 14 bp, Unknown
  misc_feature (1)..( 14): Result.005 file - promoters50/1673849
aattacatactaaa

SEQ ID NO: 177002 - DNA, 14 bp, Unknown
  misc_feature (1)..( 14): Result.005 file - promoters50/1673849
tatcaaaggaaatg

SEQ ID NO: 177003 - DNA, 14 bp, Unknown
  misc_feature (1)..( 14): Result.005 file - promoters50/1673849
gagaaaattatcca

SEQ ID NO: 177004 - DNA, 14 bp, Unknown
  misc_feature (1)..( 14): Result.005 file - promoters50/1673849
aatcacacaattaa

SEQ ID NO: 177005 - DNA, 9 bp, Unknown
  misc_feature (1)..( 9): Result.005 file - promoters50/1673849
aaaattatc

SEQ ID NO: 177006 - DNA, 9 bp, Unknown
  misc_feature (1)..( 9): Result.005 file - promoters50/1673849
aaatttatt

SEQ ID NO: 177007 - DNA, 9 bp, Unknown
  misc_feature (1)..( 9): Result.005 file - promoters50/1673849
ttattaatt

SEQ ID NO: 177008 - DNA, 9 bp, Unknown
  misc_feature (1)..( 9): Result.005 file - promoters50/1673849
acttttatt

SEQ ID NO: 177009 - DNA, 8 bp, Unknown
  misc_feature (1)..( 8): Result.005 file - promoters50/1673853
agaatatt

SEQ ID NO: 177010 - DNA, 8 bp, Unknown
  misc_feature (1)..( 8): Result.005 file - promoters50/1673853
ggaagatt

SEQ ID NO: 177011 - DNA, 8 bp, Unknown
  misc_feature (1)..( 8): Result.005 file - promoters50/1673853
agaatact

SEQ ID NO: 177012 - DNA, 8 bp, Unknown
  misc_feature (1)..( 8): Result.005 file - promoters50/1673853
agattata

SEQ ID NO: 177013 - DNA, 7 bp, Unknown
  misc_feature (1)..( 7): Result.005 file - promoters50/1673853
ctttgaa

SEQ ID NO: 177014 - DNA, 7 bp, Unknown
  misc_feature (1)..( 7): Result.005 file - promoters50/1673853
atttgaa

SEQ ID NO: 177015 - DNA, 7 bp, Unknown
  misc_feature (1)..( 7): Result.005 file - promoters50/1673853
ttttgaa

SEQ ID NO: 177016 - DNA, 7 bp, Unknown
  misc_feature (1)..( 7): Result.005 file - promoters50/1673853
attagaa

SEQ ID NO: 177017 - DNA, 9 bp, Unknown
  misc_feature (1)..( 9): Result.005 file - promoters50/1710026
atttgaatc

SEQ ID NO: 177018 - DNA, 9 bp, Unknown
  misc_feature (1)..( 9): Result.005 file - promoters50/1710026
atttcaatc

SEQ ID NO: 177019 - DNA, 9 bp, Unknown
  misc_feature (1)..( 9): Result.005 file - promoters50/1710026
gtttcaaat

SEQ ID NO: 177020 - DNA, 9 bp, Unknown
  misc_feature (1)..( 9): Result.005 file - promoters50/1710026
ttttaaata

SEQ ID NO: 177021 - DNA, 9 bp, Unknown
  misc_feature (1)..( 9): Result.005 file - promoters50/1710026
atttcaatc

SEQ ID NO: 177022 - DNA, 8 bp, Unknown
  misc_feature (1)..( 8): Result.005 file - promoters50/1710026
tttcaaat

SEQ ID NO: 177023 - DNA, 8 bp, Unknown
  misc_feature (1)..( 8): Result.005 file - promoters50/1710026
tttcaatc

SEQ ID NO: 177024 - DNA, 8 bp, Unknown
  misc_feature (1)..( 8): Result.005 file - promoters50/1710026
tttcaatc

SEQ ID NO: 177025 - DNA, 8 bp, Unknown
  misc_feature (1)..( 8): Result.005 file - promoters50/1710026
ttttaaat

SEQ ID NO: 177026 - DNA, 7 bp, Unknown
  misc_feature (1)..( 7): Result.005 file - promoters50/1710051
tttttcc

SEQ ID NO: 177027 - DNA, 7 bp, Unknown
  misc_feature (1)..( 7): Result.005 file - promoters50/1710051
tttttca

SEQ ID NO: 177028 - DNA, 7 bp, Unknown
  misc_feature (1)..( 7): Result.005 file - promoters50/1710051
tttatca

SEQ ID NO: 177029 - DNA, 8 bp, Unknown
  misc_feature (1)..( 8): Result.005 file - promoters50/1710051
tttaaata

SEQ ID NO: 177030 - DNA, 8 bp, Unknown
  misc_feature (1)..( 8): Result.005 file - promoters50/1710051
cttaaata

SEQ ID NO: 177031 - DNA, 8 bp, Unknown
  misc_feature (1)..( 8): Result.005 file - promoters50/1710051
cttgaatc

SEQ ID NO: 177032 - DNA, 10 bp, Unknown
  misc_feature (1)..( 10): Result.005 file - promoters50/1710051
aaatctataa

SEQ ID NO: 177033 - DNA, 10 bp, Unknown
  misc_feature (1)..( 10): Result.005 file - promoters50/1710051
caatttataa

SEQ ID NO: 177034 - DNA, 10 bp, Unknown
  misc_feature (1)..( 10): Result.005 file - promoters50/1710051
caatttaaaa

SEQ ID NO: 177035 - DNA, 8 bp, Unknown
  misc_feature (1)..( 8): Result.005 file - promoters50/1710645
aatttcgt

SEQ ID NO: 177036 - DNA, 8 bp, Unknown
  misc_feature (1)..( 8): Result.005 file - promoters50/1710645
gatttcgt

SEQ ID NO: 177037 - DNA, 8 bp, Unknown
  misc_feature (1)..( 8): Result.005 file - promoters50/1710645
aatttcgg

SEQ ID NO: 177038 - DNA, 9 bp, Unknown
  misc_feature (1)..( 9): Result.005 file - promoters50/1710645
gaagatgaa

SEQ ID NO: 177039 - DNA, 9 bp, Unknown
  misc_feature (1)..( 9): Result.005 file - promoters50/1710645
tttgatgaa

SEQ ID NO: 177040 - DNA, 9 bp, Unknown
  misc_feature (1)..( 9): Result.005 file - promoters50/1710645
tttgttgac

SEQ ID NO: 177041 - DNA, 9 bp, Unknown
  misc_feature (1)..( 9): Result.005 file - promoters50/1710759
caccttttc

SEQ ID NO: 177042 - DNA, 9 bp, Unknown
  misc_feature (1)..( 9): Result.005 file - promoters50/1710759
atcctttta

SEQ ID NO: 177043 - DNA, 9 bp, Unknown
  misc_feature (1)..( 9): Result.005 file - promoters50/1710759
atcatttta

SEQ ID NO: 177044 - DNA, 9 bp, Unknown
  misc_feature (1)..( 9): Result.005 file - promoters50/1710759
atttaccaa

SEQ ID NO: 177045 - DNA, 9 bp, Unknown
  misc_feature (1)..( 9): Result.005 file - promoters50/1710759
ttttaacaa

SEQ ID NO: 177046 - DNA, 9 bp, Unknown
  misc_feature (1)..( 9): Result.005 file - promoters50/1710759
ttttaaagt

SEQ ID NO: 177047 - DNA, 8 bp, Unknown
  misc_feature (1)..( 8): Result.005 file - promoters50/1710759
caatttta

SEQ ID NO: 177048 - DNA, 8 bp, Unknown
  misc_feature (1)..( 8): Result.005 file - promoters50/1710759
aaattttt

SEQ ID NO: 177049 - DNA, 8 bp, Unknown
  misc_feature (1)..( 8): Result.005 file - promoters50/1710759
caatttta

SEQ ID NO: 177050 - DNA, 10 bp, Unknown
  misc_feature (1)..( 10): Result.005 file - promoters50/1711228
ttcttaagat

SEQ ID NO: 177051 - DNA, 10 bp, Unknown
  misc_feature (1)..( 10): Result.005 file - promoters50/1711228
ttcttaggtg

SEQ ID NO: 177052 - DNA, 10 bp, Unknown
  misc_feature (1)..( 10): Result.005 file - promoters50/1711228
atctttagat

SEQ ID NO: 177053 - DNA, 10 bp, Unknown
  misc_feature (1)..( 10): Result.005 file - promoters50/1711228
tgattagatt

SEQ ID NO: 177054 - DNA, 10 bp, Unknown
  misc_feature (1)..( 10): Result.005 file - promoters50/1711228
aattttagaa

SEQ ID NO: 177055 - DNA, 10 bp, Unknown
  misc_feature (1)..( 10): Result.005 file - promoters50/1711228
ttctttggat

SEQ ID NO: 177056 - DNA, 13 bp, Unknown
  misc_feature (1)..( 13): Result.005 file - promoters50/1711228
cattaggctttaa

SEQ ID NO: 177057 - DNA, 13 bp, Unknown
  misc_feature (1)..( 13): Result.005 file - promoters50/1711228
aattgggcccaat

SEQ ID NO: 177058 - DNA, 13 bp, Unknown
  misc_feature (1)..( 13): Result.005 file - promoters50/1711228
aaatgggcctaat

SEQ ID NO: 177059 - DNA, 13 bp, Unknown
  misc_feature (1)..( 13): Result.005 file - promoters50/1711228
aaataggcccatt

SEQ ID NO: 177060 - DNA, 13 bp, Unknown
  misc_feature (1)..( 13): Result.005 file - promoters50/1711228
gtttgggccaact

SEQ ID NO: 177061 - DNA, 13 bp, Unknown
  misc_feature (1)..( 13): Result.005 file - promoters50/1711228
agatgggcctgac

SEQ ID NO: 177062 - DNA, 19 bp, Unknown
  misc_feature (1)..( 19): Result.005 file - promoters50/1711318
aatttattttccaattccc

SEQ ID NO: 177063 - DNA, 19 bp, Unknown
  misc_feature (1)..( 19): Result.005 file - promoters50/1711318
catacggtttgcaaaatct

SEQ ID NO: 177064 - DNA, 19 bp, Unknown
  misc_feature (1)..( 19): Result.005 file - promoters50/1711318
gatctaacttccaaaaacg

SEQ ID NO: 177065 - DNA, 19 bp, Unknown
  misc_feature (1)..( 19): Result.005 file - promoters50/1711318
aatttattttccaaagctc

SEQ ID NO: 177066 - DNA, 19 bp, Unknown
  misc_feature (1)..( 19): Result.005 file - promoters50/1711318
gaaactcttttcaagaagt

SEQ ID NO: 177067 - DNA, 19 bp, Unknown
  misc_feature (1)..( 19): Result.005 file - promoters50/1711318
ccagggatgtgaaatatat

SEQ ID NO: 177068 - DNA, 19 bp, Unknown
  misc_feature (1)..( 19): Result.005 file - promoters50/1711318
tgattaatttctctacttg

SEQ ID NO: 177069 - DNA, 19 bp, Unknown
  misc_feature (1)..( 19): Result.005 file - promoters50/1711318
atatgcaacaccaaatatc

SEQ ID NO: 177070 - DNA, 13 bp, Unknown
  misc_feature (1)..( 13): Result.005 file - promoters50/1711318
ttttttgttgtta

SEQ ID NO: 177071 - DNA, 13 bp, Unknown
  misc_feature (1)..( 13): Result.005 file - promoters50/1711318
gaattttttggca

SEQ ID NO: 177072 - DNA, 14 bp, Unknown
  misc_feature (1)..( 14): Result.005 file - promoters50/1711318
gatttatgttgtta

SEQ ID NO: 177073 - DNA, 14 bp, Unknown
  misc_feature (1)..( 14): Result.005 file - promoters50/1711318
tacggctgttgttg

SEQ ID NO: 177074 - DNA, 14 bp, Unknown
  misc_feature (1)..( 14): Result.005 file - promoters50/1711318
attgtttgttgcgt

SEQ ID NO: 177075 - DNA, 14 bp, Unknown
  misc_feature (1)..( 14): Result.005 file - promoters50/1711318
atcgtttgtattat

SEQ ID NO: 177076 - DNA, 10 bp, Unknown
  misc_feature (1)..( 10): Result.005 file - promoters50/1711318
tatttgataa

SEQ ID NO: 177077 - DNA, 10 bp, Unknown
  misc_feature (1)..( 10): Result.005 file - promoters50/1711318
atttttataa

SEQ ID NO: 177078 - DNA, 10 bp, Unknown
  misc_feature (1)..( 10): Result.005 file - promoters50/1711318
tattagatcc

SEQ ID NO: 177079 - DNA, 10 bp, Unknown
  misc_feature (1)..( 10): Result.005 file - promoters50/1711318
catgttataa

SEQ ID NO: 177080 - DNA, 10 bp, Unknown
  misc_feature (1)..( 10): Result.005 file - promoters50/1711318
cggattataa

SEQ ID NO: 177081 - DNA, 10 bp, Unknown
  misc_feature (1)..( 10): Result.005 file - promoters50/1711318
gagcttatta

SEQ ID NO: 177082 - DNA, 9 bp, Unknown
  misc_feature (1)..( 9): Result.005 file - promoters50/1711318
aaattgaat

SEQ ID NO: 177083 - DNA, 9 bp, Unknown
  misc_feature (1)..( 9): Result.005 file - promoters50/1711318
taattgaac

SEQ ID NO: 177084 - DNA, 9 bp, Unknown
  misc_feature (1)..( 9): Result.005 file - promoters50/1711318
ggattgaag

SEQ ID NO: 177085 - DNA, 9 bp, Unknown
  misc_feature (1)..( 9): Result.005 file - promoters50/1711318
agattgaaa

SEQ ID NO: 177086 - DNA, 9 bp, Unknown
  misc_feature (1)..( 9): Result.005 file - promoters50/1711318
aaattgatt

SEQ ID NO: 177087 - DNA, 9 bp, Unknown
  misc_feature (1)..( 9): Result.005 file - promoters50/1711318
gcatttaac

SEQ ID NO: 177088 - DNA, 16 bp, Unknown
  misc_feature (1)..( 16): Result.005 file - promoters50/1711318
tataatactaattaat

SEQ ID NO: 177089 - DNA, 16 bp, Unknown
  misc_feature (1)..( 16): Result.005 file - promoters50/1711318
aataataataagtaaa

SEQ ID NO: 177090 - DNA, 16 bp, Unknown
  misc_feature (1)..( 16): Result.005 file - promoters50/1711318
taaagctttaattagc

SEQ ID NO: 177091 - DNA, 16 bp, Unknown
  misc_feature (1)..( 16): Result.005 file - promoters50/1711318
tataatttaatgcatc

SEQ ID NO: 177092 - DNA, 16 bp, Unknown
  misc_feature (1)..( 16): Result.005 file - promoters50/1711318
taaagagataagtctg

SEQ ID NO: 177093 - DNA, 16 bp, Unknown
  misc_feature (1)..( 16): Result.005 file - promoters50/1711318
aaaacttaaaagtaaa

SEQ ID NO: 177094 - DNA, 16 bp, Unknown
  misc_feature (1)..( 16): Result.005 file - promoters50/1711318
aagatggttatttatt

SEQ ID NO: 177095 - DNA, 16 bp, Unknown
  misc_feature (1)..( 16): Result.005 file - promoters50/1711318
ttgtctgttacttagc

SEQ ID NO: 177096 - DNA, 11 bp, Unknown
  misc_feature (1)..( 11): Result.005 file - promoters50/1711318
tgttttgacta

SEQ ID NO: 177097 - DNA, 11 bp, Unknown
  misc_feature (1)..( 11): Result.005 file - promoters50/1711318
tgtcttggacc

SEQ ID NO: 177098 - DNA, 11 bp, Unknown
  misc_feature (1)..( 11): Result.005 file - promoters50/1711318
gattttgataa

SEQ ID NO: 177099 - DNA, 11 bp, Unknown
  misc_feature (1)..( 11): Result.005 file - promoters50/1711318
tgtattttatc

SEQ ID NO: 177100 - DNA, 11 bp, Unknown
  misc_feature (1)..( 11): Result.005 file - promoters50/1711318
aatttttataa

SEQ ID NO: 177101 - DNA, 11 bp, Unknown
  misc_feature (1)..( 11): Result.005 file - promoters50/1711318
acatgttataa

SEQ ID NO: 177102 - DNA, 11 bp, Unknown
  misc_feature (1)..( 11): Result.005 file - promoters50/1711318
acggattataa

SEQ ID NO: 177103 - DNA, 10 bp, Unknown
  misc_feature (1)..( 10): Result.005 file - promoters50/1711318
gatgaattta

SEQ ID NO: 177104 - DNA, 10 bp, Unknown
  misc_feature (1)..( 10): Result.005 file - promoters50/1711318
gatcaatggc

SEQ ID NO: 177105 - DNA, 10 bp, Unknown
  misc_feature (1)..( 10): Result.005 file - promoters50/1711318
gattaatttc

SEQ ID NO: 177106 - DNA, 10 bp, Unknown
  misc_feature (1)..( 10): Result.005 file - promoters50/1711318
atctaacttc

SEQ ID NO: 177107 - DNA, 10 bp, Unknown
  misc_feature (1)..( 10): Result.005 file - promoters50/1711318
atgtaattta

SEQ ID NO: 177108 - DNA, 10 bp, Unknown
  misc_feature (1)..( 10): Result.005 file - promoters50/1711318
tatcagtggt

SEQ ID NO: 177109 - DNA, 12 bp, Unknown
  misc_feature (1)..( 12): Result.005 file - promoters50/1711318
gtatcgattatg

SEQ ID NO: 177110 - DNA, 12 bp, Unknown
  misc_feature (1)..( 12): Result.005 file - promoters50/1711318
ccatcaattagt

SEQ ID NO: 177111 - DNA, 12 bp, Unknown
  misc_feature (1)..( 12): Result.005 file - promoters50/1711318
atatctattggg

SEQ ID NO: 177112 - DNA, 12 bp, Unknown
  misc_feature (1)..( 12): Result.005 file - promoters50/1711318
tgcacaatcagt

SEQ ID NO: 177113 - DNA, 12 bp, Unknown
  misc_feature (1)..( 12): Result.005 file - promoters50/1711318
acatcaaatagt

SEQ ID NO: 177114 - DNA, 12 bp, Unknown
  misc_feature (1)..( 12): Result.005 file - promoters50/1711318
ccatgaatttaa

SEQ ID NO: 177115 - DNA, 11 bp, Unknown
  misc_feature (1)..( 11): Result.005 file - promoters50/1711318
gatgaatttat

SEQ ID NO: 177116 - DNA, 11 bp, Unknown
  misc_feature (1)..( 11): Result.005 file - promoters50/1711318
gtgaaatatat

SEQ ID NO: 177117 - DNA, 11 bp, Unknown
  misc_feature (1)..( 11): Result.005 file - promoters50/1711318
gattaatttct

SEQ ID NO: 177118 - DNA, 11 bp, Unknown
  misc_feature (1)..( 11): Result.005 file - promoters50/1711318
aacctatatat

SEQ ID NO: 177119 - DNA, 11 bp, Unknown
  misc_feature (1)..( 11): Result.005 file - promoters50/1711318
atctaacttcc

SEQ ID NO: 177120 - DNA, 11 bp, Unknown
  misc_feature (1)..( 11): Result.005 file - promoters50/1711318
atgtaatttat

SEQ ID NO: 177121 - DNA, 11 bp, Unknown
  misc_feature (1)..( 11): Result.005 file - promoters50/1711318
accaaatatca

SEQ ID NO: 177122 - DNA, 8 bp, Unknown
  misc_feature (1)..( 8): Result.005 file - promoters50/1711318
gttttttt

SEQ ID NO: 177123 - DNA, 8 bp, Unknown
  misc_feature (1)..( 8): Result.005 file - promoters50/1711318
gttattta

SEQ ID NO: 177124 - DNA, 8 bp, Unknown
  misc_feature (1)..( 8): Result.005 file - promoters50/1711318
attttttt

SEQ ID NO: 177125 - DNA, 8 bp, Unknown
  misc_feature (1)..( 8): Result.005 file - promoters50/1711318
tttaatta

SEQ ID NO: 177126 - DNA, 8 bp, Unknown
  misc_feature (1)..( 8): Result.005 file - promoters50/1711318
tttaatgc

SEQ ID NO: 177127 - DNA, 8 bp, Unknown
  misc_feature (1)..( 8): Result.005 file - promoters50/1711318
gttactta

SEQ ID NO: 177128 - DNA, 16 bp, Unknown
  misc_feature (1)..( 16): Result.005 file - promoters50/1711586
ttgcccaaaaaataat

SEQ ID NO: 177129 - DNA, 16 bp, Unknown
  misc_feature (1)..( 16): Result.005 file - promoters50/1711586
atatatgaaatataaa

SEQ ID NO: 177130 - DNA, 16 bp, Unknown
  misc_feature (1)..( 16): Result.005 file - promoters50/1711586
ttattcaaaacataaa

SEQ ID NO: 177131 - DNA, 16 bp, Unknown
  misc_feature (1)..( 16): Result.005 file - promoters50/1711586
agtgtcaaaaaataat

SEQ ID NO: 177132 - DNA, 16 bp, Unknown
  misc_feature (1)..( 16): Result.005 file - promoters50/1711586
ctttacggtatataat

SEQ ID NO: 177133 - DNA, 16 bp, Unknown
  misc_feature (1)..( 16): Result.005 file - promoters50/1711586
tatatcaaaagtgtat

SEQ ID NO: 177134 - DNA, 16 bp, Unknown
  misc_feature (1)..( 16): Result.005 file - promoters50/1711586
ttattcaaaacccaac

SEQ ID NO: 177135 - DNA, 11 bp, Unknown
  misc_feature (1)..( 11): Result.005 file - promoters50/1711586
gatatatcaat

SEQ ID NO: 177136 - DNA, 11 bp, Unknown
  misc_feature (1)..( 11): Result.005 file - promoters50/1711586
gatatagcaaa

SEQ ID NO: 177137 - DNA, 11 bp, Unknown
  misc_feature (1)..( 11): Result.005 file - promoters50/1711586
catatatcgtg

SEQ ID NO: 177138 - DNA, 11 bp, Unknown
  misc_feature (1)..( 11): Result.005 file - promoters50/1711586
aatacatccct

SEQ ID NO: 177139 - DNA, 11 bp, Unknown
  misc_feature (1)..( 11): Result.005 file - promoters50/1711586
tatattgcaag

SEQ ID NO: 177140 - DNA, 11 bp, Unknown
  misc_feature (1)..( 11): Result.005 file - promoters50/1711586
aatattgcaaa

SEQ ID NO: 177141 - DNA, 10 bp, Unknown
  misc_feature (1)..( 10): Result.005 file - promoters50/1711626
aattaatctc

SEQ ID NO: 177142 - DNA, 10 bp, Unknown
  misc_feature (1)..( 10): Result.005 file - promoters50/1711626
aataaattat

SEQ ID NO: 177143 - DNA, 10 bp, Unknown
  misc_feature (1)..( 10): Result.005 file - promoters50/1711626
tgttactctc

SEQ ID NO: 177144 - DNA, 6 bp, Unknown
  misc_feature (1)..( 6): Result.005 file - promoters50/1711626
attcga

SEQ ID NO: 177145 - DNA, 6 bp, Unknown
  misc_feature (1)..( 6): Result.005 file - promoters50/1711626
attcga

SEQ ID NO: 177146 - DNA, 6 bp, Unknown
  misc_feature (1)..( 6): Result.005 file - promoters50/1711626
attcga

SEQ ID NO: 177147 - DNA, 8 bp, Unknown
  misc_feature (1)..( 8): Result.005 file - promoters50/1711626
aattcaac

SEQ ID NO: 177148 - DNA, 8 bp, Unknown
  misc_feature (1)..( 8): Result.005 file - promoters50/1711626
aatacaat

SEQ ID NO: 177149 - DNA, 8 bp, Unknown
  misc_feature (1)..( 8): Result.005 file - promoters50/1711626
tatataat

SEQ ID NO: 177150 - DNA, 7 bp, Unknown
  misc_feature (1)..( 7): Result.005 file - promoters50/1711626
atttgat

SEQ ID NO: 177151 - DNA, 7 bp, Unknown
  misc_feature (1)..( 7): Result.005 file - promoters50/1711626
attcgat

SEQ ID NO: 177152 - DNA, 7 bp, Unknown
  misc_feature (1)..( 7): Result.005 file - promoters50/1711626
attcgac

SEQ ID NO: 177153 - DNA, 10 bp, Unknown
  misc_feature (1)..( 10): Result.005 file - promoters50/1711638
taattaatta

SEQ ID NO: 177154 - DNA, 10 bp, Unknown
  misc_feature (1)..( 10): Result.005 file - promoters50/1711638
caattaatta

SEQ ID NO: 177155 - DNA, 11 bp, Unknown
  misc_feature (1)..( 11): Result.005 file - promoters50/1711638
atatctattta

SEQ ID NO: 177156 - DNA, 11 bp, Unknown
  misc_feature (1)..( 11): Result.005 file - promoters50/1711638
cgatctttttg

SEQ ID NO: 177157 - DNA, 8 bp, Unknown
  misc_feature (1)..( 8): Result.005 file - promoters50/1711638
gtaaaaag

SEQ ID NO: 177158 - DNA, 8 bp, Unknown
  misc_feature (1)..( 8): Result.005 file - promoters50/1711638
agaaaaag

SEQ ID NO: 177159 - DNA, 8 bp, Unknown
  misc_feature (1)..( 8): Result.005 file - promoters50/1711638
agaataag

SEQ ID NO: 177160 - DNA, 8 bp, Unknown
  misc_feature (1)..( 8): Result.005 file - promoters50/1711638
agaaaaat

SEQ ID NO: 177161 - DNA, 10 bp, Unknown
  misc_feature (1)..( 10): Result.005 file - promoters50/1711638
tttggattta

SEQ ID NO: 177162 - DNA, 10 bp, Unknown
  misc_feature (1)..( 10): Result.005 file - promoters50/1711638
ttttgatgat

SEQ ID NO: 177163 - DNA, 10 bp, Unknown
  misc_feature (1)..( 10): Result.005 file - promoters50/1711638
catggaatta

SEQ ID NO: 177164 - DNA, 10 bp, Unknown
  misc_feature (1)..( 10): Result.005 file - promoters50/1711638
gtttgatatc

SEQ ID NO: 177165 - DNA, 12 bp, Unknown
  misc_feature (1)..( 12): Result.005 file - promoters50/1711638
attagatttttt

SEQ ID NO: 177166 - DNA, 12 bp, Unknown
  misc_feature (1)..( 12): Result.005 file - promoters50/1711638
attcgatctttt

SEQ ID NO: 177167 - DNA, 12 bp, Unknown
  misc_feature (1)..( 12): Result.005 file - promoters50/1711638
cgattgtttttt

SEQ ID NO: 177168 - DNA, 13 bp, Unknown
  misc_feature (1)..( 13): Result.005 file - promoters50/1711638
ttgatatctattt

SEQ ID NO: 177169 - DNA, 9 bp, Unknown
  misc_feature (1)..( 9): Result.005 file - promoters50/1711650
taaactttt

SEQ ID NO: 177170 - DNA, 9 bp, Unknown
  misc_feature (1)..( 9): Result.005 file - promoters50/1711650
taaacgttt

SEQ ID NO: 177171 - DNA, 9 bp, Unknown
  misc_feature (1)..( 9): Result.005 file - promoters50/1711650
gaaagtttt

SEQ ID NO: 177172 - DNA, 13 bp, Unknown
  misc_feature (1)..( 13): Result.005 file - promoters50/1711650
tgtgataaataag

SEQ ID NO: 177173 - DNA, 13 bp, Unknown
  misc_feature (1)..( 13): Result.005 file - promoters50/1711650
tgttataaatttc

SEQ ID NO: 177174 - DNA, 13 bp, Unknown
  misc_feature (1)..( 13): Result.005 file - promoters50/1711650
ccatgtaattttc

SEQ ID NO: 177175 - DNA, 10 bp, Unknown
  misc_feature (1)..( 10): Result.005 file - promoters50/1711650
tttttacttt

SEQ ID NO: 177176 - DNA, 10 bp, Unknown
  misc_feature (1)..( 10): Result.005 file - promoters50/1711650
tgtttatttt

SEQ ID NO: 177177 - DNA, 10 bp, Unknown
  misc_feature (1)..( 10): Result.005 file - promoters50/1711650
tgtttatttg

SEQ ID NO: 177178 - DNA, 7 bp, Unknown
  misc_feature (1)..( 7): Result.005 file - promoters50/1711650
aaatttc

SEQ ID NO: 177179 - DNA, 7 bp, Unknown
  misc_feature (1)..( 7): Result.005 file - promoters50/1711650
caatttc

SEQ ID NO: 177180 - DNA, 7 bp, Unknown
  misc_feature (1)..( 7): Result.005 file - promoters50/1711650
caattta

SEQ ID NO: 177181 - DNA, 16 bp, Unknown
  misc_feature (1)..( 16): Result.005 file - promoters50/1711662
tcggttaatttacata

SEQ ID NO: 177182 - DNA, 16 bp, Unknown
  misc_feature (1)..( 16): Result.005 file - promoters50/1711662
tcggttaatttgcata

SEQ ID NO: 177183 - DNA, 16 bp, Unknown
  misc_feature (1)..( 16): Result.005 file - promoters50/1711662
cagtctaaattgggtt

SEQ ID NO: 177184 - DNA, 7 bp, Unknown
  misc_feature (1)..( 7): Result.005 file - promoters50/1711666
gattaaa

SEQ ID NO: 177185 - DNA, 7 bp, Unknown
  misc_feature (1)..( 7): Result.005 file - promoters50/1711666
aattaaa

SEQ ID NO: 177186 - DNA, 7 bp, Unknown
  misc_feature (1)..( 7): Result.005 file - promoters50/1711666
atttaaa

SEQ ID NO: 177187 - DNA, 7 bp, Unknown
  misc_feature (1)..( 7): Result.005 file - promoters50/1711666
attattt

SEQ ID NO: 177188 - DNA, 7 bp, Unknown
  misc_feature (1)..( 7): Result.005 file - promoters50/1711666
attattt

SEQ ID NO: 177189 - DNA, 7 bp, Unknown
  misc_feature (1)..( 7): Result.005 file - promoters50/1711666
atttttt

SEQ ID NO: 177190 - DNA, 9 bp, Unknown
  misc_feature (1)..( 9): Result.005 file - promoters50/1711666
ttaatcaaa

SEQ ID NO: 177191 - DNA, 9 bp, Unknown
  misc_feature (1)..( 9): Result.005 file - promoters50/1711666
taaataaaa

SEQ ID NO: 177192 - DNA, 9 bp, Unknown
  misc_feature (1)..( 9): Result.005 file - promoters50/1711666
ttaataaaa

SEQ ID NO: 177193 - DNA, 9 bp, Unknown
  misc_feature (1)..( 9): Result.005 file - promoters50/1711666
ttatgtttt

SEQ ID NO: 177194 - DNA, 9 bp, Unknown
  misc_feature (1)..( 9): Result.005 file - promoters50/1711666
ttatttttt

SEQ ID NO: 177195 - DNA, 9 bp, Unknown
  misc_feature (1)..( 9): Result.005 file - promoters50/1711666
atatttttg

SEQ ID NO: 177196 - DNA, 11 bp, Unknown
  misc_feature (1)..( 11): Result.005 file - promoters50/1711691
tattgaacaca

SEQ ID NO: 177197 - DNA, 11 bp, Unknown
  misc_feature (1)..( 11): Result.005 file - promoters50/1711691
aattgaaccaa

SEQ ID NO: 177198 - DNA, 11 bp, Unknown
  misc_feature (1)..( 11): Result.005 file - promoters50/1711691
tatcgaactct

SEQ ID NO: 177199 - DNA, 11 bp, Unknown
  misc_feature (1)..( 11): Result.005 file - promoters50/1711691
gactgaaacaa

SEQ ID NO: 177200 - DNA, 8 bp, Unknown
  misc_feature (1)..( 8): Result.005 file - promoters50/1711691
gtaaattt

SEQ ID NO: 177201 - DNA, 8 bp, Unknown
  misc_feature (1)..( 8): Result.005 file - promoters50/1711691
tcaaattt

SEQ ID NO: 177202 - DNA, 8 bp, Unknown
  misc_feature (1)..( 8): Result.005 file - promoters50/1711691
gtacatta

SEQ ID NO: 177203 - DNA, 10 bp, Unknown
  misc_feature (1)..( 10): Result.005 file - promoters50/1711691
aaaccaaaat

SEQ ID NO: 177204 - DNA, 10 bp, Unknown
  misc_feature (1)..( 10): Result.005 file - promoters50/1711691
aaaccaaaat

SEQ ID NO: 177205 - DNA, 10 bp, Unknown
  misc_feature (1)..( 10): Result.005 file - promoters50/1711691
aaaacaagga

SEQ ID NO: 177206 - DNA, 8 bp, Unknown
  misc_feature (1)..( 8): Result.005 file - promoters50/1711691
ttttctta

SEQ ID NO: 177207 - DNA, 8 bp, Unknown
  misc_feature (1)..( 8): Result.005 file - promoters50/1711691
ttttttta

SEQ ID NO: 177208 - DNA, 8 bp, Unknown
  misc_feature (1)..( 8): Result.005 file - promoters50/1711691
tttttttt

SEQ ID NO: 177209 - DNA, 8 bp, Unknown
  misc_feature (1)..( 8): Result.005 file - promoters50/1711691
tttttttt

SEQ ID NO: 177210 - DNA, 8 bp, Unknown
  misc_feature (1)..( 8): Result.005 file - promoters50/1711691
ttttttct

SEQ ID NO: 177211 - DNA, 8 bp, Unknown
  misc_feature (1)..( 8): Result.005 file - promoters50/1711691
tttttttt

SEQ ID NO: 177212 - DNA, 25 bp, Unknown
  misc_feature (1)..( 25): Result.005 file - promoters50/1711691
ccgtgcacgtagaccacaccactct

SEQ ID NO: 177213 - DNA, 25 bp, Unknown
  misc_feature (1)..( 25): Result.005 file - promoters50/1711691
gcgttcacgtagacttccactagtt

SEQ ID NO: 177214 - DNA, 25 bp, Unknown
  misc_feature (1)..( 25): Result.005 file - promoters50/1711691
ccgtgcacgtacaccacacaactct

SEQ ID NO: 177215 - DNA, 9 bp, Unknown
  misc_feature (1)..( 9): Result.005 file - promoters50/1712122
agtactaat

SEQ ID NO: 177216 - DNA, 9 bp, Unknown
  misc_feature (1)..( 9): Result.005 file - promoters50/1712122
agttctaat

SEQ ID NO: 177217 - DNA, 9 bp, Unknown
  misc_feature (1)..( 9): Result.005 file - promoters50/1712122
agttataac

SEQ ID NO: 177218 - DNA, 9 bp, Unknown
  misc_feature (1)..( 9): Result.005 file - promoters50/1712122
tatattaca

SEQ ID NO: 177219 - DNA, 7 bp, Unknown
  misc_feature (1)..( 7): Result.005 file - promoters50/1712122
atataaa

SEQ ID NO: 177220 - DNA, 7 bp, Unknown
  misc_feature (1)..( 7): Result.005 file - promoters50/1712122
atataac

SEQ ID NO: 177221 - DNA, 8 bp, Unknown
  misc_feature (1)..( 8): Result.005 file - promoters50/1712122
atatgaat

SEQ ID NO: 177222 - DNA, 8 bp, Unknown
  misc_feature (1)..( 8): Result.005 file - promoters50/1712122
ataaaacg

SEQ ID NO: 177223 - DNA, 8 bp, Unknown
  misc_feature (1)..( 8): Result.005 file - promoters50/1712134
ctttttct

SEQ ID NO: 177224 - DNA, 8 bp, Unknown
  misc_feature (1)..( 8): Result.005 file - promoters50/1712134
atttttcc

SEQ ID NO: 177225 - DNA, 8 bp, Unknown
  misc_feature (1)..( 8): Result.005 file - promoters50/1712134
atttttga

SEQ ID NO: 177226 - DNA, 8 bp, Unknown
  misc_feature (1)..( 8): Result.005 file - promoters50/1712134
gtttgtga

SEQ ID NO: 177227 - DNA, 8 bp, Unknown
  misc_feature (1)..( 8): Result.005 file - promoters50/1712134
attttgaa

SEQ ID NO: 177228 - DNA, 8 bp, Unknown
  misc_feature (1)..( 8): Result.005 file - promoters50/1712134
tttttgaa

SEQ ID NO: 177229 - DNA, 8 bp, Unknown
  misc_feature (1)..( 8): Result.005 file - promoters50/1712134
tttttgcc

SEQ ID NO: 177230 - DNA, 9 bp, Unknown
  misc_feature (1)..( 9): Result.005 file - promoters50/1712134
ttttctgcc

SEQ ID NO: 177231 - DNA, 11 bp, Unknown
  misc_feature (1)..( 11): Result.005 file - promoters50/1712134
aagtttttaca

SEQ ID NO: 177232 - DNA, 11 bp, Unknown
  misc_feature (1)..( 11): Result.005 file - promoters50/1712134
aagtttttgaa

SEQ ID NO: 177233 - DNA, 11 bp, Unknown
  misc_feature (1)..( 11): Result.005 file - promoters50/1712134
ttttttttgcc

SEQ ID NO: 177234 - DNA, 12 bp, Unknown
  misc_feature (1)..( 12): Result.005 file - promoters50/1712134
gtcttttctgcc

SEQ ID NO: 177235 - DNA, 10 bp, Unknown
  misc_feature (1)..( 10): Result.005 file - promoters50/1712134
taactttttc

SEQ ID NO: 177236 - DNA, 10 bp, Unknown
  misc_feature (1)..( 10): Result.005 file - promoters50/1712134
taatttttga

SEQ ID NO: 177237 - DNA, 10 bp, Unknown
  misc_feature (1)..( 10): Result.005 file - promoters50/1712134
ttttttttgc

SEQ ID NO: 177238 - DNA, 10 bp, Unknown
  misc_feature (1)..( 10): Result.005 file - promoters50/1712134
cggtttgtga

SEQ ID NO: 177239 - DNA, 11 bp, Unknown
  misc_feature (1)..( 11): Result.005 file - promoters50/1712150
tctatataaat

SEQ ID NO: 177240 - DNA, 11 bp, Unknown
  misc_feature (1)..( 11): Result.005 file - promoters50/1712150
cccatataaaa

SEQ ID NO: 177241 - DNA, 11 bp, Unknown
  misc_feature (1)..( 11): Result.005 file - promoters50/1712150
caaatatatat

SEQ ID NO: 177242 - DNA, 11 bp, Unknown
  misc_feature (1)..( 11): Result.005 file - promoters50/1712150
tttatttattc

SEQ ID NO: 177243 - DNA, 11 bp, Unknown
  misc_feature (1)..( 11): Result.005 file - promoters50/1712150
cccaaataaag

SEQ ID NO: 177244 - DNA, 11 bp, Unknown
  misc_feature (1)..( 11): Result.005 file - promoters50/1712150
tagttataaaa

SEQ ID NO: 177245 - DNA, 12 bp, Unknown
  misc_feature (1)..( 12): Result.005 file - promoters50/1712150
tataaatacaga

SEQ ID NO: 177246 - DNA, 12 bp, Unknown
  misc_feature (1)..( 12): Result.005 file - promoters50/1712150
cccaaataaaga

SEQ ID NO: 177247 - DNA, 12 bp, Unknown
  misc_feature (1)..( 12): Result.005 file - promoters50/1712150
caaatatatata

SEQ ID NO: 177248 - DNA, 12 bp, Unknown
  misc_feature (1)..( 12): Result.005 file - promoters50/1712150
tttatttattcc

SEQ ID NO: 177249 - DNA, 12 bp, Unknown
  misc_feature (1)..( 12): Result.005 file - promoters50/1712150
cccatataaaac

SEQ ID NO: 177250 - DNA, 12 bp, Unknown
  misc_feature (1)..( 12): Result.005 file - promoters50/1712150
tagttataaaaa

SEQ ID NO: 177251 - DNA, 7 bp, Unknown
  misc_feature (1)..( 7): Result.005 file - promoters50/1712174
ttttatc

SEQ ID NO: 177252 - DNA, 7 bp, Unknown
  misc_feature (1)..( 7): Result.005 file - promoters50/1712174
atttatc

SEQ ID NO: 177253 - DNA, 7 bp, Unknown
  misc_feature (1)..( 7): Result.005 file - promoters50/1712174
ttttatc

SEQ ID NO: 177254 - DNA, 7 bp, Unknown
  misc_feature (1)..( 7): Result.005 file - promoters50/1712174
aaatcta

SEQ ID NO: 177255 - DNA, 7 bp, Unknown
  misc_feature (1)..( 7): Result.005 file - promoters50/1712174
gaatcta

SEQ ID NO: 177256 - DNA, 7 bp, Unknown
  misc_feature (1)..( 7): Result.005 file - promoters50/1712174
gaatctc

SEQ ID NO: 177257 - DNA, 8 bp, Unknown
  misc_feature (1)..( 8): Result.005 file - promoters50/1712174
actatttg

SEQ ID NO: 177258 - DNA, 8 bp, Unknown
  misc_feature (1)..( 8): Result.005 file - promoters50/1712174
attatttg

SEQ ID NO: 177259 - DNA, 8 bp, Unknown
  misc_feature (1)..( 8): Result.005 file - promoters50/1712174
attgtttt

SEQ ID NO: 177260 - DNA, 9 bp, Unknown
  misc_feature (1)..( 9): Result.005 file - promoters50/1712174
gtcaaatcc

SEQ ID NO: 177261 - DNA, 9 bp, Unknown
  misc_feature (1)..( 9): Result.005 file - promoters50/1712174
gtcaaaaaa

SEQ ID NO: 177262 - DNA, 9 bp, Unknown
  misc_feature (1)..( 9): Result.005 file - promoters50/1712174
ctcaaaaaa

SEQ ID NO: 177263 - DNA, 10 bp, Unknown
  misc_feature (1)..( 10): Result.005 file - promoters50/1713776
ttttgtcttt

SEQ ID NO: 177264 - DNA, 10 bp, Unknown
  misc_feature (1)..( 10): Result.005 file - promoters50/1713776
ttttatcttt

SEQ ID NO: 177265 - DNA, 10 bp, Unknown
  misc_feature (1)..( 10): Result.005 file - promoters50/1713776
atttatccgg

SEQ ID NO: 177266 - DNA, 14 bp, Unknown
  misc_feature (1)..( 14): Result.005 file - promoters50/1713780
tattcaaaacataa

SEQ ID NO: 177267 - DNA, 14 bp, Unknown
  misc_feature (1)..( 14): Result.005 file - promoters50/1713780
tgcccaaaaaataa

SEQ ID NO: 177268 - DNA, 14 bp, Unknown
  misc_feature (1)..( 14): Result.005 file - promoters50/1713780
tatacaaaatatat

SEQ ID NO: 177269 - DNA, 14 bp, Unknown
  misc_feature (1)..( 14): Result.005 file - promoters50/1713780
tcctttaaacatta

SEQ ID NO: 177270 - DNA, 14 bp, Unknown
  misc_feature (1)..( 14): Result.005 file - promoters50/1713780
catttctaatctat

SEQ ID NO: 177271 - DNA, 11 bp, Unknown
  misc_feature (1)..( 11): Result.005 file - promoters50/1713780
cacaaattatc

SEQ ID NO: 177272 - DNA, 11 bp, Unknown
  misc_feature (1)..( 11): Result.005 file - promoters50/1713780
aataaaatatg

SEQ ID NO: 177273 - DNA, 11 bp, Unknown
  misc_feature (1)..( 11): Result.005 file - promoters50/1713780
taaaaaataga

SEQ ID NO: 177274 - DNA, 11 bp, Unknown
  misc_feature (1)..( 11): Result.005 file - promoters50/1713780
aataaaataac

SEQ ID NO: 177275 - DNA, 11 bp, Unknown
  misc_feature (1)..( 11): Result.005 file - promoters50/1713780
tgtaaaagatg

SEQ ID NO: 177276 - DNA, 12 bp, Unknown
  misc_feature (1)..( 12): Result.005 file - promoters50/1713780
aacttaaaaata

SEQ ID NO: 177277 - DNA, 12 bp, Unknown
  misc_feature (1)..( 12): Result.005 file - promoters50/1713780
agactaaatata

SEQ ID NO: 177278 - DNA, 12 bp, Unknown
  misc_feature (1)..( 12): Result.005 file - promoters50/1713780
ataacaaatatg

SEQ ID NO: 177279 - DNA, 12 bp, Unknown
  misc_feature (1)..( 12): Result.005 file - promoters50/1713780
ttgtaaaaaata

SEQ ID NO: 177280 - DNA, 12 bp, Unknown
  misc_feature (1)..( 12): Result.005 file - promoters50/1713780
ttgtaaaagatg

SEQ ID NO: 177281 - DNA, 10 bp, Unknown
  misc_feature (1)..( 10): Result.005 file - promoters50/1713780
aaaaaaaatt

SEQ ID NO: 177282 - DNA, 10 bp, Unknown
  misc_feature (1)..( 10): Result.005 file - promoters50/1713780
taaaacaata

SEQ ID NO: 177283 - DNA, 10 bp, Unknown
  misc_feature (1)..( 10): Result.005 file - promoters50/1713780
accaactata

SEQ ID NO: 177284 - DNA, 10 bp, Unknown
  misc_feature (1)..( 10): Result.005 file - promoters50/1713780
taacacattt

SEQ ID NO: 177285 - DNA, 10 bp, Unknown
  misc_feature (1)..( 10): Result.005 file - promoters50/1713780
caaaacacgg

SEQ ID NO: 177286 - DNA, 10 bp, Unknown
  misc_feature (1)..( 10): Result.005 file - promoters50/1713804
cataagtttc

SEQ ID NO: 177287 - DNA, 10 bp, Unknown
  misc_feature (1)..( 10): Result.005 file - promoters50/1713804
tatatgtttc

SEQ ID NO: 177288 - DNA, 10 bp, Unknown
  misc_feature (1)..( 10): Result.005 file - promoters50/1713804
aatatttgta

SEQ ID NO: 177289 - DNA, 10 bp, Unknown
  misc_feature (1)..( 10): Result.005 file - promoters50/1713804
caaaattata

SEQ ID NO: 177290 - DNA, 11 bp, Unknown
  misc_feature (1)..( 11): Result.005 file - promoters50/1713804
ccatagattca

SEQ ID NO: 177291 - DNA, 11 bp, Unknown
  misc_feature (1)..( 11): Result.005 file - promoters50/1713804
taaaagaatca

SEQ ID NO: 177292 - DNA, 11 bp, Unknown
  misc_feature (1)..( 11): Result.005 file - promoters50/1713804
taaaaaaatta

SEQ ID NO: 177293 - DNA, 11 bp, Unknown
  misc_feature (1)..( 11): Result.005 file - promoters50/1713804
tattagaaata

SEQ ID NO: 177294 - DNA, 10 bp, Unknown
  misc_feature (1)..( 10): Result.005 file - promoters50/1713804
tgatatttat

SEQ ID NO: 177295 - DNA, 10 bp, Unknown
  misc_feature (1)..( 10): Result.005 file - promoters50/1713804
caatatttgt

SEQ ID NO: 177296 - DNA, 10 bp, Unknown
  misc_feature (1)..( 10): Result.005 file - promoters50/1713804
ttatatatgt

SEQ ID NO: 177297 - DNA, 10 bp, Unknown
  misc_feature (1)..( 10): Result.005 file - promoters50/1713804
caaaattata

SEQ ID NO: 177298 - DNA, 9 bp, Unknown
  misc_feature (1)..( 9): Result.005 file - promoters50/1713804
tatgattaa

SEQ ID NO: 177299 - DNA, 9 bp, Unknown
  misc_feature (1)..( 9): Result.005 file - promoters50/1713804
tatcatttt

SEQ ID NO: 177300 - DNA, 10 bp, Unknown
  misc_feature (1)..( 10): Result.005 file - promoters50/1713804
catcaatttt

SEQ ID NO: 177301 - DNA, 10 bp, Unknown
  misc_feature (1)..( 10): Result.005 file - promoters50/1713804
tactaatttt

SEQ ID NO: 177302 - DNA, 7 bp, Unknown
  misc_feature (1)..( 7): Result.005 file - promoters50/1713804
ttatatc

SEQ ID NO: 177303 - DNA, 7 bp, Unknown
  misc_feature (1)..( 7): Result.005 file - promoters50/1713804
ttagatc

SEQ ID NO: 177304 - DNA, 7 bp, Unknown
  misc_feature (1)..( 7): Result.005 file - promoters50/1713804
ttatatc

SEQ ID NO: 177305 - DNA, 7 bp, Unknown
  misc_feature (1)..( 7): Result.005 file - promoters50/1713804
ttatatt

SEQ ID NO: 177306 - DNA, 13 bp, Unknown
  misc_feature (1)..( 13): Result.005 file - promoters50/1713839
tatacaaaatata

SEQ ID NO: 177307 - DNA, 13 bp, Unknown
  misc_feature (1)..( 13): Result.005 file - promoters50/1713839
tattcaaaacata

SEQ ID NO: 177308 - DNA, 13 bp, Unknown
  misc_feature (1)..( 13): Result.005 file - promoters50/1713839
cattggatagata

SEQ ID NO: 177309 - DNA, 7 bp, Unknown
  misc_feature (1)..( 7): Result.005 file - promoters50/1713839
aaaatat

SEQ ID NO: 177310 - DNA, 7 bp, Unknown
  misc_feature (1)..( 7): Result.005 file - promoters50/1713839
aaattat

SEQ ID NO: 177311 - DNA, 7 bp, Unknown
  misc_feature (1)..( 7): Result.005 file - promoters50/1713839
aaaataa

SEQ ID NO: 177312 - DNA, 7 bp, Unknown
  misc_feature (1)..( 7): Result.005 file - promoters50/1713839
aaactaa

SEQ ID NO: 177313 - DNA, 10 bp, Unknown
  misc_feature (1)..( 10): Result.005 file - promoters50/1713839
actaaataaa

SEQ ID NO: 177314 - DNA, 10 bp, Unknown
  misc_feature (1)..( 10): Result.005 file - promoters50/1713839
ccaaaataac

SEQ ID NO: 177315 - DNA, 10 bp, Unknown
  misc_feature (1)..( 10): Result.005 file - promoters50/1713839
actaaagaaa

SEQ ID NO: 177316 - DNA, 10 bp, Unknown
  misc_feature (1)..( 10): Result.005 file - promoters50/1713839
tagaaaaaaa

SEQ ID NO: 177317 - DNA, 11 bp, Unknown
  misc_feature (1)..( 11): Result.005 file - promoters50/1713839
aaccaaagata

SEQ ID NO: 177318 - DNA, 11 bp, Unknown
  misc_feature (1)..( 11): Result.005 file - promoters50/1713839
aacgaaagatc

SEQ ID NO: 177319 - DNA, 11 bp, Unknown
  misc_feature (1)..( 11): Result.005 file - promoters50/1713839
aaagaaaaatc

SEQ ID NO: 177320 - DNA, 9 bp, Unknown
  misc_feature (1)..( 9): Result.005 file - promoters50/1713839
agaaaagaa

SEQ ID NO: 177321 - DNA, 9 bp, Unknown
  misc_feature (1)..( 9): Result.005 file - promoters50/1713839
ggaaaagag

SEQ ID NO: 177322 - DNA, 9 bp, Unknown
  misc_feature (1)..( 9): Result.005 file - promoters50/1713839
agagaagaa

SEQ ID NO: 177323 - DNA, 9 bp, Unknown
  misc_feature (1)..( 9): Result.005 file - promoters50/1713842
agatacagt

SEQ ID NO: 177324 - DNA, 9 bp, Unknown
  misc_feature (1)..( 9): Result.005 file - promoters50/1713842
agagacatc

SEQ ID NO: 177325 - DNA, 9 bp, Unknown
  misc_feature (1)..( 9): Result.005 file - promoters50/1713842
cgatccaga

SEQ ID NO: 177326 - DNA, 9 bp, Unknown
  misc_feature (1)..( 9): Result.005 file - promoters50/1713842
ttataaagt

SEQ ID NO: 177327 - DNA, 11 bp, Unknown
  misc_feature (1)..( 11): Result.005 file - promoters50/1713895
attttctttat

SEQ ID NO: 177328 - DNA, 11 bp, Unknown
  misc_feature (1)..( 11): Result.005 file - promoters50/1713895
aatttatttgt

SEQ ID NO: 177329 - DNA, 11 bp, Unknown
  misc_feature (1)..( 11): Result.005 file - promoters50/1713895
cttttctgcct

SEQ ID NO: 177330 - DNA, 11 bp, Unknown
  misc_feature (1)..( 11): Result.005 file - promoters50/1713895
aatatatgctt

SEQ ID NO: 177331 - DNA, 11 bp, Unknown
  misc_feature (1)..( 11): Result.005 file - promoters50/1713895
tgtttatgcct

SEQ ID NO: 177332 - DNA, 11 bp, Unknown
  misc_feature (1)..( 11): Result.005 file - promoters50/1713895
tttttctcatt

SEQ ID NO: 177333 - DNA, 13 bp, Unknown
  misc_feature (1)..( 13): Result.005 file - promoters50/1713895
taatttatttgtg

SEQ ID NO: 177334 - DNA, 13 bp, Unknown
  misc_feature (1)..( 13): Result.005 file - promoters50/1713895
tcgtttacttgct

SEQ ID NO: 177335 - DNA, 13 bp, Unknown
  misc_feature (1)..( 13): Result.005 file - promoters50/1713895
acatttattagtg

SEQ ID NO: 177336 - DNA, 13 bp, Unknown
  misc_feature (1)..( 13): Result.005 file - promoters50/1713895
acatttttttctg

SEQ ID NO: 177337 - DNA, 13 bp, Unknown
  misc_feature (1)..( 13): Result.005 file - promoters50/1713895
tactttattctta

SEQ ID NO: 177338 - DNA, 13 bp, Unknown
  misc_feature (1)..( 13): Result.005 file - promoters50/1713895
taaattattctca

SEQ ID NO: 177339 - DNA, 13 bp, Unknown
  misc_feature (1)..( 13): Result.005 file - promoters50/1713895
cgatttttcattt

SEQ ID NO: 177340 - DNA, 12 bp, Unknown
  misc_feature (1)..( 12): Result.005 file - promoters50/1713895
ttaatatcttct

SEQ ID NO: 177341 - DNA, 12 bp, Unknown
  misc_feature (1)..( 12): Result.005 file - promoters50/1713895
attatattttca

SEQ ID NO: 177342 - DNA, 12 bp, Unknown
  misc_feature (1)..( 12): Result.005 file - promoters50/1713895
tatttattttct

SEQ ID NO: 177343 - DNA, 12 bp, Unknown
  misc_feature (1)..( 12): Result.005 file - promoters50/1713895
gttagatttttg

SEQ ID NO: 177344 - DNA, 12 bp, Unknown
  misc_feature (1)..( 12): Result.005 file - promoters50/1713895
ccaatatttcat

SEQ ID NO: 177345 - DNA, 12 bp, Unknown
  misc_feature (1)..( 12): Result.005 file - promoters50/1713895
tttttatttctt

SEQ ID NO: 177346 - DNA, 12 bp, Unknown
  misc_feature (1)..( 12): Result.005 file - promoters50/1713895
gtttgatctttt

SEQ ID NO: 177347 - DNA, 13 bp, Unknown
  misc_feature (1)..( 13): Result.005 file - promoters50/1713895
ataagaaaacatt

SEQ ID NO: 177348 - DNA, 13 bp, Unknown
  misc_feature (1)..( 13): Result.005 file - promoters50/1713895
acaagaaataaat

SEQ ID NO: 177349 - DNA, 13 bp, Unknown
  misc_feature (1)..( 13): Result.005 file - promoters50/1713895
atatgaaattatc

SEQ ID NO: 177350 - DNA, 13 bp, Unknown
  misc_feature (1)..( 13): Result.005 file - promoters50/1713895
ataataaatatga

SEQ ID NO: 177351 - DNA, 14 bp, Unknown
  misc_feature (1)..( 14): Result.005 file - promoters50/1713895
gtaatgtaattata

SEQ ID NO: 177352 - DNA, 14 bp, Unknown
  misc_feature (1)..( 14): Result.005 file - promoters50/1713895
ataataggttttta

SEQ ID NO: 177353 - DNA, 16 bp, Unknown
  misc_feature (1)..( 16): Result.005 file - promoters50/1713895
atgaaaaagtcaaaaa

SEQ ID NO: 177354 - DNA, 16 bp, Unknown
  misc_feature (1)..( 16): Result.005 file - promoters50/1713895
aaaaaaaagttcgtaa

SEQ ID NO: 177355 - DNA, 16 bp, Unknown
  misc_feature (1)..( 16): Result.005 file - promoters50/1713895
atgagaaagagaaaga

SEQ ID NO: 177356 - DNA, 16 bp, Unknown
  misc_feature (1)..( 16): Result.005 file - promoters50/1713895
ttaaaagagtttttag

SEQ ID NO: 177357 - DNA, 16 bp, Unknown
  misc_feature (1)..( 16): Result.005 file - promoters50/1713895
aacaaaaactcataaa

SEQ ID NO: 177358 - DNA, 16 bp, Unknown
  misc_feature (1)..( 16): Result.005 file - promoters50/1713895
caataaaactgtgagt

SEQ ID NO: 177359 - DNA, 8 bp, Unknown
  misc_feature (1)..( 8): Result.005 file - promoters50/1714500
tattttta

SEQ ID NO: 177360 - DNA, 8 bp, Unknown
  misc_feature (1)..( 8): Result.005 file - promoters50/1714500
tatttttt

SEQ ID NO: 177361 - DNA, 8 bp, Unknown
  misc_feature (1)..( 8): Result.005 file - promoters50/1714500
cattgtta

SEQ ID NO: 177362 - DNA, 8 bp, Unknown
  misc_feature (1)..( 8): Result.005 file - promoters50/1714500
tattttcg

SEQ ID NO: 177363 - DNA, 9 bp, Unknown
  misc_feature (1)..( 9): Result.005 file - promoters50/1714500
tatgttttc

SEQ ID NO: 177364 - DNA, 12 bp, Unknown
  misc_feature (1)..( 12): Result.005 file - promoters50/1714500
tttaagaaaata

SEQ ID NO: 177365 - DNA, 12 bp, Unknown
  misc_feature (1)..( 12): Result.005 file - promoters50/1714500
ggaatgaacata

SEQ ID NO: 177366 - DNA, 12 bp, Unknown
  misc_feature (1)..( 12): Result.005 file - promoters50/1714500
ttcgaaaaaatc

SEQ ID NO: 177367 - DNA, 12 bp, Unknown
  misc_feature (1)..( 12): Result.005 file - promoters50/1714500
ttttcgaaaaat

SEQ ID NO: 177368 - DNA, 10 bp, Unknown
  misc_feature (1)..( 10): Result.005 file - promoters50/1714541
tctcattcat

SEQ ID NO: 177369 - DNA, 10 bp, Unknown
  misc_feature (1)..( 10): Result.005 file - promoters50/1714541
cgtcatccat

SEQ ID NO: 177370 - DNA, 10 bp, Unknown
  misc_feature (1)..( 10): Result.005 file - promoters50/1714541
tctaattatt

SEQ ID NO: 177371 - DNA, 9 bp, Unknown
  misc_feature (1)..( 9): Result.005 file - promoters50/1714541
aatgttaca

SEQ ID NO: 177372 - DNA, 9 bp, Unknown
  misc_feature (1)..( 9): Result.005 file - promoters50/1714541
gatgttaac

SEQ ID NO: 177373 - DNA, 9 bp, Unknown
  misc_feature (1)..( 9): Result.005 file - promoters50/1714541
aatggtgtt

SEQ ID NO: 177374 - DNA, 8 bp, Unknown
  misc_feature (1)..( 8): Result.005 file - promoters50/1714639
ttaaaaca

SEQ ID NO: 177375 - DNA, 8 bp, Unknown
  misc_feature (1)..( 8): Result.005 file - promoters50/1714639
ataaaacc

SEQ ID NO: 177376 - DNA, 8 bp, Unknown
  misc_feature (1)..( 8): Result.005 file - promoters50/1714639
atacaacc

SEQ ID NO: 177377 - DNA, 8 bp, Unknown
  misc_feature (1)..( 8): Result.005 file - promoters50/1714682
atcagatt

SEQ ID NO: 177378 - DNA, 8 bp, Unknown
  misc_feature (1)..( 8): Result.005 file - promoters50/1714682
ctcaaatt

SEQ ID NO: 177379 - DNA, 8 bp, Unknown
  misc_feature (1)..( 8): Result.005 file - promoters50/1714682
atcagaaa

SEQ ID NO: 177380 - DNA, 10 bp, Unknown
  misc_feature (1)..( 10): Result.005 file - promoters50/1714682
ccttataacc

SEQ ID NO: 177381 - DNA, 10 bp, Unknown
  misc_feature (1)..( 10): Result.005 file - promoters50/1714682
aattaaaacc

SEQ ID NO: 177382 - DNA, 10 bp, Unknown
  misc_feature (1)..( 10): Result.005 file - promoters50/1714682
ccttttaaat

SEQ ID NO: 177383 - DNA, 8 bp, Unknown
  misc_feature (1)..( 8): Result.005 file - promoters50/1714682
attatctg

SEQ ID NO: 177384 - DNA, 8 bp, Unknown
  misc_feature (1)..( 8): Result.005 file - promoters50/1714682
attttctt

SEQ ID NO: 177385 - DNA, 8 bp, Unknown
  misc_feature (1)..( 8): Result.005 file - promoters50/1714682
tttttctt

SEQ ID NO: 177386 - DNA, 8 bp, Unknown
  misc_feature (1)..( 8): Result.005 file - promoters50/1714682
gaaccaac

SEQ ID NO: 177387 - DNA, 8 bp, Unknown
  misc_feature (1)..( 8): Result.005 file - promoters50/1714682
gaaacaat

SEQ ID NO: 177388 - DNA, 8 bp, Unknown
  misc_feature (1)..( 8): Result.005 file - promoters50/1714682
aaaacaat

SEQ ID NO: 177389 - DNA, 8 bp, Unknown
  misc_feature (1)..( 8): Result.005 file - promoters50/1714682
gaaacata

SEQ ID NO: 177390 - DNA, 10 bp, Unknown
  misc_feature (1)..( 10): Result.005 file - promoters50/1714682
tctatttata

SEQ ID NO: 177391 - DNA, 10 bp, Unknown
  misc_feature (1)..( 10): Result.005 file - promoters50/1714682
tctatatata

SEQ ID NO: 177392 - DNA, 10 bp, Unknown
  misc_feature (1)..( 10): Result.005 file - promoters50/1714682
tgtatataaa

SEQ ID NO: 177393 - DNA, 7 bp, Unknown
  misc_feature (1)..( 7): Result.005 file - promoters50/1714682
atcaaaa

SEQ ID NO: 177394 - DNA, 7 bp, Unknown
  misc_feature (1)..( 7): Result.005 file - promoters50/1714682
gtcaaaa

SEQ ID NO: 177395 - DNA, 7 bp, Unknown
  misc_feature (1)..( 7): Result.005 file - promoters50/1714682
atcgaaa

SEQ ID NO: 177396 - DNA, 8 bp, Unknown
  misc_feature (1)..( 8): Result.005 file - promoters50/1714682
aaaacaat

SEQ ID NO: 177397 - DNA, 8 bp, Unknown
  misc_feature (1)..( 8): Result.005 file - promoters50/1714682
aaaagaat

SEQ ID NO: 177398 - DNA, 8 bp, Unknown
  misc_feature (1)..( 8): Result.005 file - promoters50/1714682
gaaacaat

SEQ ID NO: 177399 - DNA, 8 bp, Unknown
  misc_feature (1)..( 8): Result.005 file - promoters50/1714682
catataaa

SEQ ID NO: 177400 - DNA, 8 bp, Unknown
  misc_feature (1)..( 8): Result.005 file - promoters50/1714682
tatataaa

SEQ ID NO: 177401 - DNA, 8 bp, Unknown
  misc_feature (1)..( 8): Result.005 file - promoters50/1714682
tatatata

SEQ ID NO: 177402 - DNA, 9 bp, Unknown
  misc_feature (1)..( 9): Result.005 file - promoters50/1714682
tcttaaaga

SEQ ID NO: 177403 - DNA, 9 bp, Unknown
  misc_feature (1)..( 9): Result.005 file - promoters50/1714682
tctttaagt

SEQ ID NO: 177404 - DNA, 9 bp, Unknown
  misc_feature (1)..( 9): Result.005 file - promoters50/1714682
aatttaagt

SEQ ID NO: 177405 - DNA, 7 bp, Unknown
  misc_feature (1)..( 7): Result.005 file - promoters50/1714682
ctataaa

SEQ ID NO: 177406 - DNA, 7 bp, Unknown
  misc_feature (1)..( 7): Result.005 file - promoters50/1714682
atataaa

SEQ ID NO: 177407 - DNA, 7 bp, Unknown
  misc_feature (1)..( 7): Result.005 file - promoters50/1714682
atatagc

SEQ ID NO: 177408 - DNA, 7 bp, Unknown
  misc_feature (1)..( 7): Result.005 file - promoters50/1714694
attgctt

SEQ ID NO: 177409 - DNA, 7 bp, Unknown
  misc_feature (1)..( 7): Result.005 file - promoters50/1714694
tttgctt

SEQ ID NO: 177410 - DNA, 7 bp, Unknown
  misc_feature (1)..( 7): Result.005 file - promoters50/1714694
tttactt

SEQ ID NO: 177411 - DNA, 8 bp, Unknown
  misc_feature (1)..( 8): Result.005 file - promoters50/1714694
ttgtattt

SEQ ID NO: 177412 - DNA, 8 bp, Unknown
  misc_feature (1)..( 8): Result.005 file - promoters50/1714694
ttgtatat

SEQ ID NO: 177413 - DNA, 8 bp, Unknown
  misc_feature (1)..( 8): Result.005 file - promoters50/1714694
atgtctat

SEQ ID NO: 177414 - DNA, 11 bp, Unknown
  misc_feature (1)..( 11): Result.005 file - promoters50/1714694
gttcaattttt

SEQ ID NO: 177415 - DNA, 11 bp, Unknown
  misc_feature (1)..( 11): Result.005 file - promoters50/1714694
tatcatttttt

SEQ ID NO: 177416 - DNA, 11 bp, Unknown
  misc_feature (1)..( 11): Result.005 file - promoters50/1714694
tatgattaagc

SEQ ID NO: 177417 - DNA, 7 bp, Unknown
  misc_feature (1)..( 7): Result.005 file - promoters50/1714772
aaacaaa

SEQ ID NO: 177418 - DNA, 7 bp, Unknown
  misc_feature (1)..( 7): Result.005 file - promoters50/1714772
aaacaaa

SEQ ID NO: 177419 - DNA, 7 bp, Unknown
  misc_feature (1)..( 7): Result.005 file - promoters50/1714772
aaagaaa

SEQ ID NO: 177420 - DNA, 9 bp, Unknown
  misc_feature (1)..( 9): Result.005 file - promoters50/1714772
aaattaagt

SEQ ID NO: 177421 - DNA, 9 bp, Unknown
  misc_feature (1)..( 9): Result.005 file - promoters50/1714772
aaagtaaag

SEQ ID NO: 177422 - DNA, 9 bp, Unknown
  misc_feature (1)..( 9): Result.005 file - promoters50/1714772
aaagaaaag

SEQ ID NO: 177423 - DNA, 9 bp, Unknown
  misc_feature (1)..( 9): Result.005 file - promoters50/1714772
gtttgtaaa

SEQ ID NO: 177424 - DNA, 9 bp, Unknown
  misc_feature (1)..( 9): Result.005 file - promoters50/1714772
ttttttaaa

SEQ ID NO: 177425 - DNA, 9 bp, Unknown
  misc_feature (1)..( 9): Result.005 file - promoters50/1714772
atttgttat

SEQ ID NO: 177426 - DNA, 8 bp, Unknown
  misc_feature (1)..( 8): Result.005 file - promoters50/1714772
aaaaagaa

SEQ ID NO: 177427 - DNA, 8 bp, Unknown
  misc_feature (1)..( 8): Result.005 file - promoters50/1714772
aaaaagtt

SEQ ID NO: 177428 - DNA, 8 bp, Unknown
  misc_feature (1)..( 8): Result.005 file - promoters50/1714772
aaaataaa

SEQ ID NO: 177429 - DNA, 9 bp, Unknown
  misc_feature (1)..( 9): Result.005 file - promoters50/1714772
aaaagaaaa

SEQ ID NO: 177430 - DNA, 9 bp, Unknown
  misc_feature (1)..( 9): Result.005 file - promoters50/1714772
taaataaaa

SEQ ID NO: 177431 - DNA, 9 bp, Unknown
  misc_feature (1)..( 9): Result.005 file - promoters50/1714772
aaaataaat

SEQ ID NO: 177432 - DNA, 6 bp, Unknown
  misc_feature (1)..( 6): Result.005 file - promoters50/1714806
atggga

SEQ ID NO: 177433 - DNA, 6 bp, Unknown
  misc_feature (1)..( 6): Result.005 file - promoters50/1714806
atggga

SEQ ID NO: 177434 - DNA, 6 bp, Unknown
  misc_feature (1)..( 6): Result.005 file - promoters50/1714806
atggga

SEQ ID NO: 177435 - DNA, 12 bp, Unknown
  misc_feature (1)..( 12): Result.005 file - promoters50/1714806
aaagatgggaaa

SEQ ID NO: 177436 - DNA, 12 bp, Unknown
  misc_feature (1)..( 12): Result.005 file - promoters50/1714806
aaaaatgaaaca

SEQ ID NO: 177437 - DNA, 12 bp, Unknown
  misc_feature (1)..( 12): Result.005 file - promoters50/1714806
aaagaaataaaa

SEQ ID NO: 177438 - DNA, 10 bp, Unknown
  misc_feature (1)..( 10): Result.005 file - promoters50/1714831
aaataatagt

SEQ ID NO: 177439 - DNA, 10 bp, Unknown
  misc_feature (1)..( 10): Result.005 file - promoters50/1714831
aaaaaattcc

SEQ ID NO: 177440 - DNA, 11 bp, Unknown
  misc_feature (1)..( 11): Result.005 file - promoters50/1714831
cacataatatt

SEQ ID NO: 177441 - DNA, 11 bp, Unknown
  misc_feature (1)..( 11): Result.005 file - promoters50/1714831
aaacaaataga

SEQ ID NO: 177442 - DNA, 11 bp, Unknown
  misc_feature (1)..( 11): Result.005 file - promoters50/1714831
ccaaaaatggc

SEQ ID NO: 177443 - DNA, 11 bp, Unknown
  misc_feature (1)..( 11): Result.005 file - promoters50/1714831
ataaaaacagt

SEQ ID NO: 177444 - DNA, 11 bp, Unknown
  misc_feature (1)..( 11): Result.005 file - promoters50/1714831
ctataaatatg

SEQ ID NO: 177445 - DNA, 9 bp, Unknown
  misc_feature (1)..( 9): Result.005 file - promoters50/1714837
aaaacaaaa

SEQ ID NO: 177446 - DNA, 9 bp, Unknown
  misc_feature (1)..( 9): Result.005 file - promoters50/1714837
ataacaaag

SEQ ID NO: 177447 - DNA, 10 bp, Unknown
  misc_feature (1)..( 10): Result.005 file - promoters50/1714837
taaacacaaa

SEQ ID NO: 177448 - DNA, 8 bp, Unknown
  misc_feature (1)..( 8): Result.005 file - promoters50/1714837
aatttaaa

SEQ ID NO: 177449 - DNA, 8 bp, Unknown
  misc_feature (1)..( 8): Result.005 file - promoters50/1714837
aatataac

SEQ ID NO: 177450 - DNA, 8 bp, Unknown
  misc_feature (1)..( 8): Result.005 file - promoters50/1714837
gattcaaa

SEQ ID NO: 177451 - DNA, 9 bp, Unknown
  misc_feature (1)..( 9): Result.005 file - promoters50/1714837
taaattagt

SEQ ID NO: 177452 - DNA, 9 bp, Unknown
  misc_feature (1)..( 9): Result.005 file - promoters50/1714837
caaattagt

SEQ ID NO: 177453 - DNA, 9 bp, Unknown
  misc_feature (1)..( 9): Result.005 file - promoters50/1714837
caaattgtt

SEQ ID NO: 177454 - DNA, 8 bp, Unknown
  misc_feature (1)..( 8): Result.005 file - promoters50/1714837
tataatta

SEQ ID NO: 177455 - DNA, 8 bp, Unknown
  misc_feature (1)..( 8): Result.005 file - promoters50/1714837
tataatta

SEQ ID NO: 177456 - DNA, 8 bp, Unknown
  misc_feature (1)..( 8): Result.005 file - promoters50/1714837
gctaatta

SEQ ID NO: 177457 - DNA, 11 bp, Unknown
  misc_feature (1)..( 11): Result.005 file - promoters50/1714857
tcatgaatacg

SEQ ID NO: 177458 - DNA, 11 bp, Unknown
  misc_feature (1)..( 11): Result.005 file - promoters50/1714857
agatgaattta

SEQ ID NO: 177459 - DNA, 11 bp, Unknown
  misc_feature (1)..( 11): Result.005 file - promoters50/1714857
tcaagaagaaa

SEQ ID NO: 177460 - DNA, 11 bp, Unknown
  misc_feature (1)..( 11): Result.005 file - promoters50/1714857
gtttgaactta

SEQ ID NO: 177461 - DNA, 11 bp, Unknown
  misc_feature (1)..( 11): Result.005 file - promoters50/1714857
tggagaggaag

SEQ ID NO: 177462 - DNA, 11 bp, Unknown
  misc_feature (1)..( 11): Result.005 file - promoters50/1714857
acatgtagagg

SEQ ID NO: 177463 - DNA, 15 bp, Unknown
  misc_feature (1)..( 15): Result.005 file - promoters50/1714857
attaatattatttta

SEQ ID NO: 177464 - DNA, 15 bp, Unknown
  misc_feature (1)..( 15): Result.005 file - promoters50/1714857
tttagacttaatttg

SEQ ID NO: 177465 - DNA, 15 bp, Unknown
  misc_feature (1)..( 15): Result.005 file - promoters50/1714857
atatgatttaatgat

SEQ ID NO: 177466 - DNA, 15 bp, Unknown
  misc_feature (1)..( 15): Result.005 file - promoters50/1714857
acatcttttaattaa

SEQ ID NO: 177467 - DNA, 15 bp, Unknown
  misc_feature (1)..( 15): Result.005 file - promoters50/1714857
cttataaaaaatttg

SEQ ID NO: 177468 - DNA, 15 bp, Unknown
  misc_feature (1)..( 15): Result.005 file - promoters50/1714857
gccacagctgatttc

SEQ ID NO: 177469 - DNA, 13 bp, Unknown
  misc_feature (1)..( 13): Result.005 file - promoters50/1714865
caaaacaaaacag

SEQ ID NO: 177470 - DNA, 13 bp, Unknown
  misc_feature (1)..( 13): Result.005 file - promoters50/1714865
caaaaaaaaaaaa

SEQ ID NO: 177471 - DNA, 14 bp, Unknown
  misc_feature (1)..( 14): Result.005 file - promoters50/1714865
aaaaatcaaaacga

SEQ ID NO: 177472 - DNA, 14 bp, Unknown
  misc_feature (1)..( 14): Result.005 file - promoters50/1714865
aaaaaacaaatcag

SEQ ID NO: 177473 - DNA, 14 bp, Unknown
  misc_feature (1)..( 14): Result.005 file - promoters50/1714865
gtaaataaagtaca

SEQ ID NO: 177474 - DNA, 12 bp, Unknown
  misc_feature (1)..( 12): Result.005 file - promoters50/1714865
ctttctaataaa

SEQ ID NO: 177475 - DNA, 12 bp, Unknown
  misc_feature (1)..( 12): Result.005 file - promoters50/1714865
ctttcaaataaa

SEQ ID NO: 177476 - DNA, 12 bp, Unknown
  misc_feature (1)..( 12): Result.005 file - promoters50/1714865
tcataaaataag

SEQ ID NO: 177477 - DNA, 12 bp, Unknown
  misc_feature (1)..( 12): Result.005 file - promoters50/1714865
cataaaaataaa

SEQ ID NO: 177478 - DNA, 12 bp, Unknown
  misc_feature (1)..( 12): Result.005 file - promoters50/1714865
tggtgaaaaaaa

SEQ ID NO: 177479 - DNA, 11 bp, Unknown
  misc_feature (1)..( 11): Result.005 file - promoters50/1714865
ataaaattcaa

SEQ ID NO: 177480 - DNA, 11 bp, Unknown
  misc_feature (1)..( 11): Result.005 file - promoters50/1714865
tggaaatacaa

SEQ ID NO: 177481 - DNA, 11 bp, Unknown
  misc_feature (1)..( 11): Result.005 file - promoters50/1714865
ataaaattggt

SEQ ID NO: 177482 - DNA, 11 bp, Unknown
  misc_feature (1)..( 11): Result.005 file - promoters50/1714865
aagaaataccc

SEQ ID NO: 177483 - DNA, 11 bp, Unknown
  misc_feature (1)..( 11): Result.005 file - promoters50/1714865
ataaaataagt

SEQ ID NO: 177484 - DNA, 12 bp, Unknown
  misc_feature (1)..( 12): Result.005 file - promoters50/1714865
atttataaataa

SEQ ID NO: 177485 - DNA, 12 bp, Unknown
  misc_feature (1)..( 12): Result.005 file - promoters50/1714865
ttttataaaaaa

SEQ ID NO: 177486 - DNA, 12 bp, Unknown
  misc_feature (1)..( 12): Result.005 file - promoters50/1714865
ctatataaatgc

SEQ ID NO: 177487 - DNA, 12 bp, Unknown
  misc_feature (1)..( 12): Result.005 file - promoters50/1714865
tctaataaataa

SEQ ID NO: 177488 - DNA, 12 bp, Unknown
  misc_feature (1)..( 12): Result.005 file - promoters50/1714865
ctatttaaaccg

SEQ ID NO: 177489 - DNA, 11 bp, Unknown
  misc_feature (1)..( 11): Result.005 file - promoters50/1714865
aaaaatatcaa

SEQ ID NO: 177490 - DNA, 11 bp, Unknown
  misc_feature (1)..( 11): Result.005 file - promoters50/1714865
aaaaatcaaaa

SEQ ID NO: 177491 - DNA, 11 bp, Unknown
  misc_feature (1)..( 11): Result.005 file - promoters50/1714865
aaaaaaaaaaa

SEQ ID NO: 177492 - DNA, 11 bp, Unknown
  misc_feature (1)..( 11): Result.005 file - promoters50/1714865
gtaaataaagt

SEQ ID NO: 177493 - DNA, 11 bp, Unknown
  misc_feature (1)..( 11): Result.005 file - promoters50/1714865
ggaaatacaaa

SEQ ID NO: 177494 - DNA, 9 bp, Unknown
  misc_feature (1)..( 9): Result.005 file - promoters50/1714865
aaaaatgca

SEQ ID NO: 177495 - DNA, 9 bp, Unknown
  misc_feature (1)..( 9): Result.005 file - promoters50/1714865
aaaaatttg

SEQ ID NO: 177496 - DNA, 9 bp, Unknown
  misc_feature (1)..( 9): Result.005 file - promoters50/1714865
aaaaatcaa

SEQ ID NO: 177497 - DNA, 9 bp, Unknown
  misc_feature (1)..( 9): Result.005 file - promoters50/1714865
ataaatttt

SEQ ID NO: 177498 - DNA, 12 bp, Unknown
  misc_feature (1)..( 12): Result.005 file - promoters50/1714865
gaaaaaaaaaaa

SEQ ID NO: 177499 - DNA, 12 bp, Unknown
  misc_feature (1)..( 12): Result.005 file - promoters50/1714865
gaaaaaaaaaaa

SEQ ID NO: 177500 - DNA, 12 bp, Unknown
  misc_feature (1)..( 12): Result.005 file - promoters50/1714865
gaagaaactacg

SEQ ID NO: 177501 - DNA, 12 bp, Unknown
  misc_feature (1)..( 12): Result.005 file - promoters50/1714865
gaaatacaaaaa

SEQ ID NO: 177502 - DNA, 10 bp, Unknown
  misc_feature (1)..( 10): Result.005 file - promoters50/1714865
aaaataaaat

SEQ ID NO: 177503 - DNA, 10 bp, Unknown
  misc_feature (1)..( 10): Result.005 file - promoters50/1714865
aaaaaaaaac

SEQ ID NO: 177504 - DNA, 10 bp, Unknown
  misc_feature (1)..( 10): Result.005 file - promoters50/1714865
aatataaaat

SEQ ID NO: 177505 - DNA, 10 bp, Unknown
  misc_feature (1)..( 10): Result.005 file - promoters50/1714865
caaataaatg

SEQ ID NO: 177506 - DNA, 10 bp, Unknown
  misc_feature (1)..( 10): Result.005 file - promoters50/1714865
ctcataaaat

SEQ ID NO: 177507 - DNA, 11 bp, Unknown
  misc_feature (1)..( 11): Result.005 file - promoters50/1714865
aaataatatta

SEQ ID NO: 177508 - DNA, 11 bp, Unknown
  misc_feature (1)..( 11): Result.005 file - promoters50/1714865
aaatattattt

SEQ ID NO: 177509 - DNA, 11 bp, Unknown
  misc_feature (1)..( 11): Result.005 file - promoters50/1714865
aatgtttattt

SEQ ID NO: 177510 - DNA, 11 bp, Unknown
  misc_feature (1)..( 11): Result.005 file - promoters50/1714865
tgatatgattc

SEQ ID NO: 177511 - DNA, 7 bp, Unknown
  misc_feature (1)..( 7): Result.005 file - promoters50/1714877
ataattt

SEQ ID NO: 177512 - DNA, 7 bp, Unknown
  misc_feature (1)..( 7): Result.005 file - promoters50/1714877
ttaattt

SEQ ID NO: 177513 - DNA, 7 bp, Unknown
  misc_feature (1)..( 7): Result.005 file - promoters50/1714877
ttagttt

SEQ ID NO: 177514 - DNA, 11 bp, Unknown
  misc_feature (1)..( 11): Result.005 file - promoters50/1714912
aagaagaaaag

SEQ ID NO: 177515 - DNA, 11 bp, Unknown
  misc_feature (1)..( 11): Result.005 file - promoters50/1714912
aaaaagaaaaa

SEQ ID NO: 177516 - DNA, 11 bp, Unknown
  misc_feature (1)..( 11): Result.005 file - promoters50/1714912
aaaaataaaaa

SEQ ID NO: 177517 - DNA, 10 bp, Unknown
  misc_feature (1)..( 10): Result.005 file - promoters50/1714942
cattgcttag

SEQ ID NO: 177518 - DNA, 10 bp, Unknown
  misc_feature (1)..( 10): Result.005 file - promoters50/1714942
cattgctgtt

SEQ ID NO: 177519 - DNA, 10 bp, Unknown
  misc_feature (1)..( 10): Result.005 file - promoters50/1714942
tattgctcgg

SEQ ID NO: 177520 - DNA, 10 bp, Unknown
  misc_feature (1)..( 10): Result.005 file - promoters50/1714942
acttgattag

SEQ ID NO: 177521 - DNA, 10 bp, Unknown
  misc_feature (1)..( 10): Result.005 file - promoters50/1714974
ttgtatttat

SEQ ID NO: 177522 - DNA, 10 bp, Unknown
  misc_feature (1)..( 10): Result.005 file - promoters50/1714974
ttgaatttag

SEQ ID NO: 177523 - DNA, 10 bp, Unknown
  misc_feature (1)..( 10): Result.005 file - promoters50/1714974
gtggatttat

SEQ ID NO: 177524 - DNA, 11 bp, Unknown
  misc_feature (1)..( 11): Result.005 file - promoters50/1714974
tttgattatat

SEQ ID NO: 177525 - DNA, 10 bp, Unknown
  misc_feature (1)..( 10): Result.005 file - promoters50/1714974
aaacgaaatt

SEQ ID NO: 177526 - DNA, 10 bp, Unknown
  misc_feature (1)..( 10): Result.005 file - promoters50/1714974
aaaccaaata

SEQ ID NO: 177527 - DNA, 10 bp, Unknown
  misc_feature (1)..( 10): Result.005 file - promoters50/1714974
aaatgaaaaa

SEQ ID NO: 177528 - DNA, 10 bp, Unknown
  misc_feature (1)..( 10): Result.005 file - promoters50/1714974
cttgcaaata

SEQ ID NO: 177529 - DNA, 10 bp, Unknown
  misc_feature (1)..( 10): Result.005 file - promoters50/1714974
tattaaagga

SEQ ID NO: 177530 - DNA, 10 bp, Unknown
  misc_feature (1)..( 10): Result.005 file - promoters50/1714974
tataaaacca

SEQ ID NO: 177531 - DNA, 10 bp, Unknown
  misc_feature (1)..( 10): Result.005 file - promoters50/1714974
atttagagga

SEQ ID NO: 177532 - DNA, 10 bp, Unknown
  misc_feature (1)..( 10): Result.005 file - promoters50/1714974
aatacaacat

SEQ ID NO: 177533 - DNA, 11 bp, Unknown
  misc_feature (1)..( 11): Result.005 file - promoters50/1714974
taaaatttatt

SEQ ID NO: 177534 - DNA, 11 bp, Unknown
  misc_feature (1)..( 11): Result.005 file - promoters50/1714974
atgcattcatt

SEQ ID NO: 177535 - DNA, 11 bp, Unknown
  misc_feature (1)..( 11): Result.005 file - promoters50/1714974
aaaactttatc

SEQ ID NO: 177536 - DNA, 11 bp, Unknown
  misc_feature (1)..( 11): Result.005 file - promoters50/1714974
aaaccttgtgg

SEQ ID NO: 177537 - DNA, 10 bp, Unknown
  misc_feature (1)..( 10): Result.005 file - promoters50/1714974
aaattttact

SEQ ID NO: 177538 - DNA, 10 bp, Unknown
  misc_feature (1)..( 10): Result.005 file - promoters50/1714974
aaactttatc

SEQ ID NO: 177539 - DNA, 10 bp, Unknown
  misc_feature (1)..( 10): Result.005 file - promoters50/1714974
aaaccttgtg

SEQ ID NO: 177540 - DNA, 10 bp, Unknown
  misc_feature (1)..( 10): Result.005 file - promoters50/1714974
agccttgatc

SEQ ID NO: 177541 - DNA, 12 bp, Unknown
  misc_feature (1)..( 12): Result.005 file - promoters50/1714989
aatcaacatata

SEQ ID NO: 177542 - DNA, 12 bp, Unknown
  misc_feature (1)..( 12): Result.005 file - promoters50/1714989
aaactacatatt

SEQ ID NO: 177543 - DNA, 12 bp, Unknown
  misc_feature (1)..( 12): Result.005 file - promoters50/1714989
aataaacatatt

SEQ ID NO: 177544 - DNA, 12 bp, Unknown
  misc_feature (1)..( 12): Result.005 file - promoters50/1714989
accattcatata

SEQ ID NO: 177545 - DNA, 12 bp, Unknown
  misc_feature (1)..( 12): Result.005 file - promoters50/1714989
cccaaaaataag

SEQ ID NO: 177546 - DNA, 12 bp, Unknown
  misc_feature (1)..( 12): Result.005 file - promoters50/1714989
aacaaaaaaggt

SEQ ID NO: 177547 - DNA, 12 bp, Unknown
  misc_feature (1)..( 12): Result.005 file - promoters50/1714989
tacaaaaaaagc

SEQ ID NO: 177548 - DNA, 10 bp, Unknown
  misc_feature (1)..( 10): Result.005 file - promoters50/1714989
caaagattta

SEQ ID NO: 177549 - DNA, 10 bp, Unknown
  misc_feature (1)..( 10): Result.005 file - promoters50/1714989
aaaatattaa

SEQ ID NO: 177550 - DNA, 10 bp, Unknown
  misc_feature (1)..( 10): Result.005 file - promoters50/1714989
taaaaattaa

SEQ ID NO: 177551 - DNA, 10 bp, Unknown
  misc_feature (1)..( 10): Result.005 file - promoters50/1714989
aaaataagat

SEQ ID NO: 177552 - DNA, 10 bp, Unknown
  misc_feature (1)..( 10): Result.005 file - promoters50/1714989
agaatactaa

SEQ ID NO: 177553 - DNA, 10 bp, Unknown
  misc_feature (1)..( 10): Result.005 file - promoters50/1714989
taaacatatt

SEQ ID NO: 177554 - DNA, 10 bp, Unknown
  misc_feature (1)..( 10): Result.005 file - promoters50/1714989
gaaacaaatt

SEQ ID NO: 177555 - DNA, 10 bp, Unknown
  misc_feature (1)..( 10): Result.005 file - promoters50/1714989
aaaacaaacg

SEQ ID NO: 177556 - DNA, 10 bp, Unknown
  misc_feature (1)..( 10): Result.005 file - promoters50/1714989
gaaaaaaaag

SEQ ID NO: 177557 - DNA, 10 bp, Unknown
  misc_feature (1)..( 10): Result.005 file - promoters50/1714989
taaataaatt

SEQ ID NO: 177558 - DNA, 10 bp, Unknown
  misc_feature (1)..( 10): Result.005 file - promoters50/1714989
taaaaaaaga

SEQ ID NO: 177559 - DNA, 10 bp, Unknown
  misc_feature (1)..( 10): Result.005 file - promoters50/1714989
ttaactaatt

SEQ ID NO: 177560 - DNA, 10 bp, Unknown
  misc_feature (1)..( 10): Result.005 file - promoters50/1714989
taatataact

SEQ ID NO: 177561 - DNA, 16 bp, Unknown
  misc_feature (1)..( 16): Result.005 file - promoters50/1714989
tccaactaaagtatac

SEQ ID NO: 177562 - DNA, 16 bp, Unknown
  misc_feature (1)..( 16): Result.005 file - promoters50/1714989
tttaacaaaaaaaata

SEQ ID NO: 177563 - DNA, 16 bp, Unknown
  misc_feature (1)..( 16): Result.005 file - promoters50/1714989
aaaaaccaaagacaag

SEQ ID NO: 177564 - DNA, 16 bp, Unknown
  misc_feature (1)..( 16): Result.005 file - promoters50/1714989
tccaaataaaatatct

SEQ ID NO: 177565 - DNA, 16 bp, Unknown
  misc_feature (1)..( 16): Result.005 file - promoters50/1714989
agagacaaaaacaata

SEQ ID NO: 177566 - DNA, 16 bp, Unknown
  misc_feature (1)..( 16): Result.005 file - promoters50/1714989
ggttacaaaatatcaa

SEQ ID NO: 177567 - DNA, 16 bp, Unknown
  misc_feature (1)..( 16): Result.005 file - promoters50/1714989
tttctttaaactatga

SEQ ID NO: 177568 - DNA, 9 bp, Unknown
  misc_feature (1)..( 9): Result.005 file - promoters50/1714989
ttacaaaca

SEQ ID NO: 177569 - DNA, 9 bp, Unknown
  misc_feature (1)..( 9): Result.005 file - promoters50/1714989
agacaaacg

SEQ ID NO: 177570 - DNA, 9 bp, Unknown
  misc_feature (1)..( 9): Result.005 file - promoters50/1714989
ttaaaaaat

SEQ ID NO: 177571 - DNA, 9 bp, Unknown
  misc_feature (1)..( 9): Result.005 file - promoters50/1714989
ttaaaaagt

SEQ ID NO: 177572 - DNA, 9 bp, Unknown
  misc_feature (1)..( 9): Result.005 file - promoters50/1714989
ttaaaatcg

SEQ ID NO: 177573 - DNA, 9 bp, Unknown
  misc_feature (1)..( 9): Result.005 file - promoters50/1714989
caaaagagt

SEQ ID NO: 177574 - DNA, 12 bp, Unknown
  misc_feature (1)..( 12): Result.005 file - promoters50/1714989
catatacaagaa

SEQ ID NO: 177575 - DNA, 12 bp, Unknown
  misc_feature (1)..( 12): Result.005 file - promoters50/1714989
agtatacaaaaa

SEQ ID NO: 177576 - DNA, 12 bp, Unknown
  misc_feature (1)..( 12): Result.005 file - promoters50/1714989
aataaacatatt

SEQ ID NO: 177577 - DNA, 12 bp, Unknown
  misc_feature (1)..( 12): Result.005 file - promoters50/1714989
gaattacaaaac

SEQ ID NO: 177578 - DNA, 12 bp, Unknown
  misc_feature (1)..( 12): Result.005 file - promoters50/1714989
ttttaacaaaaa

SEQ ID NO: 177579 - DNA, 12 bp, Unknown
  misc_feature (1)..( 12): Result.005 file - promoters50/1714989
ctcccaaaaata

SEQ ID NO: 177580 - DNA, 12 bp, Unknown
  misc_feature (1)..( 12): Result.005 file - promoters50/1714989
agtacacagagt

SEQ ID NO: 177581 - DNA, 11 bp, Unknown
  misc_feature (1)..( 11): Result.005 file - promoters50/1714989
aattattttgt

SEQ ID NO: 177582 - DNA, 11 bp, Unknown
  misc_feature (1)..( 11): Result.005 file - promoters50/1714989
ttttatttctt

SEQ ID NO: 177583 - DNA, 11 bp, Unknown
  misc_feature (1)..( 11): Result.005 file - promoters50/1714989
aattattttgc

SEQ ID NO: 177584 - DNA, 11 bp, Unknown
  misc_feature (1)..( 11): Result.005 file - promoters50/1714989
gtttgtttaac

SEQ ID NO: 177585 - DNA, 11 bp, Unknown
  misc_feature (1)..( 11): Result.005 file - promoters50/1714989
acttatatctt

SEQ ID NO: 177586 - DNA, 11 bp, Unknown
  misc_feature (1)..( 11): Result.005 file - promoters50/1714989
gtatatatcca

SEQ ID NO: 177587 - DNA, 20 bp, Unknown
  misc_feature (1)..( 20): Result.005 file - promoters50/1714989
tccaactaaagtatacttac

SEQ ID NO: 177588 - DNA, 20 bp, Unknown
  misc_feature (1)..( 20): Result.005 file - promoters50/1714989
tttctttaaactatgacagt

SEQ ID NO: 177589 - DNA, 20 bp, Unknown
  misc_feature (1)..( 20): Result.005 file - promoters50/1714989
gggttacaaaatatcaaaga

SEQ ID NO: 177590 - DNA, 20 bp, Unknown
  misc_feature (1)..( 20): Result.005 file - promoters50/1714989
tccaaataaaatatctttaa

SEQ ID NO: 177591 - DNA, 20 bp, Unknown
  misc_feature (1)..( 20): Result.005 file - promoters50/1714989
aacaaaaaaaataagaatgt

SEQ ID NO: 177592 - DNA, 20 bp, Unknown
  misc_feature (1)..( 20): Result.005 file - promoters50/1714989
cggtctaaagtcatccaaag

SEQ ID NO: 177593 - DNA, 20 bp, Unknown
  misc_feature (1)..( 20): Result.005 file - promoters50/1714989
cacttatatcttataaccaa

SEQ ID NO: 177594 - DNA, 15 bp, Unknown
  misc_feature (1)..( 15): Result.005 file - promoters50/1714989
ccacaaaacgacgac

SEQ ID NO: 177595 - DNA, 15 bp, Unknown
  misc_feature (1)..( 15): Result.005 file - promoters50/1714989
agacaaaaacaatat

SEQ ID NO: 177596 - DNA, 15 bp, Unknown
  misc_feature (1)..( 15): Result.005 file - promoters50/1714989
ttacaaaatatcaaa

SEQ ID NO: 177597 - DNA, 15 bp, Unknown
  misc_feature (1)..( 15): Result.005 file - promoters50/1714989
taacaaaaaaaataa

SEQ ID NO: 177598 - DNA, 15 bp, Unknown
  misc_feature (1)..( 15): Result.005 file - promoters50/1714989
aaagaaaataataat

SEQ ID NO: 177599 - DNA, 15 bp, Unknown
  misc_feature (1)..( 15): Result.005 file - promoters50/1714989
aattttaataaacca

SEQ ID NO: 177600 - DNA, 11 bp, Unknown
  misc_feature (1)..( 11): Result.005 file - promoters50/1714989
ttgagtttagg

SEQ ID NO: 177601 - DNA, 11 bp, Unknown
  misc_feature (1)..( 11): Result.005 file - promoters50/1714989
gatagtttaaa

SEQ ID NO: 177602 - DNA, 11 bp, Unknown
  misc_feature (1)..( 11): Result.005 file - promoters50/1714989
ttgatttttgt

SEQ ID NO: 177603 - DNA, 11 bp, Unknown
  misc_feature (1)..( 11): Result.005 file - promoters50/1714989
ttgattttaaa

SEQ ID NO: 177604 - DNA, 11 bp, Unknown
  misc_feature (1)..( 11): Result.005 file - promoters50/1714989
tttatttttgt

SEQ ID NO: 177605 - DNA, 11 bp, Unknown
  misc_feature (1)..( 11): Result.005 file - promoters50/1714989
acaattctaat

SEQ ID NO: 177606 - DNA, 11 bp, Unknown
  misc_feature (1)..( 11): Result.005 file - promoters50/1715054
atattgattta

SEQ ID NO: 177607 - DNA, 11 bp, Unknown
  misc_feature (1)..( 11): Result.005 file - promoters50/1715054
gagtagattta

SEQ ID NO: 177608 - DNA, 11 bp, Unknown
  misc_feature (1)..( 11): Result.005 file - promoters50/1715054
caaatgattta

SEQ ID NO: 177609 - DNA, 11 bp, Unknown
  misc_feature (1)..( 11): Result.005 file - promoters50/1715054
atattgatttg

SEQ ID NO: 177610 - DNA, 15 bp, Unknown
  misc_feature (1)..( 15): Result.005 file - promoters50/1715054
atattatattattta

SEQ ID NO: 177611 - DNA, 15 bp, Unknown
  misc_feature (1)..( 15): Result.005 file - promoters50/1715054
taattatgttatcag

SEQ ID NO: 177612 - DNA, 15 bp, Unknown
  misc_feature (1)..( 15): Result.005 file - promoters50/1715054
taattttgttaataa

SEQ ID NO: 177613 - DNA, 15 bp, Unknown
  misc_feature (1)..( 15): Result.005 file - promoters50/1715054
cttttttcttaataa

SEQ ID NO: 177614 - DNA, 7 bp, Unknown
  misc_feature (1)..( 7): Result.005 file - promoters50/1715054
agcattt

SEQ ID NO: 177615 - DNA, 7 bp, Unknown
  misc_feature (1)..( 7): Result.005 file - promoters50/1715054
agccttt

SEQ ID NO: 177616 - DNA, 7 bp, Unknown
  misc_feature (1)..( 7): Result.005 file - promoters50/1715054
agcattt

SEQ ID NO: 177617 - DNA, 10 bp, Unknown
  misc_feature (1)..( 10): Result.005 file - promoters50/1715054
ccagaattta

SEQ ID NO: 177618 - DNA, 10 bp, Unknown
  misc_feature (1)..( 10): Result.005 file - promoters50/1715054
aaagaagtta

SEQ ID NO: 177619 - DNA, 10 bp, Unknown
  misc_feature (1)..( 10): Result.005 file - promoters50/1715054
aaaaaagaac

SEQ ID NO: 177620 - DNA, 8 bp, Unknown
  misc_feature (1)..( 8): Result.005 file - promoters50/1715054
aataatta

SEQ ID NO: 177621 - DNA, 8 bp, Unknown
  misc_feature (1)..( 8): Result.005 file - promoters50/1715054
tttaatta

SEQ ID NO: 177622 - DNA, 8 bp, Unknown
  misc_feature (1)..( 8): Result.005 file - promoters50/1715054
ttttattg

SEQ ID NO: 177623 - DNA, 7 bp, Unknown
  misc_feature (1)..( 7): Result.005 file - promoters50/1715054
aatcttc

SEQ ID NO: 177624 - DNA, 7 bp, Unknown
  misc_feature (1)..( 7): Result.005 file - promoters50/1715054
aatgttc

SEQ ID NO: 177625 - DNA, 7 bp, Unknown
  misc_feature (1)..( 7): Result.005 file - promoters50/1715054
aatgtta

SEQ ID NO: 177626 - DNA, 7 bp, Unknown
  misc_feature (1)..( 7): Result.005 file - promoters50/1715146
ttccata

SEQ ID NO: 177627 - DNA, 7 bp, Unknown
  misc_feature (1)..( 7): Result.005 file - promoters50/1715146
ttctata

SEQ ID NO: 177628 - DNA, 7 bp, Unknown
  misc_feature (1)..( 7): Result.005 file - promoters50/1715146
ttccata

SEQ ID NO: 177629 - DNA, 9 bp, Unknown
  misc_feature (1)..( 9): Result.005 file - promoters50/1715146
tttaaattc

SEQ ID NO: 177630 - DNA, 9 bp, Unknown
  misc_feature (1)..( 9): Result.005 file - promoters50/1715146
tataaattc

SEQ ID NO: 177631 - DNA, 9 bp, Unknown
  misc_feature (1)..( 9): Result.005 file - promoters50/1715146
tataaatat

SEQ ID NO: 177632 - DNA, 7 bp, Unknown
  misc_feature (1)..( 7): Result.005 file - promoters50/1715146
atccaaa

SEQ ID NO: 177633 - DNA, 7 bp, Unknown
  misc_feature (1)..( 7): Result.005 file - promoters50/1715146
atccaat

SEQ ID NO: 177634 - DNA, 7 bp, Unknown
  misc_feature (1)..( 7): Result.005 file - promoters50/1715146
atcaaat

SEQ ID NO: 177635 - DNA, 8 bp, Unknown
  misc_feature (1)..( 8): Result.005 file - promoters50/1715146
gaatttct

SEQ ID NO: 177636 - DNA, 8 bp, Unknown
  misc_feature (1)..( 8): Result.005 file - promoters50/1715146
gaatttaa

SEQ ID NO: 177637 - DNA, 8 bp, Unknown
  misc_feature (1)..( 8): Result.005 file - promoters50/1715146
aaatttaa

SEQ ID NO: 177638 - DNA, 9 bp, Unknown
  misc_feature (1)..( 9): Result.005 file - promoters50/1715146
agaaaatca

SEQ ID NO: 177639 - DNA, 9 bp, Unknown
  misc_feature (1)..( 9): Result.005 file - promoters50/1715146
agataataa

SEQ ID NO: 177640 - DNA, 9 bp, Unknown
  misc_feature (1)..( 9): Result.005 file - promoters50/1715146
tgatagtaa

SEQ ID NO: 177641 - DNA, 10 bp, Unknown
  misc_feature (1)..( 10): Result.005 file - promoters50/1715146
aaactatctc

SEQ ID NO: 177642 - DNA, 10 bp, Unknown
  misc_feature (1)..( 10): Result.005 file - promoters50/1715146
aaattattaa

SEQ ID NO: 177643 - DNA, 10 bp, Unknown
  misc_feature (1)..( 10): Result.005 file - promoters50/1715146
agattagtaa

SEQ ID NO: 177644 - DNA, 7 bp, Unknown
  misc_feature (1)..( 7): Result.005 file - promoters50/1715146
aagaaaa

SEQ ID NO: 177645 - DNA, 7 bp, Unknown
  misc_feature (1)..( 7): Result.005 file - promoters50/1715146
aagaaat

SEQ ID NO: 177646 - DNA, 8 bp, Unknown
  misc_feature (1)..( 8): Result.005 file - promoters50/1715146
aagtaaat

SEQ ID NO: 177647 - DNA, 8 bp, Unknown
  misc_feature (1)..( 8): Result.005 file - promoters50/1715146
aatttaag

SEQ ID NO: 177648 - DNA, 8 bp, Unknown
  misc_feature (1)..( 8): Result.005 file - promoters50/1715146
cctttaag

SEQ ID NO: 177649 - DNA, 8 bp, Unknown
  misc_feature (1)..( 8): Result.005 file - promoters50/1715146
aatttaat

SEQ ID NO: 177650 - DNA, 7 bp, Unknown
  misc_feature (1)..( 7): Result.005 file - promoters50/1715204
aaaagtc

SEQ ID NO: 177651 - DNA, 7 bp, Unknown
  misc_feature (1)..( 7): Result.005 file - promoters50/1715204
aaaagtt

SEQ ID NO: 177652 - DNA, 7 bp, Unknown
  misc_feature (1)..( 7): Result.005 file - promoters50/1715204
aaaattg

SEQ ID NO: 177653 - DNA, 9 bp, Unknown
  misc_feature (1)..( 9): Result.005 file - promoters50/1715204
aagtgttta

SEQ ID NO: 177654 - DNA, 9 bp, Unknown
  misc_feature (1)..( 9): Result.005 file - promoters50/1715204
aagtgttgg

SEQ ID NO: 177655 - DNA, 10 bp, Unknown
  misc_feature (1)..( 10): Result.005 file - promoters50/1715204
ctgtgcttat

SEQ ID NO: 177656 - DNA, 10 bp, Unknown
  misc_feature (1)..( 10): Result.005 file - promoters50/1715204
attcaacata

SEQ ID NO: 177657 - DNA, 10 bp, Unknown
  misc_feature (1)..( 10): Result.005 file - promoters50/1715204
attcaagatt

SEQ ID NO: 177658 - DNA, 10 bp, Unknown
  misc_feature (1)..( 10): Result.005 file - promoters50/1715204
gttcatgatt

SEQ ID NO: 177659 - DNA, 10 bp, Unknown
  misc_feature (1)..( 10): Result.005 file - promoters50/1715220
ctgtcattaa

SEQ ID NO: 177660 - DNA, 10 bp, Unknown
  misc_feature (1)..( 10): Result.005 file - promoters50/1715220
ctgtcaaagg

SEQ ID NO: 177661 - DNA, 10 bp, Unknown
  misc_feature (1)..( 10): Result.005 file - promoters50/1715220
ttgtctaagt

SEQ ID NO: 177662 - DNA, 10 bp, Unknown
  misc_feature (1)..( 10): Result.005 file - promoters50/1715220
ttgactaatc

SEQ ID NO: 177663 - DNA, 10 bp, Unknown
  misc_feature (1)..( 10): Result.005 file - promoters50/1715220
aagactagac

SEQ ID NO: 177664 - DNA, 11 bp, Unknown
  misc_feature (1)..( 11): Result.005 file - promoters50/1715220
ccaaacatgga

SEQ ID NO: 177665 - DNA, 11 bp, Unknown
  misc_feature (1)..( 11): Result.005 file - promoters50/1715220
agaaaaatgtg

SEQ ID NO: 177666 - DNA, 11 bp, Unknown
  misc_feature (1)..( 11): Result.005 file - promoters50/1715220
ccaaacagaaa

SEQ ID NO: 177667 - DNA, 11 bp, Unknown
  misc_feature (1)..( 11): Result.005 file - promoters50/1715220
caaaaggaaaa

SEQ ID NO: 177668 - DNA, 11 bp, Unknown
  misc_feature (1)..( 11): Result.005 file - promoters50/1715220
ccaaatttgta

SEQ ID NO: 177669 - DNA, 12 bp, Unknown
  misc_feature (1)..( 12): Result.005 file - promoters50/1715220
tttcactttaga

SEQ ID NO: 177670 - DNA, 12 bp, Unknown
  misc_feature (1)..( 12): Result.005 file - promoters50/1715220
aggttcttaaga

SEQ ID NO: 177671 - DNA, 12 bp, Unknown
  misc_feature (1)..( 12): Result.005 file - promoters50/1715220
tttcaatttaat

SEQ ID NO: 177672 - DNA, 12 bp, Unknown
  misc_feature (1)..( 12): Result.005 file - promoters50/1715220
gaccaattttag

SEQ ID NO: 177673 - DNA, 12 bp, Unknown
  misc_feature (1)..( 12): Result.005 file - promoters50/1715220
caacaattttga

SEQ ID NO: 177674 - DNA, 8 bp, Unknown
  misc_feature (1)..( 8): Result.005 file - promoters50/1715224
ttataaaa

SEQ ID NO: 177675 - DNA, 8 bp, Unknown
  misc_feature (1)..( 8): Result.005 file - promoters50/1715224
ttattaaa

SEQ ID NO: 177676 - DNA, 8 bp, Unknown
  misc_feature (1)..( 8): Result.005 file - promoters50/1715224
ctatgaaa

SEQ ID NO: 177677 - DNA, 10 bp, Unknown
  misc_feature (1)..( 10): Result.005 file - promoters50/1715224
ttttattaaa

SEQ ID NO: 177678 - DNA, 10 bp, Unknown
  misc_feature (1)..( 10): Result.005 file - promoters50/1715224
aattactaaa

SEQ ID NO: 177679 - DNA, 10 bp, Unknown
  misc_feature (1)..( 10): Result.005 file - promoters50/1715224
aattactata

SEQ ID NO: 177680 - DNA, 8 bp, Unknown
  misc_feature (1)..( 8): Result.005 file - promoters50/1715224
ggtgaaaa

SEQ ID NO: 177681 - DNA, 8 bp, Unknown
  misc_feature (1)..( 8): Result.005 file - promoters50/1715224
tatgaaaa

SEQ ID NO: 177682 - DNA, 8 bp, Unknown
  misc_feature (1)..( 8): Result.005 file - promoters50/1715224
tattaaag

SEQ ID NO: 177683 - DNA, 8 bp, Unknown
  misc_feature (1)..( 8): Result.005 file - promoters50/1715329
atctaaag

SEQ ID NO: 177684 - DNA, 8 bp, Unknown
  misc_feature (1)..( 8): Result.005 file - promoters50/1715329
ttctaaaa

SEQ ID NO: 177685 - DNA, 8 bp, Unknown
  misc_feature (1)..( 8): Result.005 file - promoters50/1715329
ttcaaaaa

SEQ ID NO: 177686 - DNA, 9 bp, Unknown
  misc_feature (1)..( 9): Result.005 file - promoters50/1715329
ccttcttct

SEQ ID NO: 177687 - DNA, 9 bp, Unknown
  misc_feature (1)..( 9): Result.005 file - promoters50/1715329
tctttttct

SEQ ID NO: 177688 - DNA, 9 bp, Unknown
  misc_feature (1)..( 9): Result.005 file - promoters50/1715329
ccttctcga

SEQ ID NO: 177689 - DNA, 10 bp, Unknown
  misc_feature (1)..( 10): Result.005 file - promoters50/1715329
agattttagc

SEQ ID NO: 177690 - DNA, 10 bp, Unknown
  misc_feature (1)..( 10): Result.005 file - promoters50/1715329
atattttatt

SEQ ID NO: 177691 - DNA, 10 bp, Unknown
  misc_feature (1)..( 10): Result.005 file - promoters50/1715329
atattttgcc

SEQ ID NO: 177692 - DNA, 10 bp, Unknown
  misc_feature (1)..( 10): Result.005 file - promoters50/1715329
gaatttcatt

SEQ ID NO: 177693 - DNA, 7 bp, Unknown
  misc_feature (1)..( 7): Result.005 file - promoters50/1715329
ttttatt

SEQ ID NO: 177694 - DNA, 7 bp, Unknown
  misc_feature (1)..( 7): Result.005 file - promoters50/1715329
ttttatt

SEQ ID NO: 177695 - DNA, 7 bp, Unknown
  misc_feature (1)..( 7): Result.005 file - promoters50/1715329
ttttatt

SEQ ID NO: 177696 - DNA, 10 bp, Unknown
  misc_feature (1)..( 10): Result.005 file - promoters50/1715329
ttaggtcaat

SEQ ID NO: 177697 - DNA, 10 bp, Unknown
  misc_feature (1)..( 10): Result.005 file - promoters50/1715329
ttagatcatt

SEQ ID NO: 177698 - DNA, 10 bp, Unknown
  misc_feature (1)..( 10): Result.005 file - promoters50/1715329
gcagatcatt

SEQ ID NO: 177699 - DNA, 11 bp, Unknown
  misc_feature (1)..( 11): Result.005 file - promoters50/1715347
tttttaataac

SEQ ID NO: 177700 - DNA, 11 bp, Unknown
  misc_feature (1)..( 11): Result.005 file - promoters50/1715347
gtgttaatagc

SEQ ID NO: 177701 - DNA, 11 bp, Unknown
  misc_feature (1)..( 11): Result.005 file - promoters50/1715347
ttgtaaatgta

SEQ ID NO: 177702 - DNA, 11 bp, Unknown
  misc_feature (1)..( 11): Result.005 file - promoters50/1715347
tcttaaatgct

SEQ ID NO: 177703 - DNA, 11 bp, Unknown
  misc_feature (1)..( 11): Result.005 file - promoters50/1715347
tcttaaataac

SEQ ID NO: 177704 - DNA, 11 bp, Unknown
  misc_feature (1)..( 11): Result.005 file - promoters50/1715347
attttaattaa

SEQ ID NO: 177705 - DNA, 17 bp, Unknown
  misc_feature (1)..( 17): Result.005 file - promoters50/1715347
tatcccaaaaattattt

SEQ ID NO: 177706 - DNA, 17 bp, Unknown
  misc_feature (1)..( 17): Result.005 file - promoters50/1715347
ttgattcaaaattctct

SEQ ID NO: 177707 - DNA, 17 bp, Unknown
  misc_feature (1)..( 17): Result.005 file - promoters50/1715347
ttgaatcaatattttat

SEQ ID NO: 177708 - DNA, 17 bp, Unknown
  misc_feature (1)..( 17): Result.005 file - promoters50/1715347
aggatcttaaatgcttt

SEQ ID NO: 177709 - DNA, 17 bp, Unknown
  misc_feature (1)..( 17): Result.005 file - promoters50/1715347
gcttgctctaattgctt

SEQ ID NO: 177710 - DNA, 17 bp, Unknown
  misc_feature (1)..( 17): Result.005 file - promoters50/1715347
attaaaacaaactctta

SEQ ID NO: 177711 - DNA, 11 bp, Unknown
  misc_feature (1)..( 11): Result.005 file - promoters50/1715400
aggttctcaga

SEQ ID NO: 177712 - DNA, 11 bp, Unknown
  misc_feature (1)..( 11): Result.005 file - promoters50/1715400
agggtctgaga

SEQ ID NO: 177713 - DNA, 11 bp, Unknown
  misc_feature (1)..( 11): Result.005 file - promoters50/1715400
tttttctcaaa

SEQ ID NO: 177714 - DNA, 8 bp, Unknown
  misc_feature (1)..( 8): Result.005 file - promoters50/1715478
ttaaaatc

SEQ ID NO: 177715 - DNA, 8 bp, Unknown
  misc_feature (1)..( 8): Result.005 file - promoters50/1715478
tcaaaatc

SEQ ID NO: 177716 - DNA, 8 bp, Unknown
  misc_feature (1)..( 8): Result.005 file - promoters50/1715478
ttataatg

SEQ ID NO: 177717 - DNA, 7 bp, Unknown
  misc_feature (1)..( 7): Result.005 file - promoters50/1715490
agatact

SEQ ID NO: 177718 - DNA, 7 bp, Unknown
  misc_feature (1)..( 7): Result.005 file - promoters50/1715490
agaaact

SEQ ID NO: 177719 - DNA, 7 bp, Unknown
  misc_feature (1)..( 7): Result.005 file - promoters50/1715490
agaaacc

SEQ ID NO: 177720 - DNA, 9 bp, Unknown
  misc_feature (1)..( 9): Result.005 file - promoters50/1715516
ttatttcca

SEQ ID NO: 177721 - DNA, 9 bp, Unknown
  misc_feature (1)..( 9): Result.005 file - promoters50/1715516
gaattacca

SEQ ID NO: 177722 - DNA, 9 bp, Unknown
  misc_feature (1)..( 9): Result.005 file - promoters50/1715516
ttatatcca

SEQ ID NO: 177723 - DNA, 9 bp, Unknown
  misc_feature (1)..( 9): Result.005 file - promoters50/1715516
atatgataa

SEQ ID NO: 177724 - DNA, 13 bp, Unknown
  misc_feature (1)..( 13): Result.005 file - promoters50/1715516
ctcctataaattg

SEQ ID NO: 177725 - DNA, 13 bp, Unknown
  misc_feature (1)..( 13): Result.005 file - promoters50/1715516
ctcttatatattc

SEQ ID NO: 177726 - DNA, 13 bp, Unknown
  misc_feature (1)..( 13): Result.005 file - promoters50/1715516
ttcctatatatca

SEQ ID NO: 177727 - DNA, 13 bp, Unknown
  misc_feature (1)..( 13): Result.005 file - promoters50/1715516
ggtgtataaattg

SEQ ID NO: 177728 - DNA, 10 bp, Unknown
  misc_feature (1)..( 10): Result.005 file - promoters50/1715516
ttaatttaca

SEQ ID NO: 177729 - DNA, 10 bp, Unknown
  misc_feature (1)..( 10): Result.005 file - promoters50/1715516
aaaattgaca

SEQ ID NO: 177730 - DNA, 10 bp, Unknown
  misc_feature (1)..( 10): Result.005 file - promoters50/1715516
taaatttgct

SEQ ID NO: 177731 - DNA, 10 bp, Unknown
  misc_feature (1)..( 10): Result.005 file - promoters50/1715516
taactttttc

SEQ ID NO: 177732 - DNA, 12 bp, Unknown
  misc_feature (1)..( 12): Result.005 file - promoters50/1715516
tgcaatttaata

SEQ ID NO: 177733 - DNA, 12 bp, Unknown
  misc_feature (1)..( 12): Result.005 file - promoters50/1715516
aaaaatataaga

SEQ ID NO: 177734 - DNA, 12 bp, Unknown
  misc_feature (1)..( 12): Result.005 file - promoters50/1715516
aactatttaaaa

SEQ ID NO: 177735 - DNA, 12 bp, Unknown
  misc_feature (1)..( 12): Result.005 file - promoters50/1715516
aagattttcata

SEQ ID NO: 177736 - DNA, 12 bp, Unknown
  misc_feature (1)..( 12): Result.005 file - promoters50/1715516
aaaaaaataaat

SEQ ID NO: 177737 - DNA, 8 bp, Unknown
  misc_feature (1)..( 8): Result.005 file - promoters50/1715516
aacttttt

SEQ ID NO: 177738 - DNA, 8 bp, Unknown
  misc_feature (1)..( 8): Result.005 file - promoters50/1715516
gactcttt

SEQ ID NO: 177739 - DNA, 8 bp, Unknown
  misc_feature (1)..( 8): Result.005 file - promoters50/1715516
aactattt

SEQ ID NO: 177740 - DNA, 8 bp, Unknown
  misc_feature (1)..( 8): Result.005 file - promoters50/1715516
ttctattt

SEQ ID NO: 177741 - DNA, 12 bp, Unknown
  misc_feature (1)..( 12): Result.005 file - promoters50/1715516
cgatagtttaac

SEQ ID NO: 177742 - DNA, 12 bp, Unknown
  misc_feature (1)..( 12): Result.005 file - promoters50/1715516
caatattttaac

SEQ ID NO: 177743 - DNA, 12 bp, Unknown
  misc_feature (1)..( 12): Result.005 file - promoters50/1715516
caaaattgacaa

SEQ ID NO: 177744 - DNA, 12 bp, Unknown
  misc_feature (1)..( 12): Result.005 file - promoters50/1715516
ataaatttgctc

SEQ ID NO: 177745 - DNA, 11 bp, Unknown
  misc_feature (1)..( 11): Result.005 file - promoters50/1715535
tggattttctt

SEQ ID NO: 177746 - DNA, 11 bp, Unknown
  misc_feature (1)..( 11): Result.005 file - promoters50/1715535
caaattttcac

SEQ ID NO: 177747 - DNA, 11 bp, Unknown
  misc_feature (1)..( 11): Result.005 file - promoters50/1715535
cagattttcag

SEQ ID NO: 177748 - DNA, 11 bp, Unknown
  misc_feature (1)..( 11): Result.005 file - promoters50/1715535
caaaatttcac

SEQ ID NO: 177749 - DNA, 11 bp, Unknown
  misc_feature (1)..( 11): Result.005 file - promoters50/1715535
gaaaattatta

SEQ ID NO: 177750 - DNA, 11 bp, Unknown
  misc_feature (1)..( 11): Result.005 file - promoters50/1715535
tgaaatttccg

SEQ ID NO: 177751 - DNA, 11 bp, Unknown
  misc_feature (1)..( 11): Result.005 file - promoters50/1715535
cgtcatttcaa

SEQ ID NO: 177752 - DNA, 11 bp, Unknown
  misc_feature (1)..( 11): Result.005 file - promoters50/1715535
caaaatttcac

SEQ ID NO: 177753 - DNA, 11 bp, Unknown
  misc_feature (1)..( 11): Result.005 file - promoters50/1715535
caaattttcac

SEQ ID NO: 177754 - DNA, 12 bp, Unknown
  misc_feature (1)..( 12): Result.005 file - promoters50/1715535
aaaaatattcgg

SEQ ID NO: 177755 - DNA, 12 bp, Unknown
  misc_feature (1)..( 12): Result.005 file - promoters50/1715535
tgaaatttccgg

SEQ ID NO: 177756 - DNA, 12 bp, Unknown
  misc_feature (1)..( 12): Result.005 file - promoters50/1715535
taaactatttat

SEQ ID NO: 177757 - DNA, 12 bp, Unknown
  misc_feature (1)..( 12): Result.005 file - promoters50/1715535
ttttgattttgc

SEQ ID NO: 177758 - DNA, 12 bp, Unknown
  misc_feature (1)..( 12): Result.005 file - promoters50/1715535
atatgatttatt

SEQ ID NO: 177759 - DNA, 12 bp, Unknown
  misc_feature (1)..( 12): Result.005 file - promoters50/1715535
atgtgattttgt

SEQ ID NO: 177760 - DNA, 12 bp, Unknown
  misc_feature (1)..( 12): Result.005 file - promoters50/1715535
atataatttaaa

SEQ ID NO: 177761 - DNA, 12 bp, Unknown
  misc_feature (1)..( 12): Result.005 file - promoters50/1715535
ttacaatttaca

SEQ ID NO: 177762 - DNA, 12 bp, Unknown
  misc_feature (1)..( 12): Result.005 file - promoters50/1715535
gtttgatatatt

SEQ ID NO: 177763 - DNA, 12 bp, Unknown
  misc_feature (1)..( 12): Result.005 file - promoters50/1715595
aaatcaaacata

SEQ ID NO: 177764 - DNA, 12 bp, Unknown
  misc_feature (1)..( 12): Result.005 file - promoters50/1715595
gagacaaacaaa

SEQ ID NO: 177765 - DNA, 12 bp, Unknown
  misc_feature (1)..( 12): Result.005 file - promoters50/1715595
taattaaacttt

SEQ ID NO: 177766 - DNA, 12 bp, Unknown
  misc_feature (1)..( 12): Result.005 file - promoters50/1715595
aggaaaaatata

SEQ ID NO: 177767 - DNA, 12 bp, Unknown
  misc_feature (1)..( 12): Result.005 file - promoters50/1715595
taattaagcata

SEQ ID NO: 177768 - DNA, 12 bp, Unknown
  misc_feature (1)..( 12): Result.005 file - promoters50/1715595
agattcagcctt

SEQ ID NO: 177769 - DNA, 8 bp, Unknown
  misc_feature (1)..( 8): Result.005 file - promoters50/1715615
taaagaca

SEQ ID NO: 177770 - DNA, 8 bp, Unknown
  misc_feature (1)..( 8): Result.005 file - promoters50/1715615
taaagata

SEQ ID NO: 177771 - DNA, 8 bp, Unknown
  misc_feature (1)..( 8): Result.005 file - promoters50/1715615
gaaaaaca

SEQ ID NO: 177772 - DNA, 8 bp, Unknown
  misc_feature (1)..( 8): Result.005 file - promoters50/1715615
caaaaata

SEQ ID NO: 177773 - DNA, 11 bp, Unknown
  misc_feature (1)..( 11): Result.005 file - promoters50/1715810
acaattaaatt

SEQ ID NO: 177774 - DNA, 11 bp, Unknown
  misc_feature (1)..( 11): Result.005 file - promoters50/1715810
gaaatgaaata

SEQ ID NO: 177775 - DNA, 12 bp, Unknown
  misc_feature (1)..( 12): Result.005 file - promoters50/1715810
ttaatttaaaga

SEQ ID NO: 177776 - DNA, 12 bp, Unknown
  misc_feature (1)..( 12): Result.005 file - promoters50/1715810
ggaaaagaaaat

SEQ ID NO: 177777 - DNA, 12 bp, Unknown
  misc_feature (1)..( 12): Result.005 file - promoters50/1715810
ggattttcaatt

SEQ ID NO: 177778 - DNA, 9 bp, Unknown
  misc_feature (1)..( 9): Result.005 file - promoters50/1715994
aataaacaa

SEQ ID NO: 177779 - DNA, 9 bp, Unknown
  misc_feature (1)..( 9): Result.005 file - promoters50/1715994
tatatacac

SEQ ID NO: 177780 - DNA, 9 bp, Unknown
  misc_feature (1)..( 9): Result.005 file - promoters50/1715994
tgtaaacac

SEQ ID NO: 177781 - DNA, 9 bp, Unknown
  misc_feature (1)..( 9): Result.005 file - promoters50/1715994
aataaacaa

SEQ ID NO: 177782 - DNA, 9 bp, Unknown
  misc_feature (1)..( 9): Result.005 file - promoters50/1715994
acaaaacaa

SEQ ID NO: 177783 - DNA, 9 bp, Unknown
  misc_feature (1)..( 9): Result.005 file - promoters50/1715994
gagaaaaaa

SEQ ID NO: 177784 - DNA, 11 bp, Unknown
  misc_feature (1)..( 11): Result.005 file - promoters50/1716037
atatttttatt

SEQ ID NO: 177785 - DNA, 11 bp, Unknown
  misc_feature (1)..( 11): Result.005 file - promoters50/1716037
atattttattt

SEQ ID NO: 177786 - DNA, 11 bp, Unknown
  misc_feature (1)..( 11): Result.005 file - promoters50/1716037
atatattagcc

SEQ ID NO: 177787 - DNA, 11 bp, Unknown
  misc_feature (1)..( 11): Result.005 file - promoters50/1716037
ataaattgtta

SEQ ID NO: 177788 - DNA, 11 bp, Unknown
  misc_feature (1)..( 11): Result.005 file - promoters50/1716037
atgtttctttg

SEQ ID NO: 177789 - DNA, 11 bp, Unknown
  misc_feature (1)..( 11): Result.005 file - promoters50/1716037
ttaaaaaaata

SEQ ID NO: 177790 - DNA, 15 bp, Unknown
  misc_feature (1)..( 15): Result.005 file - promoters50/1716037
tatatttttattctt

SEQ ID NO: 177791 - DNA, 15 bp, Unknown
  misc_feature (1)..( 15): Result.005 file - promoters50/1716037
tcatattttatttgt

SEQ ID NO: 177792 - DNA, 16 bp, Unknown
  misc_feature (1)..( 16): Result.005 file - promoters50/1716037
ataaattgttactttt

SEQ ID NO: 177793 - DNA, 16 bp, Unknown
  misc_feature (1)..( 16): Result.005 file - promoters50/1716037
aggaatgtttctttgc

SEQ ID NO: 177794 - DNA, 16 bp, Unknown
  misc_feature (1)..( 16): Result.005 file - promoters50/1716037
tgggcgttttcttaat

SEQ ID NO: 177795 - DNA, 16 bp, Unknown
  misc_feature (1)..( 16): Result.005 file - promoters50/1716037
gccattctttaaaaaa

SEQ ID NO: 177796 - DNA, 15 bp, Unknown
  misc_feature (1)..( 15): Result.005 file - promoters50/1716037
tattcttttgttttt

SEQ ID NO: 177797 - DNA, 15 bp, Unknown
  misc_feature (1)..( 15): Result.005 file - promoters50/1716037
attttatttgtttct

SEQ ID NO: 177798 - DNA, 15 bp, Unknown
  misc_feature (1)..( 15): Result.005 file - promoters50/1716037
ggaatgtttctttgc

SEQ ID NO: 177799 - DNA, 15 bp, Unknown
  misc_feature (1)..( 15): Result.005 file - promoters50/1716037
ttttaattttttttt

SEQ ID NO: 177800 - DNA, 15 bp, Unknown
  misc_feature (1)..( 15): Result.005 file - promoters50/1716037
gggcgttttcttaat

SEQ ID NO: 177801 - DNA, 15 bp, Unknown
  misc_feature (1)..( 15): Result.005 file - promoters50/1716037
aaaatatttaaataa

SEQ ID NO: 177802 - DNA, 15 bp, Unknown
  misc_feature (1)..( 15): Result.005 file - promoters50/1716037
aaaaaattgaaactt

SEQ ID NO: 177803 - DNA, 9 bp, Unknown
  misc_feature (1)..( 9): Result.005 file - promoters50/1716037
tttttgaat

SEQ ID NO: 177804 - DNA, 9 bp, Unknown
  misc_feature (1)..( 9): Result.005 file - promoters50/1716037
tttctgatc

SEQ ID NO: 177805 - DNA, 9 bp, Unknown
  misc_feature (1)..( 9): Result.005 file - promoters50/1716037
gtttagaat

SEQ ID NO: 177806 - DNA, 9 bp, Unknown
  misc_feature (1)..( 9): Result.005 file - promoters50/1716037
ttttttttt

SEQ ID NO: 177807 - DNA, 9 bp, Unknown
  misc_feature (1)..( 9): Result.005 file - promoters50/1716037
tcttagaaa

SEQ ID NO: 177808 - DNA, 9 bp, Unknown
  misc_feature (1)..( 9): Result.005 file - promoters50/1716037
attctgaat

SEQ ID NO: 177809 - DNA, 17 bp, Unknown
  misc_feature (1)..( 17): Result.005 file - promoters50/1716037
atttttattcttttgtt

SEQ ID NO: 177810 - DNA, 17 bp, Unknown
  misc_feature (1)..( 17): Result.005 file - promoters50/1716037
ggaatgtttctttgctc

SEQ ID NO: 177811 - DNA, 17 bp, Unknown
  misc_feature (1)..( 17): Result.005 file - promoters50/1716037
attttaattttttttta

SEQ ID NO: 177812 - DNA, 17 bp, Unknown
  misc_feature (1)..( 17): Result.005 file - promoters50/1716037
ttcatattttatttgtt

SEQ ID NO: 177813 - DNA, 17 bp, Unknown
  misc_feature (1)..( 17): Result.005 file - promoters50/1716037
tgggcgttttcttaatt

SEQ ID NO: 177814 - DNA, 17 bp, Unknown
  misc_feature (1)..( 17): Result.005 file - promoters50/1716037
aataaaatatttaaata

SEQ ID NO: 177815 - DNA, 17 bp, Unknown
  misc_feature (1)..( 17): Result.005 file - promoters50/1716037
gaacaaaaaaattgaaa

SEQ ID NO: 177816 - DNA, 16 bp, Unknown
  misc_feature (1)..( 16): Result.005 file - promoters50/1716037
atttatcaatcacata

SEQ ID NO: 177817 - DNA, 16 bp, Unknown
  misc_feature (1)..( 16): Result.005 file - promoters50/1716037
atttattaattatttt

SEQ ID NO: 177818 - DNA, 16 bp, Unknown
  misc_feature (1)..( 16): Result.005 file - promoters50/1716037
gcgtatcaaccaatgt

SEQ ID NO: 177819 - DNA, 16 bp, Unknown
  misc_feature (1)..( 16): Result.005 file - promoters50/1716037
taattttaattttttt

SEQ ID NO: 177820 - DNA, 16 bp, Unknown
  misc_feature (1)..( 16): Result.005 file - promoters50/1716037
aaaataaaatatttaa

SEQ ID NO: 177821 - DNA, 16 bp, Unknown
  misc_feature (1)..( 16): Result.005 file - promoters50/1716037
acaaaaaaattgaaac

SEQ ID NO: 177822 - DNA, 10 bp, Unknown
  misc_feature (1)..( 10): Result.005 file - promoters50/1716037
aaaaatgttc

SEQ ID NO: 177823 - DNA, 10 bp, Unknown
  misc_feature (1)..( 10): Result.005 file - promoters50/1716037
caaaattttc

SEQ ID NO: 177824 - DNA, 10 bp, Unknown
  misc_feature (1)..( 10): Result.005 file - promoters50/1716037
caaaagtttt

SEQ ID NO: 177825 - DNA, 10 bp, Unknown
  misc_feature (1)..( 10): Result.005 file - promoters50/1716037
aaaaatcaat

SEQ ID NO: 177826 - DNA, 10 bp, Unknown
  misc_feature (1)..( 10): Result.005 file - promoters50/1716037
tcatattttc

SEQ ID NO: 177827 - DNA, 10 bp, Unknown
  misc_feature (1)..( 10): Result.005 file - promoters50/1716037
gaaactttag

SEQ ID NO: 177828 - DNA, 12 bp, Unknown
  misc_feature (1)..( 12): Result.005 file - promoters50/1716040
agacattgttgg

SEQ ID NO: 177829 - DNA, 12 bp, Unknown
  misc_feature (1)..( 12): Result.005 file - promoters50/1716040
atttattgtttg

SEQ ID NO: 177830 - DNA, 12 bp, Unknown
  misc_feature (1)..( 12): Result.005 file - promoters50/1716040
gtttaatgttat

SEQ ID NO: 177831 - DNA, 12 bp, Unknown
  misc_feature (1)..( 12): Result.005 file - promoters50/1716040
accaaatcttaa

SEQ ID NO: 177832 - DNA, 12 bp, Unknown
  misc_feature (1)..( 12): Result.005 file - promoters50/1716040
accaaatattat

SEQ ID NO: 177833 - DNA, 12 bp, Unknown
  misc_feature (1)..( 12): Result.005 file - promoters50/1716040
gttaaatgtata

SEQ ID NO: 177834 - DNA, 11 bp, Unknown
  misc_feature (1)..( 11): Result.005 file - promoters50/1806991
ttaacaaaaaa

SEQ ID NO: 177835 - DNA, 11 bp, Unknown
  misc_feature (1)..( 11): Result.005 file - promoters50/1806991
ggaactaaaaa

SEQ ID NO: 177836 - DNA, 11 bp, Unknown
  misc_feature (1)..( 11): Result.005 file - promoters50/1806991
ttaccaaaaat

SEQ ID NO: 177837 - DNA, 9 bp, Unknown
  misc_feature (1)..( 9): Result.005 file - promoters50/1806991
catatgttt

SEQ ID NO: 177838 - DNA, 9 bp, Unknown
  misc_feature (1)..( 9): Result.005 file - promoters50/1806991
catttgtat

SEQ ID NO: 177839 - DNA, 9 bp, Unknown
  misc_feature (1)..( 9): Result.005 file - promoters50/1806991
aatttctat

SEQ ID NO: 177840 - DNA, 12 bp, Unknown
  misc_feature (1)..( 12): Result.005 file - promoters50/1806998
ataacaaagttt

SEQ ID NO: 177841 - DNA, 12 bp, Unknown
  misc_feature (1)..( 12): Result.005 file - promoters50/1806998
aacacaaagtca

SEQ ID NO: 177842 - DNA, 12 bp, Unknown
  misc_feature (1)..( 12): Result.005 file - promoters50/1806998
aaatgaaaattt

SEQ ID NO: 177843 - DNA, 12 bp, Unknown
  misc_feature (1)..( 12): Result.005 file - promoters50/1806998
aaaacaaaaatt

SEQ ID NO: 177844 - DNA, 12 bp, Unknown
  misc_feature (1)..( 12): Result.005 file - promoters50/1806998
aactcaaaaagt

SEQ ID NO: 177845 - DNA, 12 bp, Unknown
  misc_feature (1)..( 12): Result.005 file - promoters50/1806998
agaacattggaa

SEQ ID NO: 177846 - DNA, 10 bp, Unknown
  misc_feature (1)..( 10): Result.005 file - promoters50/1807014
aatattttcc

SEQ ID NO: 177847 - DNA, 10 bp, Unknown
  misc_feature (1)..( 10): Result.005 file - promoters50/1807014
ttctttttcc

SEQ ID NO: 177848 - DNA, 10 bp, Unknown
  misc_feature (1)..( 10): Result.005 file - promoters50/1807014
aattttttct

SEQ ID NO: 177849 - DNA, 10 bp, Unknown
  misc_feature (1)..( 10): Result.005 file - promoters50/1807014
ctaaaataaa

SEQ ID NO: 177850 - DNA, 10 bp, Unknown
  misc_feature (1)..( 10): Result.005 file - promoters50/1807014
ttaaaagaaa

SEQ ID NO: 177851 - DNA, 10 bp, Unknown
  misc_feature (1)..( 10): Result.005 file - promoters50/1807014
ttaaaagaat

SEQ ID NO: 177852 - DNA, 13 bp, Unknown
  misc_feature (1)..( 13): Result.005 file - promoters50/1807067
gataaaacaagtt

SEQ ID NO: 177853 - DNA, 13 bp, Unknown
  misc_feature (1)..( 13): Result.005 file - promoters50/1807067
attaaaacacaca

SEQ ID NO: 177854 - DNA, 13 bp, Unknown
  misc_feature (1)..( 13): Result.005 file - promoters50/1807067
tttaaaacatgtt

SEQ ID NO: 177855 - DNA, 13 bp, Unknown
  misc_feature (1)..( 13): Result.005 file - promoters50/1807067
ttcaaaacacggc

SEQ ID NO: 177856 - DNA, 13 bp, Unknown
  misc_feature (1)..( 13): Result.005 file - promoters50/1807067
tttacaactgagc

SEQ ID NO: 177857 - DNA, 13 bp, Unknown
  misc_feature (1)..( 13): Result.005 file - promoters50/1807067
ttcataactataa

SEQ ID NO: 177858 - DNA, 15 bp, Unknown
  misc_feature (1)..( 15): Result.005 file - promoters50/1807067
gtgtaatatttattg

SEQ ID NO: 177859 - DNA, 15 bp, Unknown
  misc_feature (1)..( 15): Result.005 file - promoters50/1807067
atgtattatgtgagc

SEQ ID NO: 177860 - DNA, 15 bp, Unknown
  misc_feature (1)..( 15): Result.005 file - promoters50/1807067
atgtattattgtgta

SEQ ID NO: 177861 - DNA, 15 bp, Unknown
  misc_feature (1)..( 15): Result.005 file - promoters50/1807067
atgaattagcttgct

SEQ ID NO: 177862 - DNA, 15 bp, Unknown
  misc_feature (1)..( 15): Result.005 file - promoters50/1807067
tcgtatcatttgtat

SEQ ID NO: 177863 - DNA, 15 bp, Unknown
  misc_feature (1)..( 15): Result.005 file - promoters50/1807067
attcatcctttttat

SEQ ID NO: 177864 - DNA, 19 bp, Unknown
  misc_feature (1)..( 19): Result.005 file - promoters50/1807067
acaactaattttattataa

SEQ ID NO: 177865 - DNA, 19 bp, Unknown
  misc_feature (1)..( 19): Result.005 file - promoters50/1807067
tcaacttatttgcttcata

SEQ ID NO: 177866 - DNA, 19 bp, Unknown
  misc_feature (1)..( 19): Result.005 file - promoters50/1807067
ataacttattgtataataa

SEQ ID NO: 177867 - DNA, 19 bp, Unknown
  misc_feature (1)..( 19): Result.005 file - promoters50/1807067
gcaacaaatcaaagggaaa

SEQ ID NO: 177868 - DNA, 19 bp, Unknown
  misc_feature (1)..( 19): Result.005 file - promoters50/1807067
acaattaaaaaaaaagtta

SEQ ID NO: 177869 - DNA, 19 bp, Unknown
  misc_feature (1)..( 19): Result.005 file - promoters50/1807067
tcaacaaccaaagcctaga

SEQ ID NO: 177870 - DNA, 14 bp, Unknown
  misc_feature (1)..( 14): Result.005 file - promoters50/1807067
atcaattttaagta

SEQ ID NO: 177871 - DNA, 14 bp, Unknown
  misc_feature (1)..( 14): Result.005 file - promoters50/1807067
atcaagtttctata

SEQ ID NO: 177872 - DNA, 14 bp, Unknown
  misc_feature (1)..( 14): Result.005 file - promoters50/1807067
tcggatttttagta

SEQ ID NO: 177873 - DNA, 14 bp, Unknown
  misc_feature (1)..( 14): Result.005 file - promoters50/1807067
gatgattttaatta

SEQ ID NO: 177874 - DNA, 14 bp, Unknown
  misc_feature (1)..( 14): Result.005 file - promoters50/1807067
acatatttttcttc

SEQ ID NO: 177875 - DNA, 14 bp, Unknown
  misc_feature (1)..( 14): Result.005 file - promoters50/1807067
ggtgatttgaatta

SEQ ID NO: 177876 - DNA, 14 bp, Unknown
  misc_feature (1)..( 14): Result.005 file - promoters50/1807067
gatggtttttgtag

SEQ ID NO: 177877 - DNA, 13 bp, Unknown
  misc_feature (1)..( 13): Result.005 file - promoters50/1807067
catgttagtgtaa

SEQ ID NO: 177878 - DNA, 13 bp, Unknown
  misc_feature (1)..( 13): Result.005 file - promoters50/1807067
tgtattattgtgt

SEQ ID NO: 177879 - DNA, 13 bp, Unknown
  misc_feature (1)..( 13): Result.005 file - promoters50/1807067
acatgtattatgt

SEQ ID NO: 177880 - DNA, 13 bp, Unknown
  misc_feature (1)..( 13): Result.005 file - promoters50/1807067
tatcgtatcattt

SEQ ID NO: 177881 - DNA, 13 bp, Unknown
  misc_feature (1)..( 13): Result.005 file - promoters50/1807067
atcctttttatca

SEQ ID NO: 177882 - DNA, 13 bp, Unknown
  misc_feature (1)..( 13): Result.005 file - promoters50/1807067
gctgccatcgttt

SEQ ID NO: 177883 - DNA, 9 bp, Unknown
  misc_feature (1)..( 9): Result.005 file - promoters50/1807244
cgtccgaat

SEQ ID NO: 177884 - DNA, 9 bp, Unknown
  misc_feature (1)..( 9): Result.005 file - promoters50/1807244
tgtcctaat

SEQ ID NO: 177885 - DNA, 9 bp, Unknown
  misc_feature (1)..( 9): Result.005 file - promoters50/1807244
tgtcttaac

SEQ ID NO: 177886 - DNA, 8 bp, Unknown
  misc_feature (1)..( 8): Result.005 file - promoters50/1807415
gtttgtcc

SEQ ID NO: 177887 - DNA, 8 bp, Unknown
  misc_feature (1)..( 8): Result.005 file - promoters50/1807415
ctttgtct

SEQ ID NO: 177888 - DNA, 8 bp, Unknown
  misc_feature (1)..( 8): Result.005 file - promoters50/1807415
ctttttct

SEQ ID NO: 177889 - DNA, 6 bp, Unknown
  misc_feature (1)..( 6): Result.005 file - promoters50/1807415
attttt

SEQ ID NO: 177890 - DNA, 6 bp, Unknown
  misc_feature (1)..( 6): Result.005 file - promoters50/1807415
attttt

SEQ ID NO: 177891 - DNA, 7 bp, Unknown
  misc_feature (1)..( 7): Result.005 file - promoters50/1807415
attcttt

SEQ ID NO: 177892 - DNA, 8 bp, Unknown
  misc_feature (1)..( 8): Result.005 file - promoters50/1807415
tttctctc

SEQ ID NO: 177893 - DNA, 8 bp, Unknown
  misc_feature (1)..( 8): Result.005 file - promoters50/1807415
tttctctc

SEQ ID NO: 177894 - DNA, 8 bp, Unknown
  misc_feature (1)..( 8): Result.005 file - promoters50/1807415
attctctg

SEQ ID NO: 177895 - DNA, 7 bp, Unknown
  misc_feature (1)..( 7): Result.005 file - promoters50/1807415
caaataa

SEQ ID NO: 177896 - DNA, 7 bp, Unknown
  misc_feature (1)..( 7): Result.005 file - promoters50/1807415
caaataa

SEQ ID NO: 177897 - DNA, 7 bp, Unknown
  misc_feature (1)..( 7): Result.005 file - promoters50/1807415
taaataa

SEQ ID NO: 177898 - DNA, 7 bp, Unknown
  misc_feature (1)..( 7): Result.005 file - promoters50/1807415
ttcttta

SEQ ID NO: 177899 - DNA, 7 bp, Unknown
  misc_feature (1)..( 7): Result.005 file - promoters50/1807415
atcttta

SEQ ID NO: 177900 - DNA, 7 bp, Unknown
  misc_feature (1)..( 7): Result.005 file - promoters50/1807415
atttttt

SEQ ID NO: 177901 - DNA, 11 bp, Unknown
  misc_feature (1)..( 11): Result.005 file - promoters50/1807554
aatatattttt

SEQ ID NO: 177902 - DNA, 11 bp, Unknown
  misc_feature (1)..( 11): Result.005 file - promoters50/1807554
aatatgttttt

SEQ ID NO: 177903 - DNA, 11 bp, Unknown
  misc_feature (1)..( 11): Result.005 file - promoters50/1807554
aatgagttttt

SEQ ID NO: 177904 - DNA, 7 bp, Unknown
  misc_feature (1)..( 7): Result.005 file - promoters50/1807554
tttcacc

SEQ ID NO: 177905 - DNA, 7 bp, Unknown
  misc_feature (1)..( 7): Result.005 file - promoters50/1807554
tttgacc

SEQ ID NO: 177906 - DNA, 7 bp, Unknown
  misc_feature (1)..( 7): Result.005 file - promoters50/1807554
tttcacc

SEQ ID NO: 177907 - DNA, 6 bp, Unknown
  misc_feature (1)..( 6): Result.005 file - promoters50/1807554
taaaac

SEQ ID NO: 177908 - DNA, 6 bp, Unknown
  misc_feature (1)..( 6): Result.005 file - promoters50/1807554
taaaac

SEQ ID NO: 177909 - DNA, 6 bp, Unknown
  misc_feature (1)..( 6): Result.005 file - promoters50/1807554
taaaac

SEQ ID NO: 177910 - DNA, 10 bp, Unknown
  misc_feature (1)..( 10): Result.005 file - promoters50/1807554
tccatcccta

SEQ ID NO: 177911 - DNA, 10 bp, Unknown
  misc_feature (1)..( 10): Result.005 file - promoters50/1807554
gtcatctcta

SEQ ID NO: 177912 - DNA, 10 bp, Unknown
  misc_feature (1)..( 10): Result.005 file - promoters50/1807554
tccttccgtg

SEQ ID NO: 177913 - DNA, 11 bp, Unknown
  misc_feature (1)..( 11): Result.005 file - promoters50/1807736
ctatgaataat

SEQ ID NO: 177914 - DNA, 11 bp, Unknown
  misc_feature (1)..( 11): Result.005 file - promoters50/1807736
gtataaatatc

SEQ ID NO: 177915 - DNA, 11 bp, Unknown
  misc_feature (1)..( 11): Result.005 file - promoters50/1807736
acctgaatact

SEQ ID NO: 177916 - DNA, 11 bp, Unknown
  misc_feature (1)..( 11): Result.005 file - promoters50/1807736
gtagaaagtca

SEQ ID NO: 177917 - DNA, 11 bp, Unknown
  misc_feature (1)..( 11): Result.005 file - promoters50/1807736
atctgaacact

SEQ ID NO: 177918 - DNA, 11 bp, Unknown
  misc_feature (1)..( 11): Result.005 file - promoters50/1807736
cattgaacatt

SEQ ID NO: 177919 - DNA, 8 bp, Unknown
  misc_feature (1)..( 8): Result.005 file - promoters50/1807740
aaacttaa

SEQ ID NO: 177920 - DNA, 8 bp, Unknown
  misc_feature (1)..( 8): Result.005 file - promoters50/1807740
aaacttaa

SEQ ID NO: 177921 - DNA, 8 bp, Unknown
  misc_feature (1)..( 8): Result.005 file - promoters50/1807740
aaaattat

SEQ ID NO: 177922 - DNA, 8 bp, Unknown
  misc_feature (1)..( 8): Result.005 file - promoters50/1807771
aaaaacag

SEQ ID NO: 177923 - DNA, 8 bp, Unknown
  misc_feature (1)..( 8): Result.005 file - promoters50/1807771
aaatacac

SEQ ID NO: 177924 - DNA, 8 bp, Unknown
  misc_feature (1)..( 8): Result.005 file - promoters50/1807771
aaaaacaa

SEQ ID NO: 177925 - DNA, 8 bp, Unknown
  misc_feature (1)..( 8): Result.005 file - promoters50/1807771
tgaaacag

SEQ ID NO: 177926 - DNA, 8 bp, Unknown
  misc_feature (1)..( 8): Result.005 file - promoters50/1807771
taaaacac

SEQ ID NO: 177927 - DNA, 8 bp, Unknown
  misc_feature (1)..( 8): Result.005 file - promoters50/1807771
aaatatat

SEQ ID NO: 177928 - DNA, 10 bp, Unknown
  misc_feature (1)..( 10): Result.005 file - promoters50/1807771
agaaagtatt

SEQ ID NO: 177929 - DNA, 10 bp, Unknown
  misc_feature (1)..( 10): Result.005 file - promoters50/1807771
ccaaaatatt

SEQ ID NO: 177930 - DNA, 10 bp, Unknown
  misc_feature (1)..( 10): Result.005 file - promoters50/1807771
ttaaaatata

SEQ ID NO: 177931 - DNA, 10 bp, Unknown
  misc_feature (1)..( 10): Result.005 file - promoters50/1807771
acaaaatctc

SEQ ID NO: 177932 - DNA, 10 bp, Unknown
  misc_feature (1)..( 10): Result.005 file - promoters50/1807771
acaaaaacaa

SEQ ID NO: 177933 - DNA, 10 bp, Unknown
  misc_feature (1)..( 10): Result.005 file - promoters50/1807771
agaaaataga

SEQ ID NO: 177934 - DNA, 10 bp, Unknown
  misc_feature (1)..( 10): Result.005 file - promoters50/1807771
ataaaataga

SEQ ID NO: 177935 - DNA, 10 bp, Unknown
  misc_feature (1)..( 10): Result.005 file - promoters50/1807774
taaaaagctc

SEQ ID NO: 177936 - DNA, 10 bp, Unknown
  misc_feature (1)..( 10): Result.005 file - promoters50/1807774
taaaaatttt

SEQ ID NO: 177937 - DNA, 10 bp, Unknown
  misc_feature (1)..( 10): Result.005 file - promoters50/1807774
taaaaaatat

SEQ ID NO: 177938 - DNA, 10 bp, Unknown
  misc_feature (1)..( 10): Result.005 file - promoters50/1807774
taacaatttt

SEQ ID NO: 177939 - DNA, 10 bp, Unknown
  misc_feature (1)..( 10): Result.005 file - promoters50/1807774
ttttggaaat

SEQ ID NO: 177940 - DNA, 10 bp, Unknown
  misc_feature (1)..( 10): Result.005 file - promoters50/1807774
ccaaggaaat

SEQ ID NO: 177941 - DNA, 10 bp, Unknown
  misc_feature (1)..( 10): Result.005 file - promoters50/1807774
ttttcgaaag

SEQ ID NO: 177942 - DNA, 7 bp, Unknown
  misc_feature (1)..( 7): Result.005 file - promoters50/1807774
aaagttt

SEQ ID NO: 177943 - DNA, 7 bp, Unknown
  misc_feature (1)..( 7): Result.005 file - promoters50/1807774
aaatttt

SEQ ID NO: 177944 - DNA, 7 bp, Unknown
  misc_feature (1)..( 7): Result.005 file - promoters50/1807774
aaattta

SEQ ID NO: 177945 - DNA, 8 bp, Unknown
  misc_feature (1)..( 8): Result.005 file - promoters50/1807774
atatcaac

SEQ ID NO: 177946 - DNA, 8 bp, Unknown
  misc_feature (1)..( 8): Result.005 file - promoters50/1807774
ataccaac

SEQ ID NO: 177947 - DNA, 8 bp, Unknown
  misc_feature (1)..( 8): Result.005 file - promoters50/1807774
ttacaaac

SEQ ID NO: 177948 - DNA, 8 bp, Unknown
  misc_feature (1)..( 8): Result.005 file - promoters50/1807774
cactgttc

SEQ ID NO: 177949 - DNA, 8 bp, Unknown
  misc_feature (1)..( 8): Result.005 file - promoters50/1807774
cactgttt

SEQ ID NO: 177950 - DNA, 8 bp, Unknown
  misc_feature (1)..( 8): Result.005 file - promoters50/1807774
tactattt

SEQ ID NO: 177951 - DNA, 8 bp, Unknown
  misc_feature (1)..( 8): Result.005 file - promoters50/1807774
tataaaac

SEQ ID NO: 177952 - DNA, 8 bp, Unknown
  misc_feature (1)..( 8): Result.005 file - promoters50/1807774
tataaata

SEQ ID NO: 177953 - DNA, 8 bp, Unknown
  misc_feature (1)..( 8): Result.005 file - promoters50/1807774
tatatata

SEQ ID NO: 177954 - DNA, 8 bp, Unknown
  misc_feature (1)..( 8): Result.005 file - promoters50/1807774
attaattg

SEQ ID NO: 177955 - DNA, 8 bp, Unknown
  misc_feature (1)..( 8): Result.005 file - promoters50/1807774
atttattt

SEQ ID NO: 177956 - DNA, 8 bp, Unknown
  misc_feature (1)..( 8): Result.005 file - promoters50/1807774
atttgttt

SEQ ID NO: 177957 - DNA, 7 bp, Unknown
  misc_feature (1)..( 7): Result.005 file - promoters50/1808030
ggtccaa

SEQ ID NO: 177958 - DNA, 7 bp, Unknown
  misc_feature (1)..( 7): Result.005 file - promoters50/1808030
ggtccat

SEQ ID NO: 177959 - DNA, 7 bp, Unknown
  misc_feature (1)..( 7): Result.005 file - promoters50/1808030
tgtccat

SEQ ID NO: 177960 - DNA, 8 bp, Unknown
  misc_feature (1)..( 8): Result.005 file - promoters50/1808030
atacaaat

SEQ ID NO: 177961 - DNA, 8 bp, Unknown
  misc_feature (1)..( 8): Result.005 file - promoters50/1808030
atacaaaa

SEQ ID NO: 177962 - DNA, 8 bp, Unknown
  misc_feature (1)..( 8): Result.005 file - promoters50/1808030
caacaaat

SEQ ID NO: 177963 - DNA, 7 bp, Unknown
  misc_feature (1)..( 7): Result.005 file - promoters50/1808030
caaaaac

SEQ ID NO: 177964 - DNA, 7 bp, Unknown
  misc_feature (1)..( 7): Result.005 file - promoters50/1808030
caataac

SEQ ID NO: 177965 - DNA, 7 bp, Unknown
  misc_feature (1)..( 7): Result.005 file - promoters50/1808030
caaaaaa

SEQ ID NO: 177966 - DNA, 12 bp, Unknown
  misc_feature (1)..( 12): Result.005 file - promoters50/1808072
tccataattatt

SEQ ID NO: 177967 - DNA, 12 bp, Unknown
  misc_feature (1)..( 12): Result.005 file - promoters50/1808072
taaataattaaa

SEQ ID NO: 177968 - DNA, 12 bp, Unknown
  misc_feature (1)..( 12): Result.005 file - promoters50/1808072
aatataattgac

SEQ ID NO: 177969 - DNA, 12 bp, Unknown
  misc_feature (1)..( 12): Result.005 file - promoters50/1808072
taaacaatggtt

SEQ ID NO: 177970 - DNA, 12 bp, Unknown
  misc_feature (1)..( 12): Result.005 file - promoters50/1808072
atcataagtaat

SEQ ID NO: 177971 - DNA, 12 bp, Unknown
  misc_feature (1)..( 12): Result.005 file - promoters50/1808072
caaacgatggtc

SEQ ID NO: 177972 - DNA, 8 bp, Unknown
  misc_feature (1)..( 8): Result.005 file - promoters50/1808072
taatttaa

SEQ ID NO: 177973 - DNA, 8 bp, Unknown
  misc_feature (1)..( 8): Result.005 file - promoters50/1808072
aaatataa

SEQ ID NO: 177974 - DNA, 8 bp, Unknown
  misc_feature (1)..( 8): Result.005 file - promoters50/1808072
taattttt

SEQ ID NO: 177975 - DNA, 8 bp, Unknown
  misc_feature (1)..( 8): Result.005 file - promoters50/1808072
aaatataa

SEQ ID NO: 177976 - DNA, 8 bp, Unknown
  misc_feature (1)..( 8): Result.005 file - promoters50/1808072
taatttaa

SEQ ID NO: 177977 - DNA, 8 bp, Unknown
  misc_feature (1)..( 8): Result.005 file - promoters50/1808072
ttatataa

SEQ ID NO: 177978 - DNA, 13 bp, Unknown
  misc_feature (1)..( 13): Result.005 file - promoters50/1808072
tgacaaaatttaa

SEQ ID NO: 177979 - DNA, 13 bp, Unknown
  misc_feature (1)..( 13): Result.005 file - promoters50/1808072
ctacaaaataaac

SEQ ID NO: 177980 - DNA, 13 bp, Unknown
  misc_feature (1)..( 13): Result.005 file - promoters50/1808072
attgaaaatttta

SEQ ID NO: 177981 - DNA, 13 bp, Unknown
  misc_feature (1)..( 13): Result.005 file - promoters50/1808072
tgactaaagatta

SEQ ID NO: 177982 - DNA, 13 bp, Unknown
  misc_feature (1)..( 13): Result.005 file - promoters50/1808072
aaaggaaattaaa

SEQ ID NO: 177983 - DNA, 13 bp, Unknown
  misc_feature (1)..( 13): Result.005 file - promoters50/1808072
attataaattagg

SEQ ID NO: 177984 - DNA, 15 bp, Unknown
  misc_feature (1)..( 15): Result.005 file - promoters50/1808072
aaaatttaaaattgt

SEQ ID NO: 177985 - DNA, 15 bp, Unknown
  misc_feature (1)..( 15): Result.005 file - promoters50/1808072
taaatttaaaaacca

SEQ ID NO: 177986 - DNA, 15 bp, Unknown
  misc_feature (1)..( 15): Result.005 file - promoters50/1808072
aaaattttatatata

SEQ ID NO: 177987 - DNA, 15 bp, Unknown
  misc_feature (1)..( 15): Result.005 file - promoters50/1808072
ggaaattaaaatcta

SEQ ID NO: 177988 - DNA, 15 bp, Unknown
  misc_feature (1)..( 15): Result.005 file - promoters50/1808072
aagagttaaaatcaa

SEQ ID NO: 177989 - DNA, 16 bp, Unknown
  misc_feature (1)..( 16): Result.005 file - promoters50/1808072
aaagattacaaaacat

SEQ ID NO: 177990 - DNA, 10 bp, Unknown
  misc_feature (1)..( 10): Result.005 file - promoters50/1808072
aaaattatcc

SEQ ID NO: 177991 - DNA, 10 bp, Unknown
  misc_feature (1)..( 10): Result.005 file - promoters50/1808072
taaattatat

SEQ ID NO: 177992 - DNA, 10 bp, Unknown
  misc_feature (1)..( 10): Result.005 file - promoters50/1808072
aaaattcaag

SEQ ID NO: 177993 - DNA, 10 bp, Unknown
  misc_feature (1)..( 10): Result.005 file - promoters50/1808072
taaattaata

SEQ ID NO: 177994 - DNA, 10 bp, Unknown
  misc_feature (1)..( 10): Result.005 file - promoters50/1808072
ccaattttat

SEQ ID NO: 177995 - DNA, 14 bp, Unknown
  misc_feature (1)..( 14): Result.005 file - promoters50/1808072
cgagtttttttata

SEQ ID NO: 177996 - DNA, 14 bp, Unknown
  misc_feature (1)..( 14): Result.005 file - promoters50/1808072
ttcccaattttatg

SEQ ID NO: 177997 - DNA, 14 bp, Unknown
  misc_feature (1)..( 14): Result.005 file - promoters50/1808072
tcataaattatatt

SEQ ID NO: 177998 - DNA, 14 bp, Unknown
  misc_feature (1)..( 14): Result.005 file - promoters50/1808072
tcaaaaattaccaa

SEQ ID NO: 177999 - DNA, 14 bp, Unknown
  misc_feature (1)..( 14): Result.005 file - promoters50/1808072
tccaaaatcataaa

SEQ ID NO: 178000 - DNA, 13 bp, Unknown
  misc_feature (1)..( 13): Result.005 file - promoters50/1808072
gcttaactaaaat

SEQ ID NO: 178001 - DNA, 13 bp, Unknown
  misc_feature (1)..( 13): Result.005 file - promoters50/1808072
cataaaccaaaaa

SEQ ID NO: 178002 - DNA, 13 bp, Unknown
  misc_feature (1)..( 13): Result.005 file - promoters50/1808072
tgctaactatgaa

SEQ ID NO: 178003 - DNA, 13 bp, Unknown
  misc_feature (1)..( 13): Result.005 file - promoters50/1808072
caataattcataa

SEQ ID NO: 178004 - DNA, 13 bp, Unknown
  misc_feature (1)..( 13): Result.005 file - promoters50/1808072
tataaattaatat

SEQ ID NO: 178005 - DNA, 13 bp, Unknown
  misc_feature (1)..( 13): Result.005 file - promoters50/1808072
atagcattattat

SEQ ID NO: 178006 - DNA, 11 bp, Unknown
  misc_feature (1)..( 11): Result.005 file - promoters50/1808072
attattatccg

SEQ ID NO: 178007 - DNA, 11 bp, Unknown
  misc_feature (1)..( 11): Result.005 file - promoters50/1808072
gttattaataa

SEQ ID NO: 178008 - DNA, 11 bp, Unknown
  misc_feature (1)..( 11): Result.005 file - promoters50/1808072
gttataaataa

SEQ ID NO: 178009 - DNA, 11 bp, Unknown
  misc_feature (1)..( 11): Result.005 file - promoters50/1808072
attacaaacga

SEQ ID NO: 178010 - DNA, 11 bp, Unknown
  misc_feature (1)..( 11): Result.005 file - promoters50/1808072
tatattaattt

SEQ ID NO: 178011 - DNA, 14 bp, Unknown
  misc_feature (1)..( 14): Result.005 file - promoters50/1808072
atttaaaaaccata

SEQ ID NO: 178012 - DNA, 14 bp, Unknown
  misc_feature (1)..( 14): Result.005 file - promoters50/1808072
ttttggcaaccata

SEQ ID NO: 178013 - DNA, 14 bp, Unknown
  misc_feature (1)..( 14): Result.005 file - promoters50/1808072
gattacaaaacatg

SEQ ID NO: 178014 - DNA, 14 bp, Unknown
  misc_feature (1)..( 14): Result.005 file - promoters50/1808072
atctacaaaataaa

SEQ ID NO: 178015 - DNA, 14 bp, Unknown
  misc_feature (1)..( 14): Result.005 file - promoters50/1808072
gattataaattagg

SEQ ID NO: 178016 - DNA, 8 bp, Unknown
  misc_feature (1)..( 8): Result.005 file - promoters50/1808088
ttttaccg

SEQ ID NO: 178017 - DNA, 8 bp, Unknown
  misc_feature (1)..( 8): Result.005 file - promoters50/1808088
gttttccg

SEQ ID NO: 178018 - DNA, 8 bp, Unknown
  misc_feature (1)..( 8): Result.005 file - promoters50/1808088
ttttacca

SEQ ID NO: 178019 - DNA, 8 bp, Unknown
  misc_feature (1)..( 8): Result.005 file - promoters50/1808088
taaaaaaa

SEQ ID NO: 178020 - DNA, 8 bp, Unknown
  misc_feature (1)..( 8): Result.005 file - promoters50/1808088
acaaaaaa

SEQ ID NO: 178021 - DNA, 8 bp, Unknown
  misc_feature (1)..( 8): Result.005 file - promoters50/1808088
acacaaac

SEQ ID NO: 178022 - DNA, 11 bp, Unknown
  misc_feature (1)..( 11): Result.005 file - promoters50/1808088
aaagaagatac

SEQ ID NO: 178023 - DNA, 11 bp, Unknown
  misc_feature (1)..( 11): Result.005 file - promoters50/1808088
aaagaggattg

SEQ ID NO: 178024 - DNA, 11 bp, Unknown
  misc_feature (1)..( 11): Result.005 file - promoters50/1808088
tgagaggcttg

SEQ ID NO: 178025 - DNA, 7 bp, Unknown
  misc_feature (1)..( 7): Result.005 file - promoters50/1808088
taaaaaa

SEQ ID NO: 178026 - DNA, 7 bp, Unknown
  misc_feature (1)..( 7): Result.005 file - promoters50/1808088
taaaaag

SEQ ID NO: 178027 - DNA, 7 bp, Unknown
  misc_feature (1)..( 7): Result.005 file - promoters50/1808088
aaaaaag

SEQ ID NO: 178028 - DNA, 9 bp, Unknown
  misc_feature (1)..( 9): Result.005 file - promoters50/1808111
caaaaaaaa

SEQ ID NO: 178029 - DNA, 9 bp, Unknown
  misc_feature (1)..( 9): Result.005 file - promoters50/1808111
taaaaaagg

SEQ ID NO: 178030 - DNA, 9 bp, Unknown
  misc_feature (1)..( 9): Result.005 file - promoters50/1808111
taaaaaaaa

SEQ ID NO: 178031 - DNA, 10 bp, Unknown
  misc_feature (1)..( 10): Result.005 file - promoters50/1808111
caaaacaaaa

SEQ ID NO: 178032 - DNA, 10 bp, Unknown
  misc_feature (1)..( 10): Result.005 file - promoters50/1808111
taaagaaagc

SEQ ID NO: 178033 - DNA, 10 bp, Unknown
  misc_feature (1)..( 10): Result.005 file - promoters50/1808111
cctagaaagt

SEQ ID NO: 178034 - DNA, 8 bp, Unknown
  misc_feature (1)..( 8): Result.005 file - promoters50/1808111
aaaaatca

SEQ ID NO: 178035 - DNA, 8 bp, Unknown
  misc_feature (1)..( 8): Result.005 file - promoters50/1808111
aaaaattt

SEQ ID NO: 178036 - DNA, 8 bp, Unknown
  misc_feature (1)..( 8): Result.005 file - promoters50/1808111
aaaaatgc

SEQ ID NO: 178037 - DNA, 8 bp, Unknown
  misc_feature (1)..( 8): Result.005 file - promoters50/1808111
gaaaatta

SEQ ID NO: 178038 - DNA, 8 bp, Unknown
  misc_feature (1)..( 8): Result.005 file - promoters50/1808111
aaaaatgc

SEQ ID NO: 178039 - DNA, 8 bp, Unknown
  misc_feature (1)..( 8): Result.005 file - promoters50/1808111
tataaaaa

SEQ ID NO: 178040 - DNA, 8 bp, Unknown
  misc_feature (1)..( 8): Result.005 file - promoters50/1808111
tatataaa

SEQ ID NO: 178041 - DNA, 8 bp, Unknown
  misc_feature (1)..( 8): Result.005 file - promoters50/1808111
tatataaa

SEQ ID NO: 178042 - DNA, 8 bp, Unknown
  misc_feature (1)..( 8): Result.005 file - promoters50/1808111
tttataaa

SEQ ID NO: 178043 - DNA, 8 bp, Unknown
  misc_feature (1)..( 8): Result.005 file - promoters50/1808111
catataaa

SEQ ID NO: 178044 - DNA, 11 bp, Unknown
  misc_feature (1)..( 11): Result.005 file - promoters50/1808111
aaaaaaaaaaa

SEQ ID NO: 178045 - DNA, 11 bp, Unknown
  misc_feature (1)..( 11): Result.005 file - promoters50/1808111
ataaagaaagc

SEQ ID NO: 178046 - DNA, 11 bp, Unknown
  misc_feature (1)..( 11): Result.005 file - promoters50/1808111
ttaaaaaaaag

SEQ ID NO: 178047 - DNA, 11 bp, Unknown
  misc_feature (1)..( 11): Result.005 file - promoters50/1808111
caaaacaaaac

SEQ ID NO: 178048 - DNA, 12 bp, Unknown
  misc_feature (1)..( 12): Result.005 file - promoters50/1808111
aaaaatcaaaac

SEQ ID NO: 178049 - DNA, 8 bp, Unknown
  misc_feature (1)..( 8): Result.005 file - promoters50/1808145
tgagttta

SEQ ID NO: 178050 - DNA, 8 bp, Unknown
  misc_feature (1)..( 8): Result.005 file - promoters50/1808145
tgaatttc

SEQ ID NO: 178051 - DNA, 8 bp, Unknown
  misc_feature (1)..( 8): Result.005 file - promoters50/1808145
agagctta

SEQ ID NO: 178052 - DNA, 8 bp, Unknown
  misc_feature (1)..( 8): Result.005 file - promoters50/1808145
atagttta

SEQ ID NO: 178053 - DNA, 8 bp, Unknown
  misc_feature (1)..( 8): Result.005 file - promoters50/1808145
atataaac

SEQ ID NO: 178054 - DNA, 8 bp, Unknown
  misc_feature (1)..( 8): Result.005 file - promoters50/1808145
atagaaag

SEQ ID NO: 178055 - DNA, 8 bp, Unknown
  misc_feature (1)..( 8): Result.005 file - promoters50/1808145
gtaggaag

SEQ ID NO: 178056 - DNA, 8 bp, Unknown
  misc_feature (1)..( 8): Result.005 file - promoters50/1808145
acatggtt

SEQ ID NO: 178057 - DNA, 8 bp, Unknown
  misc_feature (1)..( 8): Result.005 file - promoters50/1808145
acaaggtc

SEQ ID NO: 178058 - DNA, 8 bp, Unknown
  misc_feature (1)..( 8): Result.005 file - promoters50/1808145
ccatggtt

SEQ ID NO: 178059 - DNA, 12 bp, Unknown
  misc_feature (1)..( 12): Result.005 file - promoters50/1808145
agcccatttgaa

SEQ ID NO: 178060 - DNA, 12 bp, Unknown
  misc_feature (1)..( 12): Result.005 file - promoters50/1808145
agcccaattgaa

SEQ ID NO: 178061 - DNA, 12 bp, Unknown
  misc_feature (1)..( 12): Result.005 file - promoters50/1808145
tgcccatggctg

SEQ ID NO: 178062 - DNA, 10 bp, Unknown
  misc_feature (1)..( 10): Result.005 file - promoters50/1808156
caatatgatt

SEQ ID NO: 178063 - DNA, 10 bp, Unknown
  misc_feature (1)..( 10): Result.005 file - promoters50/1808156
aaatttgaac

SEQ ID NO: 178064 - DNA, 10 bp, Unknown
  misc_feature (1)..( 10): Result.005 file - promoters50/1808156
caatgtgaaa

SEQ ID NO: 178065 - DNA, 10 bp, Unknown
  misc_feature (1)..( 10): Result.005 file - promoters50/1808156
taatttcaac

SEQ ID NO: 178066 - DNA, 11 bp, Unknown
  misc_feature (1)..( 11): Result.005 file - promoters50/1808156
aaactttgatt

SEQ ID NO: 178067 - DNA, 11 bp, Unknown
  misc_feature (1)..( 11): Result.005 file - promoters50/1808156
tcaatttcaca

SEQ ID NO: 178068 - DNA, 11 bp, Unknown
  misc_feature (1)..( 11): Result.005 file - promoters50/1808156
ttaatgagaag

SEQ ID NO: 178069 - DNA, 10 bp, Unknown
  misc_feature (1)..( 10): Result.005 file - promoters50/1808168
taaaataaac

SEQ ID NO: 178070 - DNA, 10 bp, Unknown
  misc_feature (1)..( 10): Result.005 file - promoters50/1808168
aaaaagaaaa

SEQ ID NO: 178071 - DNA, 10 bp, Unknown
  misc_feature (1)..( 10): Result.005 file - promoters50/1808168
ttaatgaaat

SEQ ID NO: 178072 - DNA, 10 bp, Unknown
  misc_feature (1)..( 10): Result.005 file - promoters50/1808168
caaactaacc

SEQ ID NO: 178073 - DNA, 10 bp, Unknown
  misc_feature (1)..( 10): Result.005 file - promoters50/1808168
taaaatacta

SEQ ID NO: 178074 - DNA, 10 bp, Unknown
  misc_feature (1)..( 10): Result.005 file - promoters50/1808168
ttagataatt

SEQ ID NO: 178075 - DNA, 10 bp, Unknown
  misc_feature (1)..( 10): Result.005 file - promoters50/1808168
acaaatacca

SEQ ID NO: 178076 - DNA, 8 bp, Unknown
  misc_feature (1)..( 8): Result.005 file - promoters50/1808168
cataaaca

SEQ ID NO: 178077 - DNA, 8 bp, Unknown
  misc_feature (1)..( 8): Result.005 file - promoters50/1808168
tataaacg

SEQ ID NO: 178078 - DNA, 8 bp, Unknown
  misc_feature (1)..( 8): Result.005 file - promoters50/1808168
tataaatt

SEQ ID NO: 178079 - DNA, 8 bp, Unknown
  misc_feature (1)..( 8): Result.005 file - promoters50/1808168
aataaaca

SEQ ID NO: 178080 - DNA, 8 bp, Unknown
  misc_feature (1)..( 8): Result.005 file - promoters50/1808168
tatcaatt

SEQ ID NO: 178081 - DNA, 8 bp, Unknown
  misc_feature (1)..( 8): Result.005 file - promoters50/1808168
aatcaata

SEQ ID NO: 178082 - DNA, 10 bp, Unknown
  misc_feature (1)..( 10): Result.005 file - promoters50/1808172
taaattttga

SEQ ID NO: 178083 - DNA, 10 bp, Unknown
  misc_feature (1)..( 10): Result.005 file - promoters50/1808172
aaaagtttat

SEQ ID NO: 178084 - DNA, 10 bp, Unknown
  misc_feature (1)..( 10): Result.005 file - promoters50/1808172
catattctga

SEQ ID NO: 178085 - DNA, 10 bp, Unknown
  misc_feature (1)..( 10): Result.005 file - promoters50/1808172
aaaatttatc

SEQ ID NO: 178086 - DNA, 10 bp, Unknown
  misc_feature (1)..( 10): Result.005 file - promoters50/1808172
caaattgatc

SEQ ID NO: 178087 - DNA, 10 bp, Unknown
  misc_feature (1)..( 10): Result.005 file - promoters50/1808172
ctaatatata

SEQ ID NO: 178088 - DNA, 11 bp, Unknown
  misc_feature (1)..( 11): Result.005 file - promoters50/1808172
agttaactttg

SEQ ID NO: 178089 - DNA, 11 bp, Unknown
  misc_feature (1)..( 11): Result.005 file - promoters50/1808172
aattaacttat

SEQ ID NO: 178090 - DNA, 11 bp, Unknown
  misc_feature (1)..( 11): Result.005 file - promoters50/1808172
agtcaacttgt

SEQ ID NO: 178091 - DNA, 12 bp, Unknown
  misc_feature (1)..( 12): Result.005 file - promoters50/1808172
tattaaccttga

SEQ ID NO: 178092 - DNA, 12 bp, Unknown
  misc_feature (1)..( 12): Result.005 file - promoters50/1808172
ttaagaacttta

SEQ ID NO: 178093 - DNA, 12 bp, Unknown
  misc_feature (1)..( 12): Result.005 file - promoters50/1808172
aataaaacatgt

SEQ ID NO: 178094 - DNA, 15 bp, Unknown
  misc_feature (1)..( 15): Result.005 file - promoters50/1808172
gaaatcataatagag

SEQ ID NO: 178095 - DNA, 15 bp, Unknown
  misc_feature (1)..( 15): Result.005 file - promoters50/1808172
tcaattatatatata

SEQ ID NO: 178096 - DNA, 15 bp, Unknown
  misc_feature (1)..( 15): Result.005 file - promoters50/1808172
aaaataataataaaa

SEQ ID NO: 178097 - DNA, 15 bp, Unknown
  misc_feature (1)..( 15): Result.005 file - promoters50/1808172
ccaactatccaaaat

SEQ ID NO: 178098 - DNA, 15 bp, Unknown
  misc_feature (1)..( 15): Result.005 file - promoters50/1808172
ctacttattccatta

SEQ ID NO: 178099 - DNA, 15 bp, Unknown
  misc_feature (1)..( 15): Result.005 file - promoters50/1808172
ctttttatatgttat

SEQ ID NO: 178100 - DNA, 15 bp, Unknown
  misc_feature (1)..( 15): Result.005 file - promoters50/1808172
taactgatttttcat

SEQ ID NO: 178101 - DNA, 15 bp, Unknown
  misc_feature (1)..( 15): Result.005 file - promoters50/1808172
aaaattaaagtcaat

SEQ ID NO: 178102 - DNA, 11 bp, Unknown
  misc_feature (1)..( 11): Result.005 file - promoters50/1808172
actatgagaaa

SEQ ID NO: 178103 - DNA, 11 bp, Unknown
  misc_feature (1)..( 11): Result.005 file - promoters50/1808172
tatataagaaa

SEQ ID NO: 178104 - DNA, 11 bp, Unknown
  misc_feature (1)..( 11): Result.005 file - promoters50/1808172
aaaatgaaaaa

SEQ ID NO: 178105 - DNA, 11 bp, Unknown
  misc_feature (1)..( 11): Result.005 file - promoters50/1808172
tttatctaatc

SEQ ID NO: 178106 - DNA, 11 bp, Unknown
  misc_feature (1)..( 11): Result.005 file - promoters50/1808172
gctatctaact

SEQ ID NO: 178107 - DNA, 11 bp, Unknown
  misc_feature (1)..( 11): Result.005 file - promoters50/1808172
aaaattaaagt

SEQ ID NO: 178108 - DNA, 11 bp, Unknown
  misc_feature (1)..( 11): Result.005 file - promoters50/1808172
gttacctagct

SEQ ID NO: 178109 - DNA, 15 bp, Unknown
  misc_feature (1)..( 15): Result.005 file - promoters50/1808172
aaataataaagttaa

SEQ ID NO: 178110 - DNA, 15 bp, Unknown
  misc_feature (1)..( 15): Result.005 file - promoters50/1808172
aaatattaaccttga

SEQ ID NO: 178111 - DNA, 15 bp, Unknown
  misc_feature (1)..( 15): Result.005 file - promoters50/1808172
gcttaataaaacatg

SEQ ID NO: 178112 - DNA, 15 bp, Unknown
  misc_feature (1)..( 15): Result.005 file - promoters50/1808172
caaaattgaccctga

SEQ ID NO: 178113 - DNA, 15 bp, Unknown
  misc_feature (1)..( 15): Result.005 file - promoters50/1808172
ttttaatagacagct

SEQ ID NO: 178114 - DNA, 15 bp, Unknown
  misc_feature (1)..( 15): Result.005 file - promoters50/1808172
aaagattacatagtc

SEQ ID NO: 178115 - DNA, 11 bp, Unknown
  misc_feature (1)..( 11): Result.005 file - promoters50/1808172
aaagcaaacaa

SEQ ID NO: 178116 - DNA, 11 bp, Unknown
  misc_feature (1)..( 11): Result.005 file - promoters50/1808172
aaaacaaagac

SEQ ID NO: 178117 - DNA, 11 bp, Unknown
  misc_feature (1)..( 11): Result.005 file - promoters50/1808172
taaataaaaga

SEQ ID NO: 178118 - DNA, 11 bp, Unknown
  misc_feature (1)..( 11): Result.005 file - promoters50/1808172
accataaaact

SEQ ID NO: 178119 - DNA, 11 bp, Unknown
  misc_feature (1)..( 11): Result.005 file - promoters50/1808172
gaaagaaaaac

SEQ ID NO: 178120 - DNA, 11 bp, Unknown
  misc_feature (1)..( 11): Result.005 file - promoters50/1808172
ttattaaaaac

SEQ ID NO: 178121 - DNA, 12 bp, Unknown
  misc_feature (1)..( 12): Result.005 file - promoters50/1808172
catatattcagt

SEQ ID NO: 178122 - DNA, 12 bp, Unknown
  misc_feature (1)..( 12): Result.005 file - promoters50/1808172
tctatattgttt

SEQ ID NO: 178123 - DNA, 12 bp, Unknown
  misc_feature (1)..( 12): Result.005 file - promoters50/1808172
aatacatttcat

SEQ ID NO: 178124 - DNA, 12 bp, Unknown
  misc_feature (1)..( 12): Result.005 file - promoters50/1808172
catgtatgatga

SEQ ID NO: 178125 - DNA, 12 bp, Unknown
  misc_feature (1)..( 12): Result.005 file - promoters50/1808172
tctctatttttt

SEQ ID NO: 178126 - DNA, 12 bp, Unknown
  misc_feature (1)..( 12): Result.005 file - promoters50/1808172
ttcttattttaa

SEQ ID NO: 178127 - DNA, 8 bp, Unknown
  misc_feature (1)..( 8): Result.005 file - promoters50/1808172
caataatg

SEQ ID NO: 178128 - DNA, 8 bp, Unknown
  misc_feature (1)..( 8): Result.005 file - promoters50/1808172
caataaat

SEQ ID NO: 178129 - DNA, 8 bp, Unknown
  misc_feature (1)..( 8): Result.005 file - promoters50/1808172
aaataatg

SEQ ID NO: 178130 - DNA, 8 bp, Unknown
  misc_feature (1)..( 8): Result.005 file - promoters50/1808172
aaataaac

SEQ ID NO: 178131 - DNA, 8 bp, Unknown
  misc_feature (1)..( 8): Result.005 file - promoters50/1808172
aaacaaaa

SEQ ID NO: 178132 - DNA, 8 bp, Unknown
  misc_feature (1)..( 8): Result.005 file - promoters50/1808172
aaagaaat

SEQ ID NO: 178133 - DNA, 10 bp, Unknown
  misc_feature (1)..( 10): Result.005 file - promoters50/1808172
acaataaata

SEQ ID NO: 178134 - DNA, 10 bp, Unknown
  misc_feature (1)..( 10): Result.005 file - promoters50/1808172
ataataaatc

SEQ ID NO: 178135 - DNA, 10 bp, Unknown
  misc_feature (1)..( 10): Result.005 file - promoters50/1808172
ccaaaaaaaa

SEQ ID NO: 178136 - DNA, 10 bp, Unknown
  misc_feature (1)..( 10): Result.005 file - promoters50/1808172
ccaaaaccaa

SEQ ID NO: 178137 - DNA, 11 bp, Unknown
  misc_feature (1)..( 11): Result.005 file - promoters50/1808172
ggaaagaaaaa

SEQ ID NO: 178138 - DNA, 11 bp, Unknown
  misc_feature (1)..( 11): Result.005 file - promoters50/1808172
ttaaaaactta

SEQ ID NO: 178139 - DNA, 11 bp, Unknown
  misc_feature (1)..( 11): Result.005 file - promoters50/1808172
tatataacaca

SEQ ID NO: 178140 - DNA, 11 bp, Unknown
  misc_feature (1)..( 11): Result.005 file - promoters50/1808172
gatataataca

SEQ ID NO: 178141 - DNA, 12 bp, Unknown
  misc_feature (1)..( 12): Result.005 file - promoters50/1808172
attatatataga

SEQ ID NO: 178142 - DNA, 12 bp, Unknown
  misc_feature (1)..( 12): Result.005 file - promoters50/1808172
catataaataga

SEQ ID NO: 178143 - DNA, 12 bp, Unknown
  misc_feature (1)..( 12): Result.005 file - promoters50/1808172
agtataaataaa

SEQ ID NO: 178144 - DNA, 12 bp, Unknown
  misc_feature (1)..( 12): Result.005 file - promoters50/1808172
cctatatataaa

SEQ ID NO: 178145 - DNA, 10 bp, Unknown
  misc_feature (1)..( 10): Result.005 file - promoters50/1808172
tttatttttt

SEQ ID NO: 178146 - DNA, 10 bp, Unknown
  misc_feature (1)..( 10): Result.005 file - promoters50/1808172
cttctttttt

SEQ ID NO: 178147 - DNA, 10 bp, Unknown
  misc_feature (1)..( 10): Result.005 file - promoters50/1808172
tttctttttg

SEQ ID NO: 178148 - DNA, 10 bp, Unknown
  misc_feature (1)..( 10): Result.005 file - promoters50/1808172
ttaattttct

SEQ ID NO: 178149 - DNA, 10 bp, Unknown
  misc_feature (1)..( 10): Result.005 file - promoters50/1808172
aaccttttta

SEQ ID NO: 178150 - DNA, 10 bp, Unknown
  misc_feature (1)..( 10): Result.005 file - promoters50/1808172
ataattttgc

SEQ ID NO: 178151 - DNA, 12 bp, Unknown
  misc_feature (1)..( 12): Result.005 file - promoters50/1808172
gtatataaccca

SEQ ID NO: 178152 - DNA, 12 bp, Unknown
  misc_feature (1)..( 12): Result.005 file - promoters50/1808172
taataaaacatt

SEQ ID NO: 178153 - DNA, 12 bp, Unknown
  misc_feature (1)..( 12): Result.005 file - promoters50/1808172
gtttaaaacaaa

SEQ ID NO: 178154 - DNA, 12 bp, Unknown
  misc_feature (1)..( 12): Result.005 file - promoters50/1808172
aaataaaccttt

SEQ ID NO: 178155 - DNA, 12 bp, Unknown
  misc_feature (1)..( 12): Result.005 file - promoters50/1808172
ggttaaaaaaga

SEQ ID NO: 178156 - DNA, 12 bp, Unknown
  misc_feature (1)..( 12): Result.005 file - promoters50/1808172
ttcttaaacaaa

SEQ ID NO: 178157 - DNA, 9 bp, Unknown
  misc_feature (1)..( 9): Result.005 file - promoters50/1808172
taaaacaaa

SEQ ID NO: 178158 - DNA, 9 bp, Unknown
  misc_feature (1)..( 9): Result.005 file - promoters50/1808172
ttaaacaaa

SEQ ID NO: 178159 - DNA, 9 bp, Unknown
  misc_feature (1)..( 9): Result.005 file - promoters50/1808172
taaaacatt

SEQ ID NO: 178160 - DNA, 9 bp, Unknown
  misc_feature (1)..( 9): Result.005 file - promoters50/1808172
acaaataaa

SEQ ID NO: 178161 - DNA, 9 bp, Unknown
  misc_feature (1)..( 9): Result.005 file - promoters50/1808172
aaaaagaaa

SEQ ID NO: 178162 - DNA, 9 bp, Unknown
  misc_feature (1)..( 9): Result.005 file - promoters50/1808172
ttaaagaaa

SEQ ID NO: 178163 - DNA, 9 bp, Unknown
  misc_feature (1)..( 9): Result.005 file - promoters50/1808184
aattttcaa

SEQ ID NO: 178164 - DNA, 9 bp, Unknown
  misc_feature (1)..( 9): Result.005 file - promoters50/1808184
gatttacaa

SEQ ID NO: 178165 - DNA, 9 bp, Unknown
  misc_feature (1)..( 9): Result.005 file - promoters50/1808184
aattttttt

SEQ ID NO: 178166 - DNA, 9 bp, Unknown
  misc_feature (1)..( 9): Result.005 file - promoters50/1808184
attttacat

SEQ ID NO: 178167 - DNA, 10 bp, Unknown
  misc_feature (1)..( 10): Result.005 file - promoters50/1808184
tttttgacac

SEQ ID NO: 178168 - DNA, 10 bp, Unknown
  misc_feature (1)..( 10): Result.005 file - promoters50/1808184
cactttatga

SEQ ID NO: 178169 - DNA, 12 bp, Unknown
  misc_feature (1)..( 12): Result.005 file - promoters50/1808490
cagttattggtt

SEQ ID NO: 178170 - DNA, 12 bp, Unknown
  misc_feature (1)..( 12): Result.005 file - promoters50/1808490
tatgaatttgtt

SEQ ID NO: 178171 - DNA, 12 bp, Unknown
  misc_feature (1)..( 12): Result.005 file - promoters50/1808490
gttgactttgaa

SEQ ID NO: 178172 - DNA, 12 bp, Unknown
  misc_feature (1)..( 12): Result.005 file - promoters50/1808490
gttaacttaaca

SEQ ID NO: 178173 - DNA, 10 bp, Unknown
  misc_feature (1)..( 10): Result.005 file - promoters50/1808490
aaaaacttag

SEQ ID NO: 178174 - DNA, 10 bp, Unknown
  misc_feature (1)..( 10): Result.005 file - promoters50/1808490
caaaacttgt

SEQ ID NO: 178175 - DNA, 10 bp, Unknown
  misc_feature (1)..( 10): Result.005 file - promoters50/1808490
agaaacgtag

SEQ ID NO: 178176 - DNA, 10 bp, Unknown
  misc_feature (1)..( 10): Result.005 file - promoters50/1808490
caaaaccact

SEQ ID NO: 178177 - DNA, 7 bp, Unknown
  misc_feature (1)..( 7): Result.005 file - promoters50/1808549
atcaaat

SEQ ID NO: 178178 - DNA, 7 bp, Unknown
  misc_feature (1)..( 7): Result.005 file - promoters50/1808549
atcaaaa

SEQ ID NO: 178179 - DNA, 7 bp, Unknown
  misc_feature (1)..( 7): Result.005 file - promoters50/1808549
ttcaaat

SEQ ID NO: 178180 - DNA, 10 bp, Unknown
  misc_feature (1)..( 10): Result.005 file - promoters50/1808549
ctaaaaggcc

SEQ ID NO: 178181 - DNA, 10 bp, Unknown
  misc_feature (1)..( 10): Result.005 file - promoters50/1808549
ctaaaattcc

SEQ ID NO: 178182 - DNA, 10 bp, Unknown
  misc_feature (1)..( 10): Result.005 file - promoters50/1808549
ctataatgac

SEQ ID NO: 178183 - DNA, 10 bp, Unknown
  misc_feature (1)..( 10): Result.005 file - promoters50/1808549
tgataatgac

SEQ ID NO: 178184 - DNA, 9 bp, Unknown
  misc_feature (1)..( 9): Result.005 file - promoters50/1808549
attttaaaa

SEQ ID NO: 178185 - DNA, 9 bp, Unknown
  misc_feature (1)..( 9): Result.005 file - promoters50/1808549
atttgaaac

SEQ ID NO: 178186 - DNA, 9 bp, Unknown
  misc_feature (1)..( 9): Result.005 file - promoters50/1808549
caatgaaac

SEQ ID NO: 178187 - DNA, 7 bp, Unknown
  misc_feature (1)..( 7): Result.005 file - promoters50/1808549
actttta

SEQ ID NO: 178188 - DNA, 7 bp, Unknown
  misc_feature (1)..( 7): Result.005 file - promoters50/1808549
tctttta

SEQ ID NO: 178189 - DNA, 7 bp, Unknown
  misc_feature (1)..( 7): Result.005 file - promoters50/1808549
acttttc

SEQ ID NO: 178190 - DNA, 10 bp, Unknown
  misc_feature (1)..( 10): Result.005 file - promoters50/1808549
aataactttg

SEQ ID NO: 178191 - DNA, 10 bp, Unknown
  misc_feature (1)..( 10): Result.005 file - promoters50/1808549
aataactaaa

SEQ ID NO: 178192 - DNA, 10 bp, Unknown
  misc_feature (1)..( 10): Result.005 file - promoters50/1808549
gttaacgaaa

SEQ ID NO: 178193 - DNA, 11 bp, Unknown
  misc_feature (1)..( 11): Result.005 file - promoters50/1808572
actaattaata

SEQ ID NO: 178194 - DNA, 11 bp, Unknown
  misc_feature (1)..( 11): Result.005 file - promoters50/1808572
actaatttgta

SEQ ID NO: 178195 - DNA, 11 bp, Unknown
  misc_feature (1)..( 11): Result.005 file - promoters50/1808572
aataattagta

SEQ ID NO: 178196 - DNA, 8 bp, Unknown
  misc_feature (1)..( 8): Result.005 file - promoters50/1808572
ataaatta

SEQ ID NO: 178197 - DNA, 8 bp, Unknown
  misc_feature (1)..( 8): Result.005 file - promoters50/1808572
gtaaatta

SEQ ID NO: 178198 - DNA, 8 bp, Unknown
  misc_feature (1)..( 8): Result.005 file - promoters50/1808572
gtaaataa

SEQ ID NO: 178199 - DNA, 7 bp, Unknown
  misc_feature (1)..( 7): Result.005 file - promoters50/1808572
aaaaaaa

SEQ ID NO: 178200 - DNA, 7 bp, Unknown
  misc_feature (1)..( 7): Result.005 file - promoters50/1808572
aaaaaaa

SEQ ID NO: 178201 - DNA, 7 bp, Unknown
  misc_feature (1)..( 7): Result.005 file - promoters50/1808572
aaaaaac

SEQ ID NO: 178202 - DNA, 9 bp, Unknown
  misc_feature (1)..( 9): Result.005 file - promoters50/1808572
ttattttat

SEQ ID NO: 178203 - DNA, 9 bp, Unknown
  misc_feature (1)..( 9): Result.005 file - promoters50/1808572
ttaatttat

SEQ ID NO: 178204 - DNA, 9 bp, Unknown
  misc_feature (1)..( 9): Result.005 file - promoters50/1808572
tttttttga

SEQ ID NO: 178205 - DNA, 8 bp, Unknown
  misc_feature (1)..( 8): Result.005 file - promoters50/1808572
taataaag

SEQ ID NO: 178206 - DNA, 8 bp, Unknown
  misc_feature (1)..( 8): Result.005 file - promoters50/1808572
atataaag

SEQ ID NO: 178207 - DNA, 8 bp, Unknown
  misc_feature (1)..( 8): Result.005 file - promoters50/1808572
atataaat

SEQ ID NO: 178208 - DNA, 8 bp, Unknown
  misc_feature (1)..( 8): Result.005 file - promoters50/1808635
tctcaatt

SEQ ID NO: 178209 - DNA, 8 bp, Unknown
  misc_feature (1)..( 8): Result.005 file - promoters50/1808635
tgtcaatt

SEQ ID NO: 178210 - DNA, 8 bp, Unknown
  misc_feature (1)..( 8): Result.005 file - promoters50/1808635
tgtgaatt

SEQ ID NO: 178211 - DNA, 9 bp, Unknown
  misc_feature (1)..( 9): Result.005 file - promoters50/1808696
cactagtta

SEQ ID NO: 178212 - DNA, 9 bp, Unknown
  misc_feature (1)..( 9): Result.005 file - promoters50/1808696
gactagtat

SEQ ID NO: 178213 - DNA, 9 bp, Unknown
  misc_feature (1)..( 9): Result.005 file - promoters50/1808696
gtctattat

SEQ ID NO: 178214 - DNA, 9 bp, Unknown
  misc_feature (1)..( 9): Result.005 file - promoters50/1808696
aattattac

SEQ ID NO: 178215 - DNA, 9 bp, Unknown
  misc_feature (1)..( 9): Result.005 file - promoters50/1808696
aattatgtt

SEQ ID NO: 178216 - DNA, 11 bp, Unknown
  misc_feature (1)..( 11): Result.005 file - promoters50/1808696
atacagatata

SEQ ID NO: 178217 - DNA, 11 bp, Unknown
  misc_feature (1)..( 11): Result.005 file - promoters50/1808696
cgatagatata

SEQ ID NO: 178218 - DNA, 11 bp, Unknown
  misc_feature (1)..( 11): Result.005 file - promoters50/1808696
gcatacaaata

SEQ ID NO: 178219 - DNA, 12 bp, Unknown
  misc_feature (1)..( 12): Result.005 file - promoters50/1808696
aaaaagaatagc

SEQ ID NO: 178220 - DNA, 12 bp, Unknown
  misc_feature (1)..( 12): Result.005 file - promoters50/1808696
tgtaataaaaag

SEQ ID NO: 178221 - DNA, 9 bp, Unknown
  misc_feature (1)..( 9): Result.005 file - promoters50/1808696
tataaggtt

SEQ ID NO: 178222 - DNA, 9 bp, Unknown
  misc_feature (1)..( 9): Result.005 file - promoters50/1808696
cttaacgtt

SEQ ID NO: 178223 - DNA, 8 bp, Unknown
  misc_feature (1)..( 8): Result.005 file - promoters50/1808696
atacggtg

SEQ ID NO: 178224 - DNA, 9 bp, Unknown
  misc_feature (1)..( 9): Result.005 file - promoters50/1808696
tctaaagtt

SEQ ID NO: 178225 - DNA, 9 bp, Unknown
  misc_feature (1)..( 9): Result.005 file - promoters50/1808696
atcaaaaga

SEQ ID NO: 178226 - DNA, 9 bp, Unknown
  misc_feature (1)..( 9): Result.005 file - promoters50/1808753
tataaacaa

SEQ ID NO: 178227 - DNA, 9 bp, Unknown
  misc_feature (1)..( 9): Result.005 file - promoters50/1808753
tgtaatcaa

SEQ ID NO: 178228 - DNA, 9 bp, Unknown
  misc_feature (1)..( 9): Result.005 file - promoters50/1808753
aaaaaacaa

SEQ ID NO: 178229 - DNA, 6 bp, Unknown
  misc_feature (1)..( 6): Result.005 file - promoters50/1808753
acatac

SEQ ID NO: 178230 - DNA, 6 bp, Unknown
  misc_feature (1)..( 6): Result.005 file - promoters50/1808753
acatac

SEQ ID NO: 178231 - DNA, 6 bp, Unknown
  misc_feature (1)..( 6): Result.005 file - promoters50/1808753
acatac

SEQ ID NO: 178232 - DNA, 8 bp, Unknown
  misc_feature (1)..( 8): Result.005 file - promoters50/1809003
catttttt

SEQ ID NO: 178233 - DNA, 8 bp, Unknown
  misc_feature (1)..( 8): Result.005 file - promoters50/1809003
aatttttc

SEQ ID NO: 178234 - DNA, 8 bp, Unknown
  misc_feature (1)..( 8): Result.005 file - promoters50/1809003
catttttt

SEQ ID NO: 178235 - DNA, 16 bp, Unknown
  misc_feature (1)..( 16): Result.005 file - promoters50/1809088
tcaaaacttaatttat

SEQ ID NO: 178236 - DNA, 16 bp, Unknown
  misc_feature (1)..( 16): Result.005 file - promoters50/1809088
aacaaaattataaaat

SEQ ID NO: 178237 - DNA, 16 bp, Unknown
  misc_feature (1)..( 16): Result.005 file - promoters50/1809088
ggccaaagtatgaaat

SEQ ID NO: 178238 - DNA, 16 bp, Unknown
  misc_feature (1)..( 16): Result.005 file - promoters50/1809088
aacacaatgtcgattt

SEQ ID NO: 178239 - DNA, 16 bp, Unknown
  misc_feature (1)..( 16): Result.005 file - promoters50/1809088
tatcaaactattttca

SEQ ID NO: 178240 - DNA, 14 bp, Unknown
  misc_feature (1)..( 14): Result.005 file - promoters50/1809088
tgatttttacatat

SEQ ID NO: 178241 - DNA, 14 bp, Unknown
  misc_feature (1)..( 14): Result.005 file - promoters50/1809088
ggattttcacaaac

SEQ ID NO: 178242 - DNA, 14 bp, Unknown
  misc_feature (1)..( 14): Result.005 file - promoters50/1809088
tgatttttacatat

SEQ ID NO: 178243 - DNA, 14 bp, Unknown
  misc_feature (1)..( 14): Result.005 file - promoters50/1809088
tcaccttcacaggt

SEQ ID NO: 178244 - DNA, 12 bp, Unknown
  misc_feature (1)..( 12): Result.005 file - promoters50/1809088
tcatccattcat

SEQ ID NO: 178245 - DNA, 12 bp, Unknown
  misc_feature (1)..( 12): Result.005 file - promoters50/1809088
tcagccattcgt

SEQ ID NO: 178246 - DNA, 12 bp, Unknown
  misc_feature (1)..( 12): Result.005 file - promoters50/1809088
ctttccatacat

SEQ ID NO: 178247 - DNA, 12 bp, Unknown
  misc_feature (1)..( 12): Result.005 file - promoters50/1809088
acgtacatataa

SEQ ID NO: 178248 - DNA, 17 bp, Unknown
  misc_feature (1)..( 17): Result.005 file - promoters50/1809088
aaatcttttatatatac

SEQ ID NO: 178249 - DNA, 17 bp, Unknown
  misc_feature (1)..( 17): Result.005 file - promoters50/1809088
aaagcttctatataaac

SEQ ID NO: 178250 - DNA, 17 bp, Unknown
  misc_feature (1)..( 17): Result.005 file - promoters50/1809088
gaagcttagggtttttg

SEQ ID NO: 178251 - DNA, 17 bp, Unknown
  misc_feature (1)..( 17): Result.005 file - promoters50/1809088
tttatcattatttaaac

SEQ ID NO: 178252 - DNA, 18 bp, Unknown
  misc_feature (1)..( 18): Result.005 file - promoters50/1809157
atttgtacaaaacataga

SEQ ID NO: 178253 - DNA, 18 bp, Unknown
  misc_feature (1)..( 18): Result.005 file - promoters50/1809157
aaacaaacaaaaaatgat

SEQ ID NO: 178254 - DNA, 18 bp, Unknown
  misc_feature (1)..( 18): Result.005 file - promoters50/1809157
tgttcaacacaaattttt

SEQ ID NO: 178255 - DNA, 18 bp, Unknown
  misc_feature (1)..( 18): Result.005 file - promoters50/1809157
attgttacaaatctatcc

SEQ ID NO: 178256 - DNA, 18 bp, Unknown
  misc_feature (1)..( 18): Result.005 file - promoters50/1809157
gttagttcaaaaaaaaaa

SEQ ID NO: 178257 - DNA, 18 bp, Unknown
  misc_feature (1)..( 18): Result.005 file - promoters50/1809157
atgtttccaaaatatctt

SEQ ID NO: 178258 - DNA, 13 bp, Unknown
  misc_feature (1)..( 13): Result.005 file - promoters50/1809157
ataaaaccaagac

SEQ ID NO: 178259 - DNA, 13 bp, Unknown
  misc_feature (1)..( 13): Result.005 file - promoters50/1809157
aagaaacaaagta

SEQ ID NO: 178260 - DNA, 13 bp, Unknown
  misc_feature (1)..( 13): Result.005 file - promoters50/1809157
cagacaccaagac

SEQ ID NO: 178261 - DNA, 13 bp, Unknown
  misc_feature (1)..( 13): Result.005 file - promoters50/1809157
tccaaacaaaaca

SEQ ID NO: 178262 - DNA, 13 bp, Unknown
  misc_feature (1)..( 13): Result.005 file - promoters50/1809157
gccaaacaacatt

SEQ ID NO: 178263 - DNA, 13 bp, Unknown
  misc_feature (1)..( 13): Result.005 file - promoters50/1809157
aagaaaaaaaaaa

SEQ ID NO: 178264 - DNA, 11 bp, Unknown
  misc_feature (1)..( 11): Result.005 file - promoters50/1809233
taaaatttcgc

SEQ ID NO: 178265 - DNA, 11 bp, Unknown
  misc_feature (1)..( 11): Result.005 file - promoters50/1809233
taatattaaga

SEQ ID NO: 178266 - DNA, 11 bp, Unknown
  misc_feature (1)..( 11): Result.005 file - promoters50/1809233
agaaattgcgc

SEQ ID NO: 178267 - DNA, 11 bp, Unknown
  misc_feature (1)..( 11): Result.005 file - promoters50/1809233
taatcttagaa

SEQ ID NO: 178268 - DNA, 11 bp, Unknown
  misc_feature (1)..( 11): Result.005 file - promoters50/1809233
ctgaattgcaa

SEQ ID NO: 178269 - DNA, 11 bp, Unknown
  misc_feature (1)..( 11): Result.005 file - promoters50/1809233
gcgaatttgat

SEQ ID NO: 178270 - DNA, 12 bp, Unknown
  misc_feature (1)..( 12): Result.005 file - promoters50/1809233
ttacttcttata

SEQ ID NO: 178271 - DNA, 12 bp, Unknown
  misc_feature (1)..( 12): Result.005 file - promoters50/1809233
ttaattctcagc

SEQ ID NO: 178272 - DNA, 12 bp, Unknown
  misc_feature (1)..( 12): Result.005 file - promoters50/1809233
gatcttcttata

SEQ ID NO: 178273 - DNA, 12 bp, Unknown
  misc_feature (1)..( 12): Result.005 file - promoters50/1809233
ttagatcgtacc

SEQ ID NO: 178274 - DNA, 12 bp, Unknown
  misc_feature (1)..( 12): Result.005 file - promoters50/1809233
catcttctaaaa

SEQ ID NO: 178275 - DNA, 12 bp, Unknown
  misc_feature (1)..( 12): Result.005 file - promoters50/1809233
ttaattgtattt

SEQ ID NO: 178276 - DNA, 10 bp, Unknown
  misc_feature (1)..( 10): Result.005 file - promoters50/1809235
aatgaattta

SEQ ID NO: 178277 - DNA, 10 bp, Unknown
  misc_feature (1)..( 10): Result.005 file - promoters50/1809235
aatgaattta

SEQ ID NO: 178278 - DNA, 7 bp, Unknown
  misc_feature (1)..( 7): Result.005 file - promoters50/1809235
gaaatta

SEQ ID NO: 178279 - DNA, 11 bp, Unknown
  misc_feature (1)..( 11): Result.005 file - promoters50/1809235
ttgaaaaattg

SEQ ID NO: 178280 - DNA, 11 bp, Unknown
  misc_feature (1)..( 11): Result.005 file - promoters50/1809235
ttgataaatgc

SEQ ID NO: 178281 - DNA, 11 bp, Unknown
  misc_feature (1)..( 11): Result.005 file - promoters50/1809235
agctaaaattg

SEQ ID NO: 178282 - DNA, 10 bp, Unknown
  misc_feature (1)..( 10): Result.005 file - promoters50/1809243
aaattaattt

SEQ ID NO: 178283 - DNA, 10 bp, Unknown
  misc_feature (1)..( 10): Result.005 file - promoters50/1809243
aaattagaac

SEQ ID NO: 178284 - DNA, 10 bp, Unknown
  misc_feature (1)..( 10): Result.005 file - promoters50/1809243
taattaattt

SEQ ID NO: 178285 - DNA, 10 bp, Unknown
  misc_feature (1)..( 10): Result.005 file - promoters50/1809243
caatgaatgg

SEQ ID NO: 178286 - DNA, 8 bp, Unknown
  misc_feature (1)..( 8): Result.005 file - promoters50/1809243
tcaatttt

SEQ ID NO: 178287 - DNA, 8 bp, Unknown
  misc_feature (1)..( 8): Result.005 file - promoters50/1809243
acaaattt

SEQ ID NO: 178288 - DNA, 8 bp, Unknown
  misc_feature (1)..( 8): Result.005 file - promoters50/1809243
acacattc

SEQ ID NO: 178289 - DNA, 8 bp, Unknown
  misc_feature (1)..( 8): Result.005 file - promoters50/1809243
acaaatct

SEQ ID NO: 178290 - DNA, 10 bp, Unknown
  misc_feature (1)..( 10): Result.005 file - promoters50/1809253
aataacaata

SEQ ID NO: 178291 - DNA, 10 bp, Unknown
  misc_feature (1)..( 10): Result.005 file - promoters50/1809253
aattacaaaa

SEQ ID NO: 178292 - DNA, 10 bp, Unknown
  misc_feature (1)..( 10): Result.005 file - promoters50/1809253
ttttagaaaa

SEQ ID NO: 178293 - DNA, 10 bp, Unknown
  misc_feature (1)..( 10): Result.005 file - promoters50/1809253
gatttcaaat

SEQ ID NO: 178294 - DNA, 10 bp, Unknown
  misc_feature (1)..( 10): Result.005 file - promoters50/1809253
gatttccggt

SEQ ID NO: 178295 - DNA, 12 bp, Unknown
  misc_feature (1)..( 12): Result.005 file - promoters50/1809253
taataaaaacaa

SEQ ID NO: 178296 - DNA, 12 bp, Unknown
  misc_feature (1)..( 12): Result.005 file - promoters50/1809253
aaataaaagcaa

SEQ ID NO: 178297 - DNA, 12 bp, Unknown
  misc_feature (1)..( 12): Result.005 file - promoters50/1809253
aaatgaaattta

SEQ ID NO: 178298 - DNA, 12 bp, Unknown
  misc_feature (1)..( 12): Result.005 file - promoters50/1809253
taataaaatccc

SEQ ID NO: 178299 - DNA, 12 bp, Unknown
  misc_feature (1)..( 12): Result.005 file - promoters50/1809253
taatatcgaatg

SEQ ID NO: 178300 - DNA, 12 bp, Unknown
  misc_feature (1)..( 12): Result.005 file - promoters50/1809253
aactgaaatttg

SEQ ID NO: 178301 - DNA, 7 bp, Unknown
  misc_feature (1)..( 7): Result.005 file - promoters50/1809253
atatatt

SEQ ID NO: 178302 - DNA, 7 bp, Unknown
  misc_feature (1)..( 7): Result.005 file - promoters50/1809253
atatata

SEQ ID NO: 178303 - DNA, 7 bp, Unknown
  misc_feature (1)..( 7): Result.005 file - promoters50/1809253
ttatatt

SEQ ID NO: 178304 - DNA, 7 bp, Unknown
  misc_feature (1)..( 7): Result.005 file - promoters50/1809253
ataaata

SEQ ID NO: 178305 - DNA, 7 bp, Unknown
  misc_feature (1)..( 7): Result.005 file - promoters50/1809253
ttatatc

SEQ ID NO: 178306 - DNA, 9 bp, Unknown
  misc_feature (1)..( 9): Result.005 file - promoters50/1809253
catcgtttg

SEQ ID NO: 178307 - DNA, 9 bp, Unknown
  misc_feature (1)..( 9): Result.005 file - promoters50/1809253
attcgtttc

SEQ ID NO: 178308 - DNA, 9 bp, Unknown
  misc_feature (1)..( 9): Result.005 file - promoters50/1809253
tttcgttat

SEQ ID NO: 178309 - DNA, 9 bp, Unknown
  misc_feature (1)..( 9): Result.005 file - promoters50/1809253
attagtttc

SEQ ID NO: 178310 - DNA, 9 bp, Unknown
  misc_feature (1)..( 9): Result.005 file - promoters50/1809253
attagtcta

SEQ ID NO: 178311 - DNA, 9 bp, Unknown
  misc_feature (1)..( 9): Result.005 file - promoters50/1809253
attagtagg

SEQ ID NO: 178312 - DNA, 9 bp, Unknown
  misc_feature (1)..( 9): Result.005 file - promoters50/1809253
attagtcta

SEQ ID NO: 178313 - DNA, 9 bp, Unknown
  misc_feature (1)..( 9): Result.005 file - promoters50/1809253
attagtttc

SEQ ID NO: 178314 - DNA, 9 bp, Unknown
  misc_feature (1)..( 9): Result.005 file - promoters50/1809253
attcgtttc

SEQ ID NO: 178315 - DNA, 9 bp, Unknown
  misc_feature (1)..( 9): Result.005 file - promoters50/1809253
cttaattta

SEQ ID NO: 178316 - DNA, 9 bp, Unknown
  misc_feature (1)..( 9): Result.005 file - promoters50/1820893
ggttggttt

SEQ ID NO: 178317 - DNA, 9 bp, Unknown
  misc_feature (1)..( 9): Result.005 file - promoters50/1820893
ttttgtttt

SEQ ID NO: 178318 - DNA, 9 bp, Unknown
  misc_feature (1)..( 9): Result.005 file - promoters50/1820893
ttttgttga

SEQ ID NO: 178319 - DNA, 9 bp, Unknown
  misc_feature (1)..( 9): Result.005 file - promoters50/1820893
cttttattc

SEQ ID NO: 178320 - DNA, 9 bp, Unknown
  misc_feature (1)..( 9): Result.005 file - promoters50/1820893
gaattattc

SEQ ID NO: 178321 - DNA, 9 bp, Unknown
  misc_feature (1)..( 9): Result.005 file - promoters50/1820893
cttttattt

SEQ ID NO: 178322 - DNA, 11 bp, Unknown
  misc_feature (1)..( 11): Result.005 file - promoters50/1830195
caatgaactct

SEQ ID NO: 178323 - DNA, 11 bp, Unknown
  misc_feature (1)..( 11): Result.005 file - promoters50/1830195
atatgaaccat

SEQ ID NO: 178324 - DNA, 11 bp, Unknown
  misc_feature (1)..( 11): Result.005 file - promoters50/1830195
caaggaaagaa

SEQ ID NO: 178325 - DNA, 11 bp, Unknown
  misc_feature (1)..( 11): Result.005 file - promoters50/1830195
agaagaaaatg

SEQ ID NO: 178326 - DNA, 11 bp, Unknown
  misc_feature (1)..( 11): Result.005 file - promoters50/1830195
taagtaaacat

SEQ ID NO: 178327 - DNA, 11 bp, Unknown
  misc_feature (1)..( 11): Result.005 file - promoters50/1830195
taaagaaaaag

SEQ ID NO: 178328 - DNA, 11 bp, Unknown
  misc_feature (1)..( 11): Result.005 file - promoters50/1830195
ctcagaataag

SEQ ID NO: 178329 - DNA, 11 bp, Unknown
  misc_feature (1)..( 11): Result.005 file - promoters50/1830195
cttctatatat

SEQ ID NO: 178330 - DNA, 11 bp, Unknown
  misc_feature (1)..( 11): Result.005 file - promoters50/1830195
ttcctatatat

SEQ ID NO: 178331 - DNA, 11 bp, Unknown
  misc_feature (1)..( 11): Result.005 file - promoters50/1830195
tgtctatatat

SEQ ID NO: 178332 - DNA, 11 bp, Unknown
  misc_feature (1)..( 11): Result.005 file - promoters50/1830195
ctcttatatat

SEQ ID NO: 178333 - DNA, 11 bp, Unknown
  misc_feature (1)..( 11): Result.005 file - promoters50/1830195
ctcctataaat

SEQ ID NO: 178334 - DNA, 11 bp, Unknown
  misc_feature (1)..( 11): Result.005 file - promoters50/1830195
ttcctttatat

SEQ ID NO: 178335 - DNA, 7 bp, Unknown
  misc_feature (1)..( 7): Result.005 file - promoters50/1837627
gattttt

SEQ ID NO: 178336 - DNA, 7 bp, Unknown
  misc_feature (1)..( 7): Result.005 file - promoters50/1837627
gatttta

SEQ ID NO: 178337 - DNA, 7 bp, Unknown
  misc_feature (1)..( 7): Result.005 file - promoters50/1837627
aattttt

SEQ ID NO: 178338 - DNA, 12 bp, Unknown
  misc_feature (1)..( 12): Result.005 file - promoters50/1837627
tgtttttttata

SEQ ID NO: 178339 - DNA, 12 bp, Unknown
  misc_feature (1)..( 12): Result.005 file - promoters50/1837627
acggattttatt

SEQ ID NO: 178340 - DNA, 12 bp, Unknown
  misc_feature (1)..( 12): Result.005 file - promoters50/1837627
tttttttttaaa

SEQ ID NO: 178341 - DNA, 11 bp, Unknown
  misc_feature (1)..( 11): Result.005 file - promoters50/1837627
aaaataataat

SEQ ID NO: 178342 - DNA, 11 bp, Unknown
  misc_feature (1)..( 11): Result.005 file - promoters50/1837627
caaatattaat

SEQ ID NO: 178343 - DNA, 11 bp, Unknown
  misc_feature (1)..( 11): Result.005 file - promoters50/1837627
aaaataaatac

SEQ ID NO: 178344 - DNA, 9 bp, Unknown
  misc_feature (1)..( 9): Result.005 file - promoters50/1837627
aaacaaaaa

SEQ ID NO: 178345 - DNA, 9 bp, Unknown
  misc_feature (1)..( 9): Result.005 file - promoters50/1837627
aaacaaaaa

SEQ ID NO: 178346 - DNA, 9 bp, Unknown
  misc_feature (1)..( 9): Result.005 file - promoters50/1837627
ggccaaaaa

SEQ ID NO: 178347 - DNA, 8 bp, Unknown
  misc_feature (1)..( 8): Result.005 file - promoters50/1837627
ataatatt

SEQ ID NO: 178348 - DNA, 8 bp, Unknown
  misc_feature (1)..( 8): Result.005 file - promoters50/1837627
ataaaatt

SEQ ID NO: 178349 - DNA, 8 bp, Unknown
  misc_feature (1)..( 8): Result.005 file - promoters50/1837627
ctaaaata

SEQ ID NO: 178350 - DNA, 7 bp, Unknown
  misc_feature (1)..( 7): Result.005 file - promoters50/1920394
aatgtta

SEQ ID NO: 178351 - DNA, 7 bp, Unknown
  misc_feature (1)..( 7): Result.005 file - promoters50/1920394
tatgtta

SEQ ID NO: 178352 - DNA, 7 bp, Unknown
  misc_feature (1)..( 7): Result.005 file - promoters50/1920394
aatctta

SEQ ID NO: 178353 - DNA, 10 bp, Unknown
  misc_feature (1)..( 10): Result.005 file - promoters50/1920394
gatcaatgtg

SEQ ID NO: 178354 - DNA, 10 bp, Unknown
  misc_feature (1)..( 10): Result.005 file - promoters50/1920394
ttttaatgtg

SEQ ID NO: 178355 - DNA, 10 bp, Unknown
  misc_feature (1)..( 10): Result.005 file - promoters50/1920394
ttttcatgta

SEQ ID NO: 178356 - DNA, 10 bp, Unknown
  misc_feature (1)..( 10): Result.005 file - promoters50/1920394
gttataagac

SEQ ID NO: 178357 - DNA, 10 bp, Unknown
  misc_feature (1)..( 10): Result.005 file - promoters50/1920394
gttttaatgt

SEQ ID NO: 178358 - DNA, 10 bp, Unknown
  misc_feature (1)..( 10): Result.005 file - promoters50/1920394
attttcatgt

SEQ ID NO: 178359 - DNA, 12 bp, Unknown
  misc_feature (1)..( 12): Result.005 file - promoters50/1920394
ccaagttttatt

SEQ ID NO: 178360 - DNA, 12 bp, Unknown
  misc_feature (1)..( 12): Result.005 file - promoters50/1920394
ccaatttttatt

SEQ ID NO: 178361 - DNA, 12 bp, Unknown
  misc_feature (1)..( 12): Result.005 file - promoters50/1920394
aagagttttacg

SEQ ID NO: 178362 - DNA, 11 bp, Unknown
  misc_feature (1)..( 11): Result.005 file - promoters50/1920394
agttttcgaat

SEQ ID NO: 178363 - DNA, 11 bp, Unknown
  misc_feature (1)..( 11): Result.005 file - promoters50/1920394
aatttttgaat

SEQ ID NO: 178364 - DNA, 11 bp, Unknown
  misc_feature (1)..( 11): Result.005 file - promoters50/1920394
aatttttataa

SEQ ID NO: 178365 - DNA, 8 bp, Unknown
  misc_feature (1)..( 8): Result.005 file - promoters50/1920394
ataatttc

SEQ ID NO: 178366 - DNA, 8 bp, Unknown
  misc_feature (1)..( 8): Result.005 file - promoters50/1920394
ataattaa

SEQ ID NO: 178367 - DNA, 8 bp, Unknown
  misc_feature (1)..( 8): Result.005 file - promoters50/1920394
ataagtaa

SEQ ID NO: 178368 - DNA, 7 bp, Unknown
  misc_feature (1)..( 7): Result.005 file - promoters50/1920394
ttaaaag

SEQ ID NO: 178369 - DNA, 7 bp, Unknown
  misc_feature (1)..( 7): Result.005 file - promoters50/1920394
ttaaaaa

SEQ ID NO: 178370 - DNA, 8 bp, Unknown
  misc_feature (1)..( 8): Result.005 file - promoters50/1920394
ttataaat

SEQ ID NO: 178371 - DNA, 8 bp, Unknown
  misc_feature (1)..( 8): Result.005 file - promoters50/1920394
aaactaga

SEQ ID NO: 178372 - DNA, 8 bp, Unknown
  misc_feature (1)..( 8): Result.005 file - promoters50/1920394
aaactatt

SEQ ID NO: 178373 - DNA, 8 bp, Unknown
  misc_feature (1)..( 8): Result.005 file - promoters50/1920394
taaccatt

SEQ ID NO: 178374 - DNA, 11 bp, Unknown
  misc_feature (1)..( 11): Result.005 file - promoters50/1921363
caattttctca

SEQ ID NO: 178375 - DNA, 11 bp, Unknown
  misc_feature (1)..( 11): Result.005 file - promoters50/1921363
ttcatttttca

SEQ ID NO: 178376 - DNA, 11 bp, Unknown
  misc_feature (1)..( 11): Result.005 file - promoters50/1921363
catatttttgc

SEQ ID NO: 178377 - DNA, 11 bp, Unknown
  misc_feature (1)..( 11): Result.005 file - promoters50/1921363
atagtttgtgt

SEQ ID NO: 178378 - DNA, 10 bp, Unknown
  misc_feature (1)..( 10): Result.005 file - promoters50/1921363
atttaatact

SEQ ID NO: 178379 - DNA, 10 bp, Unknown
  misc_feature (1)..( 10): Result.005 file - promoters50/1921363
tgttaatata

SEQ ID NO: 178380 - DNA, 10 bp, Unknown
  misc_feature (1)..( 10): Result.005 file - promoters50/1921363
gttttatatt

SEQ ID NO: 178381 - DNA, 10 bp, Unknown
  misc_feature (1)..( 10): Result.005 file - promoters50/1921363
tttttattga

SEQ ID NO: 178382 - DNA, 10 bp, Unknown
  misc_feature (1)..( 10): Result.005 file - promoters50/1921363
tattaaaata

SEQ ID NO: 178383 - DNA, 9 bp, Unknown
  misc_feature (1)..( 9): Result.005 file - promoters50/1921363
cggaaaata

SEQ ID NO: 178384 - DNA, 9 bp, Unknown
  misc_feature (1)..( 9): Result.005 file - promoters50/1921363
cagaaaata

SEQ ID NO: 178385 - DNA, 9 bp, Unknown
  misc_feature (1)..( 9): Result.005 file - promoters50/1921363
tagaaaagt

SEQ ID NO: 178386 - DNA, 9 bp, Unknown
  misc_feature (1)..( 9): Result.005 file - promoters50/1921363
tagaaaact

SEQ ID NO: 178387 - DNA, 13 bp, Unknown
  misc_feature (1)..( 13): Result.005 file - promoters50/1921363
tttttattgaaat

SEQ ID NO: 178388 - DNA, 13 bp, Unknown
  misc_feature (1)..( 13): Result.005 file - promoters50/1921363
aatatatagaaat

SEQ ID NO: 178389 - DNA, 13 bp, Unknown
  misc_feature (1)..( 13): Result.005 file - promoters50/1921363
tacatattaaaat

SEQ ID NO: 178390 - DNA, 13 bp, Unknown
  misc_feature (1)..( 13): Result.005 file - promoters50/1921363
tttatattgtttg

SEQ ID NO: 178391 - DNA, 10 bp, Unknown
  misc_feature (1)..( 10): Result.005 file - promoters50/1923743
tttcaaaatg

SEQ ID NO: 178392 - DNA, 10 bp, Unknown
  misc_feature (1)..( 10): Result.005 file - promoters50/1923743
attcgaaaga

SEQ ID NO: 178393 - DNA, 10 bp, Unknown
  misc_feature (1)..( 10): Result.005 file - promoters50/1923743
tttccaaaga

SEQ ID NO: 178394 - DNA, 10 bp, Unknown
  misc_feature (1)..( 10): Result.005 file - promoters50/1923743
gttcataatt

SEQ ID NO: 178395 - DNA, 10 bp, Unknown
  misc_feature (1)..( 10): Result.005 file - promoters50/1923743
ttcaataatt

SEQ ID NO: 178396 - DNA, 14 bp, Unknown
  misc_feature (1)..( 14): Result.005 file - promoters50/1957018
tttatatattttta

SEQ ID NO: 178397 - DNA, 14 bp, Unknown
  misc_feature (1)..( 14): Result.005 file - promoters50/1957018
aactaggattctta

SEQ ID NO: 178398 - DNA, 14 bp, Unknown
  misc_feature (1)..( 14): Result.005 file - promoters50/1957018
tttatatattttgt

SEQ ID NO: 178399 - DNA, 14 bp, Unknown
  misc_feature (1)..( 14): Result.005 file - promoters50/1957018
accatggatgcttt

SEQ ID NO: 178400 - DNA, 14 bp, Unknown
  misc_feature (1)..( 14): Result.005 file - promoters50/1957018
tagtaagattctag

SEQ ID NO: 178401 - DNA, 14 bp, Unknown
  misc_feature (1)..( 14): Result.005 file - promoters50/1957018
tagtaagattctag

SEQ ID NO: 178402 - DNA, 8 bp, Unknown
  misc_feature (1)..( 8): Result.005 file - promoters50/1957094
cggcaaaa

SEQ ID NO: 178403 - DNA, 8 bp, Unknown
  misc_feature (1)..( 8): Result.005 file - promoters50/1957094
cggcaaat

SEQ ID NO: 178404 - DNA, 8 bp, Unknown
  misc_feature (1)..( 8): Result.005 file - promoters50/1957094
tggcaaat

SEQ ID NO: 178405 - DNA, 9 bp, Unknown
  misc_feature (1)..( 9): Result.005 file - promoters50/1957212
tcgagaaac

SEQ ID NO: 178406 - DNA, 9 bp, Unknown
  misc_feature (1)..( 9): Result.005 file - promoters50/1957212
tggagaaag

SEQ ID NO: 178407 - DNA, 9 bp, Unknown
  misc_feature (1)..( 9): Result.005 file - promoters50/1957212
tcgtgaaca

SEQ ID NO: 178408 - DNA, 9 bp, Unknown
  misc_feature (1)..( 9): Result.005 file - promoters50/1957212
cagagactt

SEQ ID NO: 178409 - DNA, 9 bp, Unknown
  misc_feature (1)..( 9): Result.005 file - promoters50/1957212
aagagagat

SEQ ID NO: 178410 - DNA, 9 bp, Unknown
  misc_feature (1)..( 9): Result.005 file - promoters50/1957212
ctaagaaag

SEQ ID NO: 178411 - DNA, 9 bp, Unknown
  misc_feature (1)..( 9): Result.005 file - promoters50/1957212
gtaataaat

SEQ ID NO: 178412 - DNA, 10 bp, Unknown
  misc_feature (1)..( 10): Result.005 file - promoters50/1957212
ggagacagag

SEQ ID NO: 178413 - DNA, 10 bp, Unknown
  misc_feature (1)..( 10): Result.005 file - promoters50/1957212
ggaaacatat

SEQ ID NO: 178414 - DNA, 10 bp, Unknown
  misc_feature (1)..( 10): Result.005 file - promoters50/1957212
agaaagaatc

SEQ ID NO: 178415 - DNA, 10 bp, Unknown
  misc_feature (1)..( 10): Result.005 file - promoters50/1957212
agacagacag

SEQ ID NO: 178416 - DNA, 10 bp, Unknown
  misc_feature (1)..( 10): Result.005 file - promoters50/1957212
taaaacgaca

SEQ ID NO: 178417 - DNA, 10 bp, Unknown
  misc_feature (1)..( 10): Result.005 file - promoters50/1957212
gcaaccacag

SEQ ID NO: 178418 - DNA, 10 bp, Unknown
  misc_feature (1)..( 10): Result.005 file - promoters50/1957212
ccaaaaaaat

SEQ ID NO: 178419 - DNA, 9 bp, Unknown
  misc_feature (1)..( 9): Result.005 file - promoters50/1957241
caaactaaa

SEQ ID NO: 178420 - DNA, 9 bp, Unknown
  misc_feature (1)..( 9): Result.005 file - promoters50/1957241
caagctaga

SEQ ID NO: 178421 - DNA, 9 bp, Unknown
  misc_feature (1)..( 9): Result.005 file - promoters50/1957241
taaacaaaa

SEQ ID NO: 178422 - DNA, 8 bp, Unknown
  misc_feature (1)..( 8): Result.005 file - promoters50/1957241
cttacaaa

SEQ ID NO: 178423 - DNA, 8 bp, Unknown
  misc_feature (1)..( 8): Result.005 file - promoters50/1957241
cttacatt

SEQ ID NO: 178424 - DNA, 8 bp, Unknown
  misc_feature (1)..( 8): Result.005 file - promoters50/1957241
gttagaaa

SEQ ID NO: 178425 - DNA, 19 bp, Unknown
  misc_feature (1)..( 19): Result.005 file - promoters50/1957245
aaaagtagtattttcacta

SEQ ID NO: 178426 - DNA, 19 bp, Unknown
  misc_feature (1)..( 19): Result.005 file - promoters50/1957245
taagagagtatttatttct

SEQ ID NO: 178427 - DNA, 19 bp, Unknown
  misc_feature (1)..( 19): Result.005 file - promoters50/1957245
aaaggtagtttttcaaaaa

SEQ ID NO: 178428 - DNA, 19 bp, Unknown
  misc_feature (1)..( 19): Result.005 file - promoters50/1957245
cagactggtaattatctct

SEQ ID NO: 178429 - DNA, 10 bp, Unknown
  misc_feature (1)..( 10): Result.005 file - promoters50/1957245
gaaataaaat

SEQ ID NO: 178430 - DNA, 10 bp, Unknown
  misc_feature (1)..( 10): Result.005 file - promoters50/1957245
taaatgaaat

SEQ ID NO: 178431 - DNA, 10 bp, Unknown
  misc_feature (1)..( 10): Result.005 file - promoters50/1957245
aaaatggcaa

SEQ ID NO: 178432 - DNA, 10 bp, Unknown
  misc_feature (1)..( 10): Result.005 file - promoters50/1957245
aaaatggtta

SEQ ID NO: 178433 - DNA, 11 bp, Unknown
  misc_feature (1)..( 11): Result.005 file - promoters50/1957245
agagaaacact

SEQ ID NO: 178434 - DNA, 11 bp, Unknown
  misc_feature (1)..( 11): Result.005 file - promoters50/1957245
tcagaaacaga

SEQ ID NO: 178435 - DNA, 11 bp, Unknown
  misc_feature (1)..( 11): Result.005 file - promoters50/1957245
tcaaaaattta

SEQ ID NO: 178436 - DNA, 11 bp, Unknown
  misc_feature (1)..( 11): Result.005 file - promoters50/1957245
ataaaaataga

SEQ ID NO: 178437 - DNA, 11 bp, Unknown
  misc_feature (1)..( 11): Result.005 file - promoters50/1957245
ataaaagtagt

SEQ ID NO: 178438 - DNA, 11 bp, Unknown
  misc_feature (1)..( 11): Result.005 file - promoters50/1957245
ataaaaataga

SEQ ID NO: 178439 - DNA, 11 bp, Unknown
  misc_feature (1)..( 11): Result.005 file - promoters50/1957245
tcagaaacaga

SEQ ID NO: 178440 - DNA, 11 bp, Unknown
  misc_feature (1)..( 11): Result.005 file - promoters50/1957245
tcaaaaattta

SEQ ID NO: 178441 - DNA, 12 bp, Unknown
  misc_feature (1)..( 12): Result.005 file - promoters50/1957245
taaaagatcggt

SEQ ID NO: 178442 - DNA, 12 bp, Unknown
  misc_feature (1)..( 12): Result.005 file - promoters50/1957245
ctctagatcgat

SEQ ID NO: 178443 - DNA, 12 bp, Unknown
  misc_feature (1)..( 12): Result.005 file - promoters50/1957245
acgcagatagat

SEQ ID NO: 178444 - DNA, 12 bp, Unknown
  misc_feature (1)..( 12): Result.005 file - promoters50/1957245
acgcacatagaa

SEQ ID NO: 178445 - DNA, 7 bp, Unknown
  misc_feature (1)..( 7): Result.005 file - promoters50/1957296
caagaaa

SEQ ID NO: 178446 - DNA, 7 bp, Unknown
  misc_feature (1)..( 7): Result.005 file - promoters50/1957296
aaagaaa

SEQ ID NO: 178447 - DNA, 7 bp, Unknown
  misc_feature (1)..( 7): Result.005 file - promoters50/1957296
aaaggaa

SEQ ID NO: 178448 - DNA, 8 bp, Unknown
  misc_feature (1)..( 8): Result.005 file - promoters50/1957303
aaacgaaa

SEQ ID NO: 178449 - DNA, 8 bp, Unknown
  misc_feature (1)..( 8): Result.005 file - promoters50/1957303
aaacgact

SEQ ID NO: 178450 - DNA, 8 bp, Unknown
  misc_feature (1)..( 8): Result.005 file - promoters50/1957303
aaaagaaa

SEQ ID NO: 178451 - DNA, 8 bp, Unknown
  misc_feature (1)..( 8): Result.005 file - promoters50/1957303
gaagaaag

SEQ ID NO: 178452 - DNA, 8 bp, Unknown
  misc_feature (1)..( 8): Result.005 file - promoters50/1957303
ttagaaag

SEQ ID NO: 178453 - DNA, 8 bp, Unknown
  misc_feature (1)..( 8): Result.005 file - promoters50/1957303
gaagaaaa

SEQ ID NO: 178454 - DNA, 14 bp, Unknown
  misc_feature (1)..( 14): Result.005 file - promoters50/1957303
agaagcaaatcgaa

SEQ ID NO: 178455 - DNA, 14 bp, Unknown
  misc_feature (1)..( 14): Result.005 file - promoters50/1957303
ttataaaaattgaa

SEQ ID NO: 178456 - DNA, 14 bp, Unknown
  misc_feature (1)..( 14): Result.005 file - promoters50/1957303
agaagaaaatcccg

SEQ ID NO: 178457 - DNA, 8 bp, Unknown
  misc_feature (1)..( 8): Result.005 file - promoters50/1957303
ttttaaag

SEQ ID NO: 178458 - DNA, 8 bp, Unknown
  misc_feature (1)..( 8): Result.005 file - promoters50/1957303
ctttaaaa

SEQ ID NO: 178459 - DNA, 8 bp, Unknown
  misc_feature (1)..( 8): Result.005 file - promoters50/1957303
atttgaag

SEQ ID NO: 178460 - DNA, 8 bp, Unknown
  misc_feature (1)..( 8): Result.005 file - promoters50/1957303
agcaaatc

SEQ ID NO: 178461 - DNA, 8 bp, Unknown
  misc_feature (1)..( 8): Result.005 file - promoters50/1957303
accaaatc

SEQ ID NO: 178462 - DNA, 8 bp, Unknown
  misc_feature (1)..( 8): Result.005 file - promoters50/1957303
agcgaatg

SEQ ID NO: 178463 - DNA, 10 bp, Unknown
  misc_feature (1)..( 10): Result.005 file - promoters50/1957303
gaagaaaaaa

SEQ ID NO: 178464 - DNA, 10 bp, Unknown
  misc_feature (1)..( 10): Result.005 file - promoters50/1957303
gaacaaaacc

SEQ ID NO: 178465 - DNA, 10 bp, Unknown
  misc_feature (1)..( 10): Result.005 file - promoters50/1957303
gaaaaaaaaa

SEQ ID NO: 178466 - DNA, 11 bp, Unknown
  misc_feature (1)..( 11): Result.005 file - promoters50/1959878
tctaattggat

SEQ ID NO: 178467 - DNA, 11 bp, Unknown
  misc_feature (1)..( 11): Result.005 file - promoters50/1959878
tttaaatgggc

SEQ ID NO: 178468 - DNA, 11 bp, Unknown
  misc_feature (1)..( 11): Result.005 file - promoters50/1959878
gacaatttgat

SEQ ID NO: 178469 - DNA, 11 bp, Unknown
  misc_feature (1)..( 11): Result.005 file - promoters50/1959878
actaattatcc

SEQ ID NO: 178470 - DNA, 11 bp, Unknown
  misc_feature (1)..( 11): Result.005 file - promoters50/1959878
tttcatttcta

SEQ ID NO: 178471 - DNA, 9 bp, Unknown
  misc_feature (1)..( 9): Result.005 file - promoters50/1959920
gcatctctt

SEQ ID NO: 178472 - DNA, 9 bp, Unknown
  misc_feature (1)..( 9): Result.005 file - promoters50/1959920
ccatttctt

SEQ ID NO: 178473 - DNA, 9 bp, Unknown
  misc_feature (1)..( 9): Result.005 file - promoters50/1959920
gcatccctt

SEQ ID NO: 178474 - DNA, 10 bp, Unknown
  misc_feature (1)..( 10): Result.005 file - promoters50/1959920
gatttgggat

SEQ ID NO: 178475 - DNA, 10 bp, Unknown
  misc_feature (1)..( 10): Result.005 file - promoters50/1959920
tctttaggac

SEQ ID NO: 178476 - DNA, 10 bp, Unknown
  misc_feature (1)..( 10): Result.005 file - promoters50/1959920
gatttgtgat

SEQ ID NO: 178477 - DNA, 8 bp, Unknown
  misc_feature (1)..( 8): Result.005 file - promoters50/1959927
aaagattc

SEQ ID NO: 178478 - DNA, 8 bp, Unknown
  misc_feature (1)..( 8): Result.005 file - promoters50/1959927
aaatattt

SEQ ID NO: 178479 - DNA, 8 bp, Unknown
  misc_feature (1)..( 8): Result.005 file - promoters50/1959927
caattttt

SEQ ID NO: 178480 - DNA, 14 bp, Unknown
  misc_feature (1)..( 14): Result.005 file - promoters50/1959965
atttatacatataa

SEQ ID NO: 178481 - DNA, 14 bp, Unknown
  misc_feature (1)..( 14): Result.005 file - promoters50/1959965
caaacttcatctaa

SEQ ID NO: 178482 - DNA, 14 bp, Unknown
  misc_feature (1)..( 14): Result.005 file - promoters50/1959965
aaaagttcatctgt

SEQ ID NO: 178483 - DNA, 14 bp, Unknown
  misc_feature (1)..( 14): Result.005 file - promoters50/1959965
aaaagttttattct

SEQ ID NO: 178484 - DNA, 9 bp, Unknown
  misc_feature (1)..( 9): Result.005 file - promoters50/1959965
tttcatata

SEQ ID NO: 178485 - DNA, 9 bp, Unknown
  misc_feature (1)..( 9): Result.005 file - promoters50/1959965
tttcatttt

SEQ ID NO: 178486 - DNA, 9 bp, Unknown
  misc_feature (1)..( 9): Result.005 file - promoters50/1959965
tttcttata

SEQ ID NO: 178487 - DNA, 7 bp, Unknown
  misc_feature (1)..( 7): Result.005 file - promoters50/1959965
ccatttt

SEQ ID NO: 178488 - DNA, 7 bp, Unknown
  misc_feature (1)..( 7): Result.005 file - promoters50/1959965
acatttt

SEQ ID NO: 178489 - DNA, 7 bp, Unknown
  misc_feature (1)..( 7): Result.005 file - promoters50/1959965
ccatttg

SEQ ID NO: 178490 - DNA, 10 bp, Unknown
  misc_feature (1)..( 10): Result.005 file - promoters50/1959965
ttatatatca

SEQ ID NO: 178491 - DNA, 10 bp, Unknown
  misc_feature (1)..( 10): Result.005 file - promoters50/1959965
ttaaatattt

SEQ ID NO: 178492 - DNA, 10 bp, Unknown
  misc_feature (1)..( 10): Result.005 file - promoters50/1959965
tacaattttt

SEQ ID NO: 178493 - DNA, 8 bp, Unknown
  misc_feature (1)..( 8): Result.005 file - promoters50/1959965
attgtttt

SEQ ID NO: 178494 - DNA, 8 bp, Unknown
  misc_feature (1)..( 8): Result.005 file - promoters50/1959965
attttttt

SEQ ID NO: 178495 - DNA, 8 bp, Unknown
  misc_feature (1)..( 8): Result.005 file - promoters50/1959965
ctttctta

SEQ ID NO: 178496 - DNA, 13 bp, Unknown
  misc_feature (1)..( 13): Result.005 file - promoters50/1959965
ataatttaatcac

SEQ ID NO: 178497 - DNA, 13 bp, Unknown
  misc_feature (1)..( 13): Result.005 file - promoters50/1959965
agttattaatcac

SEQ ID NO: 178498 - DNA, 13 bp, Unknown
  misc_feature (1)..( 13): Result.005 file - promoters50/1959965
agtgattcatctt

SEQ ID NO: 178499 - DNA, 9 bp, Unknown
  misc_feature (1)..( 9): Result.005 file - promoters50/1959965
actatgaaa

SEQ ID NO: 178500 - DNA, 9 bp, Unknown
  misc_feature (1)..( 9): Result.005 file - promoters50/1959965
tttattaaa

SEQ ID NO: 178501 - DNA, 9 bp, Unknown
  misc_feature (1)..( 9): Result.005 file - promoters50/1959965
ttttttaaa

SEQ ID NO: 178502 - DNA, 13 bp, Unknown
  misc_feature (1)..( 13): Result.005 file - promoters50/1974123
ttatcatgcaaaa

SEQ ID NO: 178503 - DNA, 13 bp, Unknown
  misc_feature (1)..( 13): Result.005 file - promoters50/1974123
ttatcaaaccaat

SEQ ID NO: 178504 - DNA, 13 bp, Unknown
  misc_feature (1)..( 13): Result.005 file - promoters50/1974123
ctatcaaacaaat

SEQ ID NO: 178505 - DNA, 11 bp, Unknown
  misc_feature (1)..( 11): Result.005 file - promoters50/1974123
aattattttgt

SEQ ID NO: 178506 - DNA, 11 bp, Unknown
  misc_feature (1)..( 11): Result.005 file - promoters50/1974123
aatcattttgt

SEQ ID NO: 178507 - DNA, 11 bp, Unknown
  misc_feature (1)..( 11): Result.005 file - promoters50/1974123
atttatgttgt

SEQ ID NO: 178508 - DNA, 9 bp, Unknown
  misc_feature (1)..( 9): Result.005 file - promoters50/1974123
taaaactaa

SEQ ID NO: 178509 - DNA, 9 bp, Unknown
  misc_feature (1)..( 9): Result.005 file - promoters50/1974123
taaaacacc

SEQ ID NO: 178510 - DNA, 9 bp, Unknown
  misc_feature (1)..( 9): Result.005 file - promoters50/1974123
caaaatacc

SEQ ID NO: 178511 - DNA, 12 bp, Unknown
  misc_feature (1)..( 12): Result.005 file - promoters50/1974123
aaaaaaaacatt

SEQ ID NO: 178512 - DNA, 12 bp, Unknown
  misc_feature (1)..( 12): Result.005 file - promoters50/1974123
aaagaaaataga

SEQ ID NO: 178513 - DNA, 12 bp, Unknown
  misc_feature (1)..( 12): Result.005 file - promoters50/1974123
attgaaattaga

SEQ ID NO: 178514 - DNA, 8 bp, Unknown
  misc_feature (1)..( 8): Result.005 file - promoters50/1974123
tttataaa

SEQ ID NO: 178515 - DNA, 8 bp, Unknown
  misc_feature (1)..( 8): Result.005 file - promoters50/1974123
tttctaac

SEQ ID NO: 178516 - DNA, 8 bp, Unknown
  misc_feature (1)..( 8): Result.005 file - promoters50/1974123
tatataaa

SEQ ID NO: 178517 - DNA, 9 bp, Unknown
  misc_feature (1)..( 9): Result.005 file - promoters50/1974123
ccgattaga

SEQ ID NO: 178518 - DNA, 9 bp, Unknown
  misc_feature (1)..( 9): Result.005 file - promoters50/1974123
gaaattaga

SEQ ID NO: 178519 - DNA, 9 bp, Unknown
  misc_feature (1)..( 9): Result.005 file - promoters50/1974123
gaaaataga

SEQ ID NO: 178520 - DNA, 13 bp, Unknown
  misc_feature (1)..( 13): Result.005 file - promoters50/1974282
tgaacttagtctg

SEQ ID NO: 178521 - DNA, 13 bp, Unknown
  misc_feature (1)..( 13): Result.005 file - promoters50/1974282
tttacttaggaaa

SEQ ID NO: 178522 - DNA, 13 bp, Unknown
  misc_feature (1)..( 13): Result.005 file - promoters50/1974282
attactttggatt

SEQ ID NO: 178523 - DNA, 13 bp, Unknown
  misc_feature (1)..( 13): Result.005 file - promoters50/1974282
atagagttggata

SEQ ID NO: 178524 - DNA, 13 bp, Unknown
  misc_feature (1)..( 13): Result.005 file - promoters50/1974282
aattttttgaata

SEQ ID NO: 178525 - DNA, 13 bp, Unknown
  misc_feature (1)..( 13): Result.005 file - promoters50/1974282
attactctcattc

SEQ ID NO: 178526 - DNA, 13 bp, Unknown
  misc_feature (1)..( 13): Result.005 file - promoters50/1974282
attactgtataat

SEQ ID NO: 178527 - DNA, 15 bp, Unknown
  misc_feature (1)..( 15): Result.005 file - promoters50/1974282
catgttcgaacatga

SEQ ID NO: 178528 - DNA, 15 bp, Unknown
  misc_feature (1)..( 15): Result.005 file - promoters50/1974282
ccttttcgtacatca

SEQ ID NO: 178529 - DNA, 15 bp, Unknown
  misc_feature (1)..( 15): Result.005 file - promoters50/1974282
cctattacaacatga

SEQ ID NO: 178530 - DNA, 15 bp, Unknown
  misc_feature (1)..( 15): Result.005 file - promoters50/1974282
cctttttgtatcaag

SEQ ID NO: 178531 - DNA, 15 bp, Unknown
  misc_feature (1)..( 15): Result.005 file - promoters50/1974282
aacagttgtataatt

SEQ ID NO: 178532 - DNA, 15 bp, Unknown
  misc_feature (1)..( 15): Result.005 file - promoters50/1974282
tctttttgatatgat

SEQ ID NO: 178533 - DNA, 14 bp, Unknown
  misc_feature (1)..( 14): Result.005 file - promoters50/1974282
caaaaaacttccaa

SEQ ID NO: 178534 - DNA, 14 bp, Unknown
  misc_feature (1)..( 14): Result.005 file - promoters50/1974282
ctaaaaacgaatta

SEQ ID NO: 178535 - DNA, 14 bp, Unknown
  misc_feature (1)..( 14): Result.005 file - promoters50/1974282
ataaaagttctaaa

SEQ ID NO: 178536 - DNA, 14 bp, Unknown
  misc_feature (1)..( 14): Result.005 file - promoters50/1974282
ctaacaacttaatt

SEQ ID NO: 178537 - DNA, 14 bp, Unknown
  misc_feature (1)..( 14): Result.005 file - promoters50/1974282
ttaaaagagaaggt

SEQ ID NO: 178538 - DNA, 14 bp, Unknown
  misc_feature (1)..( 14): Result.005 file - promoters50/1974282
ttcaaaatttataa

SEQ ID NO: 178539 - DNA, 13 bp, Unknown
  misc_feature (1)..( 13): Result.005 file - promoters50/1974501
ttaatgtatttgt

SEQ ID NO: 178540 - DNA, 13 bp, Unknown
  misc_feature (1)..( 13): Result.005 file - promoters50/1974501
cttatgtctttcc

SEQ ID NO: 178541 - DNA, 13 bp, Unknown
  misc_feature (1)..( 13): Result.005 file - promoters50/1974501
aaaagatatttgt

SEQ ID NO: 178542 - DNA, 13 bp, Unknown
  misc_feature (1)..( 13): Result.005 file - promoters50/1974501
taaaggtatttaa

SEQ ID NO: 178543 - DNA, 13 bp, Unknown
  misc_feature (1)..( 13): Result.005 file - promoters50/1974501
attatgtcatttt

SEQ ID NO: 178544 - DNA, 13 bp, Unknown
  misc_feature (1)..( 13): Result.005 file - promoters50/1974501
attgtgtagttca

SEQ ID NO: 178545 - DNA, 16 bp, Unknown
  misc_feature (1)..( 16): Result.005 file - promoters50/1974501
tctatgattatatttt

SEQ ID NO: 178546 - DNA, 16 bp, Unknown
  misc_feature (1)..( 16): Result.005 file - promoters50/1974501
agatttcaaataattt

SEQ ID NO: 178547 - DNA, 16 bp, Unknown
  misc_feature (1)..( 16): Result.005 file - promoters50/1974501
aaaaaaaaaaaaattt

SEQ ID NO: 178548 - DNA, 16 bp, Unknown
  misc_feature (1)..( 16): Result.005 file - promoters50/1974501
aaaaataaaataatac

SEQ ID NO: 178549 - DNA, 16 bp, Unknown
  misc_feature (1)..( 16): Result.005 file - promoters50/1974501
taaagttatataatca

SEQ ID NO: 178550 - DNA, 11 bp, Unknown
  misc_feature (1)..( 11): Result.005 file - promoters50/1974501
taataacatat

SEQ ID NO: 178551 - DNA, 11 bp, Unknown
  misc_feature (1)..( 11): Result.005 file - promoters50/1974501
taatcacatag

SEQ ID NO: 178552 - DNA, 11 bp, Unknown
  misc_feature (1)..( 11): Result.005 file - promoters50/1974501
aaataaaataa

SEQ ID NO: 178553 - DNA, 11 bp, Unknown
  misc_feature (1)..( 11): Result.005 file - promoters50/1974501
taaaaaaaaaa

SEQ ID NO: 178554 - DNA, 11 bp, Unknown
  misc_feature (1)..( 11): Result.005 file - promoters50/1974501
atttcaaataa

SEQ ID NO: 178555 - DNA, 16 bp, Unknown
  misc_feature (1)..( 16): Result.005 file - promoters50/1974501
caatataaatgtattg

SEQ ID NO: 178556 - DNA, 16 bp, Unknown
  misc_feature (1)..( 16): Result.005 file - promoters50/1974501
aaatacaaatttattg

SEQ ID NO: 178557 - DNA, 16 bp, Unknown
  misc_feature (1)..( 16): Result.005 file - promoters50/1974501
taataaaaactaatga

SEQ ID NO: 178558 - DNA, 16 bp, Unknown
  misc_feature (1)..( 16): Result.005 file - promoters50/1974501
atgaaatcatttatta

SEQ ID NO: 178559 - DNA, 16 bp, Unknown
  misc_feature (1)..( 16): Result.005 file - promoters50/1974501
aaatactcaattattt

SEQ ID NO: 178560 - DNA, 8 bp, Unknown
  misc_feature (1)..( 8): Result.005 file - promoters50/1974737
tataaaaa

SEQ ID NO: 178561 - DNA, 8 bp, Unknown
  misc_feature (1)..( 8): Result.005 file - promoters50/1974737
gataaaat

SEQ ID NO: 178562 - DNA, 8 bp, Unknown
  misc_feature (1)..( 8): Result.005 file - promoters50/1974737
tataaaaa

SEQ ID NO: 178563 - DNA, 8 bp, Unknown
  misc_feature (1)..( 8): Result.005 file - promoters50/1974737
tataaaac

SEQ ID NO: 178564 - DNA, 8 bp, Unknown
  misc_feature (1)..( 8): Result.005 file - promoters50/1974737
cataaaat

SEQ ID NO: 178565 - DNA, 8 bp, Unknown
  misc_feature (1)..( 8): Result.005 file - promoters50/1974737
tataaaac

SEQ ID NO: 178566 - DNA, 12 bp, Unknown
  misc_feature (1)..( 12): Result.005 file - promoters50/1974737
gaagagaagttt

SEQ ID NO: 178567 - DNA, 12 bp, Unknown
  misc_feature (1)..( 12): Result.005 file - promoters50/1974737
taagagaaaaga

SEQ ID NO: 178568 - DNA, 12 bp, Unknown
  misc_feature (1)..( 12): Result.005 file - promoters50/1974737
gaagagtggaaa

SEQ ID NO: 178569 - DNA, 12 bp, Unknown
  misc_feature (1)..( 12): Result.005 file - promoters50/1974737
aaagaaaaaaga

SEQ ID NO: 178570 - DNA, 12 bp, Unknown
  misc_feature (1)..( 12): Result.005 file - promoters50/1974737
taaaaaactctc

SEQ ID NO: 178571 - DNA, 12 bp, Unknown
  misc_feature (1)..( 12): Result.005 file - promoters50/1974737
atagagaaggaa

SEQ ID NO: 178572 - DNA, 9 bp, Unknown
  misc_feature (1)..( 9): Result.005 file - promoters50/1974761
aaattgaac

SEQ ID NO: 178573 - DNA, 9 bp, Unknown
  misc_feature (1)..( 9): Result.005 file - promoters50/1974761
aaatttaac

SEQ ID NO: 178574 - DNA, 9 bp, Unknown
  misc_feature (1)..( 9): Result.005 file - promoters50/1974761
taatttaaa

SEQ ID NO: 178575 - DNA, 6 bp, Unknown
  misc_feature (1)..( 6): Result.005 file - promoters50/1974761
atttaa

SEQ ID NO: 178576 - DNA, 6 bp, Unknown
  misc_feature (1)..( 6): Result.005 file - promoters50/1974761
atttaa

SEQ ID NO: 178577 - DNA, 6 bp, Unknown
  misc_feature (1)..( 6): Result.005 file - promoters50/1974761
atttaa

SEQ ID NO: 178578 - DNA, 8 bp, Unknown
  misc_feature (1)..( 8): Result.005 file - promoters50/1974761
aataaatt

SEQ ID NO: 178579 - DNA, 8 bp, Unknown
  misc_feature (1)..( 8): Result.005 file - promoters50/1974761
aataaatg

SEQ ID NO: 178580 - DNA, 8 bp, Unknown
  misc_feature (1)..( 8): Result.005 file - promoters50/1974761
tgtaaatt

SEQ ID NO: 178581 - DNA, 7 bp, Unknown
  misc_feature (1)..( 7): Result.005 file - promoters50/1974761
taaattt

SEQ ID NO: 178582 - DNA, 7 bp, Unknown
  misc_feature (1)..( 7): Result.005 file - promoters50/1974761
aaaattt

SEQ ID NO: 178583 - DNA, 7 bp, Unknown
  misc_feature (1)..( 7): Result.005 file - promoters50/1974761
taaatta

SEQ ID NO: 178584 - DNA, 14 bp, Unknown
  misc_feature (1)..( 14): Result.005 file - promoters50/1974761
ggagattgtccaca

SEQ ID NO: 178585 - DNA, 14 bp, Unknown
  misc_feature (1)..( 14): Result.005 file - promoters50/1974761
tcattttgcccaca

SEQ ID NO: 178586 - DNA, 14 bp, Unknown
  misc_feature (1)..( 14): Result.005 file - promoters50/1974761
ggagatggtctaac

SEQ ID NO: 178587 - DNA, 11 bp, Unknown
  misc_feature (1)..( 11): Result.005 file - promoters50/1974761
aaaaacataaa

SEQ ID NO: 178588 - DNA, 11 bp, Unknown
  misc_feature (1)..( 11): Result.005 file - promoters50/1974761
aaaaacataat

SEQ ID NO: 178589 - DNA, 11 bp, Unknown
  misc_feature (1)..( 11): Result.005 file - promoters50/1974761
cccaacaaaat

SEQ ID NO: 178590 - DNA, 8 bp, Unknown
  misc_feature (1)..( 8): Result.005 file - promoters50/1974761
cacaaaaa

SEQ ID NO: 178591 - DNA, 8 bp, Unknown
  misc_feature (1)..( 8): Result.005 file - promoters50/1974761
aacaaaat

SEQ ID NO: 178592 - DNA, 8 bp, Unknown
  misc_feature (1)..( 8): Result.005 file - promoters50/1974761
aacataat

SEQ ID NO: 178593 - DNA, 14 bp, Unknown
  misc_feature (1)..( 14): Result.005 file - promoters50/1975887
ttattgtaacagct

SEQ ID NO: 178594 - DNA, 14 bp, Unknown
  misc_feature (1)..( 14): Result.005 file - promoters50/1975887
tatttgtaaattgt

SEQ ID NO: 178595 - DNA, 14 bp, Unknown
  misc_feature (1)..( 14): Result.005 file - promoters50/1975887
ctattgtaattgta

SEQ ID NO: 178596 - DNA, 14 bp, Unknown
  misc_feature (1)..( 14): Result.005 file - promoters50/1975887
ttactgtaatcagt

SEQ ID NO: 178597 - DNA, 14 bp, Unknown
  misc_feature (1)..( 14): Result.005 file - promoters50/1975887
tgattgtaatctta

SEQ ID NO: 178598 - DNA, 14 bp, Unknown
  misc_feature (1)..( 14): Result.005 file - promoters50/1975887
attttgaaaaatgt

SEQ ID NO: 178599 - DNA, 14 bp, Unknown
  misc_feature (1)..( 14): Result.005 file - promoters50/1975887
agaatgtaaaagag

SEQ ID NO: 178600 - DNA, 16 bp, Unknown
  misc_feature (1)..( 16): Result.005 file - promoters50/1975887
tttgtaaattgtaatt

SEQ ID NO: 178601 - DNA, 16 bp, Unknown
  misc_feature (1)..( 16): Result.005 file - promoters50/1975887
tattgtaattgtaaaa

SEQ ID NO: 178602 - DNA, 16 bp, Unknown
  misc_feature (1)..( 16): Result.005 file - promoters50/1975887
attgcttactgtaatc

SEQ ID NO: 178603 - DNA, 16 bp, Unknown
  misc_feature (1)..( 16): Result.005 file - promoters50/1975887
gatcttgattgtaatc

SEQ ID NO: 178604 - DNA, 16 bp, Unknown
  misc_feature (1)..( 16): Result.005 file - promoters50/1975887
tttgaaaaatgttgtg

SEQ ID NO: 178605 - DNA, 16 bp, Unknown
  misc_feature (1)..( 16): Result.005 file - promoters50/1975887
ccacgagaatgtaaaa

SEQ ID NO: 178606 - DNA, 9 bp, Unknown
  misc_feature (1)..( 9): Result.005 file - promoters50/1975895
aaatacaat

SEQ ID NO: 178607 - DNA, 9 bp, Unknown
  misc_feature (1)..( 9): Result.005 file - promoters50/1975895
caataaaat

SEQ ID NO: 178608 - DNA, 9 bp, Unknown
  misc_feature (1)..( 9): Result.005 file - promoters50/1975895
aaaaacatt

SEQ ID NO: 178609 - DNA, 9 bp, Unknown
  misc_feature (1)..( 9): Result.005 file - promoters50/1975895
ttatataat

SEQ ID NO: 178610 - DNA, 9 bp, Unknown
  misc_feature (1)..( 9): Result.005 file - promoters50/1975895
caataacaa

SEQ ID NO: 178611 - DNA, 9 bp, Unknown
  misc_feature (1)..( 9): Result.005 file - promoters50/1975895
taataaaca

SEQ ID NO: 178612 - DNA, 13 bp, Unknown
  misc_feature (1)..( 13): Result.005 file - promoters50/1975940
catataaatgaaa

SEQ ID NO: 178613 - DNA, 13 bp, Unknown
  misc_feature (1)..( 13): Result.005 file - promoters50/1975940
catttaaaagaat

SEQ ID NO: 178614 - DNA, 13 bp, Unknown
  misc_feature (1)..( 13): Result.005 file - promoters50/1975940
agtgtaattgaaa

SEQ ID NO: 178615 - DNA, 13 bp, Unknown
  misc_feature (1)..( 13): Result.005 file - promoters50/1975940
ttattaaaatgca

SEQ ID NO: 178616 - DNA, 13 bp, Unknown
  misc_feature (1)..( 13): Result.005 file - promoters50/1975940
gatttaatttaat

SEQ ID NO: 178617 - DNA, 13 bp, Unknown
  misc_feature (1)..( 13): Result.005 file - promoters50/1975940
tcttttatttcct

SEQ ID NO: 178618 - DNA, 11 bp, Unknown
  misc_feature (1)..( 11): Result.005 file - promoters50/1975940
gtccaatagaa

SEQ ID NO: 178619 - DNA, 11 bp, Unknown
  misc_feature (1)..( 11): Result.005 file - promoters50/1975940
taaaaatagag

SEQ ID NO: 178620 - DNA, 11 bp, Unknown
  misc_feature (1)..( 11): Result.005 file - promoters50/1975940
acataaaagca

SEQ ID NO: 178621 - DNA, 11 bp, Unknown
  misc_feature (1)..( 11): Result.005 file - promoters50/1975940
acacaaaagaa

SEQ ID NO: 178622 - DNA, 11 bp, Unknown
  misc_feature (1)..( 11): Result.005 file - promoters50/1975940
tcataaaccaa

SEQ ID NO: 178623 - DNA, 11 bp, Unknown
  misc_feature (1)..( 11): Result.005 file - promoters50/1975940
acagaaaaaaa

SEQ ID NO: 178624 - DNA, 12 bp, Unknown
  misc_feature (1)..( 12): Result.005 file - promoters50/1975940
attgagtcattc

SEQ ID NO: 178625 - DNA, 12 bp, Unknown
  misc_feature (1)..( 12): Result.005 file - promoters50/1975940
cttgattcactt

SEQ ID NO: 178626 - DNA, 12 bp, Unknown
  misc_feature (1)..( 12): Result.005 file - promoters50/1975940
tttgagttctct

SEQ ID NO: 178627 - DNA, 12 bp, Unknown
  misc_feature (1)..( 12): Result.005 file - promoters50/1975940
tgtgatttactt

SEQ ID NO: 178628 - DNA, 12 bp, Unknown
  misc_feature (1)..( 12): Result.005 file - promoters50/1975940
ttttcttaaatt

SEQ ID NO: 178629 - DNA, 12 bp, Unknown
  misc_feature (1)..( 12): Result.005 file - promoters50/1975940
tgtaattgacaa

SEQ ID NO: 178630 - DNA, 13 bp, Unknown
  misc_feature (1)..( 13): Result.005 file - promoters50/1975940
gagtcttgtgagt

SEQ ID NO: 178631 - DNA, 13 bp, Unknown
  misc_feature (1)..( 13): Result.005 file - promoters50/1975940
taaacttgtgttt

SEQ ID NO: 178632 - DNA, 13 bp, Unknown
  misc_feature (1)..( 13): Result.005 file - promoters50/1975940
cccctttgagagg

SEQ ID NO: 178633 - DNA, 13 bp, Unknown
  misc_feature (1)..( 13): Result.005 file - promoters50/1975940
taaaattgtaagg

SEQ ID NO: 178634 - DNA, 13 bp, Unknown
  misc_feature (1)..( 13): Result.005 file - promoters50/1975940
cgaaattttaaat

SEQ ID NO: 178635 - DNA, 13 bp, Unknown
  misc_feature (1)..( 13): Result.005 file - promoters50/1975940
ttaatatttaaga

SEQ ID NO: 178636 - DNA, 12 bp, Unknown
  misc_feature (1)..( 12): Result.005 file - promoters50/1975940
agtaatatttga

SEQ ID NO: 178637 - DNA, 12 bp, Unknown
  misc_feature (1)..( 12): Result.005 file - promoters50/1975940
cttaaaattgag

SEQ ID NO: 178638 - DNA, 12 bp, Unknown
  misc_feature (1)..( 12): Result.005 file - promoters50/1975940
attaagattttt

SEQ ID NO: 178639 - DNA, 12 bp, Unknown
  misc_feature (1)..( 12): Result.005 file - promoters50/1975940
tcgttgattttg

SEQ ID NO: 178640 - DNA, 12 bp, Unknown
  misc_feature (1)..( 12): Result.005 file - promoters50/1975940
tctaaaaattca

SEQ ID NO: 178641 - DNA, 12 bp, Unknown
  misc_feature (1)..( 12): Result.005 file - promoters50/1975940
gagagaattttt

SEQ ID NO: 178642 - DNA, 12 bp, Unknown
  misc_feature (1)..( 12): Result.005 file - promoters50/1975940
gtacaatttggt

SEQ ID NO: 178643 - DNA, 12 bp, Unknown
  misc_feature (1)..( 12): Result.005 file - promoters50/1975940
ttttaatttgtt

SEQ ID NO: 178644 - DNA, 12 bp, Unknown
  misc_feature (1)..( 12): Result.005 file - promoters50/1975940
gaagaattagtt

SEQ ID NO: 178645 - DNA, 12 bp, Unknown
  misc_feature (1)..( 12): Result.005 file - promoters50/1975940
ttaatattagtt

SEQ ID NO: 178646 - DNA, 12 bp, Unknown
  misc_feature (1)..( 12): Result.005 file - promoters50/1975940
tttttatttcat

SEQ ID NO: 178647 - DNA, 12 bp, Unknown
  misc_feature (1)..( 12): Result.005 file - promoters50/1975940
agagaatttttg

SEQ ID NO: 178648 - DNA, 13 bp, Unknown
  misc_feature (1)..( 13): Result.005 file - promoters50/1975940
gatgttgaagtct

SEQ ID NO: 178649 - DNA, 13 bp, Unknown
  misc_feature (1)..( 13): Result.005 file - promoters50/1975940
gattttgactatg

SEQ ID NO: 178650 - DNA, 13 bp, Unknown
  misc_feature (1)..( 13): Result.005 file - promoters50/1975940
gattttttatttt

SEQ ID NO: 178651 - DNA, 13 bp, Unknown
  misc_feature (1)..( 13): Result.005 file - promoters50/1975940
tatttttttcttc

SEQ ID NO: 178652 - DNA, 13 bp, Unknown
  misc_feature (1)..( 13): Result.005 file - promoters50/1975940
aattttttaattt

SEQ ID NO: 178653 - DNA, 13 bp, Unknown
  misc_feature (1)..( 13): Result.005 file - promoters50/1975940
aatttttgtagac

SEQ ID NO: 178654 - DNA, 16 bp, Unknown
  misc_feature (1)..( 16): Result.005 file - promoters50/1975940
gtacaaaattgagcaa

SEQ ID NO: 178655 - DNA, 16 bp, Unknown
  misc_feature (1)..( 16): Result.005 file - promoters50/1975940
atacaaaattgataaa

SEQ ID NO: 178656 - DNA, 16 bp, Unknown
  misc_feature (1)..( 16): Result.005 file - promoters50/1975940
tataaaaatttagaat

SEQ ID NO: 178657 - DNA, 16 bp, Unknown
  misc_feature (1)..( 16): Result.005 file - promoters50/1975940
tgattaaattgaacaa

SEQ ID NO: 178658 - DNA, 16 bp, Unknown
  misc_feature (1)..( 16): Result.005 file - promoters50/1975940
ataacaaattttcttt

SEQ ID NO: 178659 - DNA, 16 bp, Unknown
  misc_feature (1)..( 16): Result.005 file - promoters50/1975940
ataaaaaattacggta

SEQ ID NO: 178660 - DNA, 7 bp, Unknown
  misc_feature (1)..( 7): Result.005 file - promoters50/1975956
taataat

SEQ ID NO: 178661 - DNA, 7 bp, Unknown
  misc_feature (1)..( 7): Result.005 file - promoters50/1975956
taataat

SEQ ID NO: 178662 - DNA, 7 bp, Unknown
  misc_feature (1)..( 7): Result.005 file - promoters50/1975956
taaaaat

SEQ ID NO: 178663 - DNA, 6 bp, Unknown
  misc_feature (1)..( 6): Result.005 file - promoters50/1975956
aatttt

SEQ ID NO: 178664 - DNA, 6 bp, Unknown
  misc_feature (1)..( 6): Result.005 file - promoters50/1975956
aatttt

SEQ ID NO: 178665 - DNA, 6 bp, Unknown
  misc_feature (1)..( 6): Result.005 file - promoters50/1975956
aatttt

SEQ ID NO: 178666 - DNA, 14 bp, Unknown
  misc_feature (1)..( 14): Result.005 file - promoters50/1975956
atatatatatattt

SEQ ID NO: 178667 - DNA, 14 bp, Unknown
  misc_feature (1)..( 14): Result.005 file - promoters50/1975956
ttgaatcaatattt

SEQ ID NO: 178668 - DNA, 14 bp, Unknown
  misc_feature (1)..( 14): Result.005 file - promoters50/1975956
ttgattcaaaattc

SEQ ID NO: 178669 - DNA, 8 bp, Unknown
  misc_feature (1)..( 8): Result.005 file - promoters50/1975956
tgaaaaaa

SEQ ID NO: 178670 - DNA, 8 bp, Unknown
  misc_feature (1)..( 8): Result.005 file - promoters50/1975956
ctaaaaaa

SEQ ID NO: 178671 - DNA, 8 bp, Unknown
  misc_feature (1)..( 8): Result.005 file - promoters50/1975956
tgagaaag

SEQ ID NO: 178672 - DNA, 9 bp, Unknown
  misc_feature (1)..( 9): Result.005 file - promoters50/1975956
taactttca

SEQ ID NO: 178673 - DNA, 9 bp, Unknown
  misc_feature (1)..( 9): Result.005 file - promoters50/1975956
taaatttct

SEQ ID NO: 178674 - DNA, 9 bp, Unknown
  misc_feature (1)..( 9): Result.005 file - promoters50/1975956
ggtatttct

SEQ ID NO: 178675 - DNA, 8 bp, Unknown
  misc_feature (1)..( 8): Result.005 file - promoters50/1975956
aattgtat

SEQ ID NO: 178676 - DNA, 8 bp, Unknown
  misc_feature (1)..( 8): Result.005 file - promoters50/1975956
aattatat

SEQ ID NO: 178677 - DNA, 8 bp, Unknown
  misc_feature (1)..( 8): Result.005 file - promoters50/1975956
tattatag

SEQ ID NO: 178678 - DNA, 9 bp, Unknown
  misc_feature (1)..( 9): Result.005 file - promoters50/1975989
atataattt

SEQ ID NO: 178679 - DNA, 9 bp, Unknown
  misc_feature (1)..( 9): Result.005 file - promoters50/1975989
aattaattt

SEQ ID NO: 178680 - DNA, 9 bp, Unknown
  misc_feature (1)..( 9): Result.005 file - promoters50/1975989
tcataattt

SEQ ID NO: 178681 - DNA, 9 bp, Unknown
  misc_feature (1)..( 9): Result.005 file - promoters50/1975989
tcacaatgc

SEQ ID NO: 178682 - DNA, 8 bp, Unknown
  misc_feature (1)..( 8): Result.005 file - promoters50/1975989
tttaattt

SEQ ID NO: 178683 - DNA, 8 bp, Unknown
  misc_feature (1)..( 8): Result.005 file - promoters50/1975989
tttaattt

SEQ ID NO: 178684 - DNA, 8 bp, Unknown
  misc_feature (1)..( 8): Result.005 file - promoters50/1975989
ataaattc

SEQ ID NO: 178685 - DNA, 7 bp, Unknown
  misc_feature (1)..( 7): Result.005 file - promoters50/1975989
taaatct

SEQ ID NO: 178686 - DNA, 7 bp, Unknown
  misc_feature (1)..( 7): Result.005 file - promoters50/1975989
caaatct

SEQ ID NO: 178687 - DNA, 7 bp, Unknown
  misc_feature (1)..( 7): Result.005 file - promoters50/1975989
taactct

SEQ ID NO: 178688 - DNA, 10 bp, Unknown
  misc_feature (1)..( 10): Result.005 file - promoters50/1975989
gaaaattgat

SEQ ID NO: 178689 - DNA, 10 bp, Unknown
  misc_feature (1)..( 10): Result.005 file - promoters50/1975989
taaaactgat

SEQ ID NO: 178690 - DNA, 10 bp, Unknown
  misc_feature (1)..( 10): Result.005 file - promoters50/1975989
taaaacaatt

SEQ ID NO: 178691 - DNA, 9 bp, Unknown
  misc_feature (1)..( 9): Result.005 file - promoters50/1975989
atttttttt

SEQ ID NO: 178692 - DNA, 9 bp, Unknown
  misc_feature (1)..( 9): Result.005 file - promoters50/1975989
atttttttt

SEQ ID NO: 178693 - DNA, 9 bp, Unknown
  misc_feature (1)..( 9): Result.005 file - promoters50/1975989
tttactttt

SEQ ID NO: 178694 - DNA, 8 bp, Unknown
  misc_feature (1)..( 8): Result.005 file - promoters50/1975989
tcaattta

SEQ ID NO: 178695 - DNA, 8 bp, Unknown
  misc_feature (1)..( 8): Result.005 file - promoters50/1975989
tcattttt

SEQ ID NO: 178696 - DNA, 8 bp, Unknown
  misc_feature (1)..( 8): Result.005 file - promoters50/1975989
ctattttt

SEQ ID NO: 178697 - DNA, 7 bp, Unknown
  misc_feature (1)..( 7): Result.005 file - promoters50/1975989
tataaat

SEQ ID NO: 178698 - DNA, 7 bp, Unknown
  misc_feature (1)..( 7): Result.005 file - promoters50/1975989
tataaac

SEQ ID NO: 178699 - DNA, 7 bp, Unknown
  misc_feature (1)..( 7): Result.005 file - promoters50/1975989
aataaac

SEQ ID NO: 178700 - DNA, 9 bp, Unknown
  misc_feature (1)..( 9): Result.005 file - promoters50/1976000
aaaacacga

SEQ ID NO: 178701 - DNA, 9 bp, Unknown
  misc_feature (1)..( 9): Result.005 file - promoters50/1976000
aaaacaatt

SEQ ID NO: 178702 - DNA, 9 bp, Unknown
  misc_feature (1)..( 9): Result.005 file - promoters50/1976000
caaacgatt

SEQ ID NO: 178703 - DNA, 17 bp, Unknown
  misc_feature (1)..( 17): Result.005 file - promoters50/1976004
ttatgccatgtagcttc

SEQ ID NO: 178704 - DNA, 17 bp, Unknown
  misc_feature (1)..( 17): Result.005 file - promoters50/1976004
tagacccatgttagaag

SEQ ID NO: 178705 - DNA, 17 bp, Unknown
  misc_feature (1)..( 17): Result.005 file - promoters50/1976004
ttattccatgatcttat

SEQ ID NO: 178706 - DNA, 17 bp, Unknown
  misc_feature (1)..( 17): Result.005 file - promoters50/1976004
actcaccatgtttattt

SEQ ID NO: 178707 - DNA, 17 bp, Unknown
  misc_feature (1)..( 17): Result.005 file - promoters50/1976004
acaggttatgttattta

SEQ ID NO: 178708 - DNA, 17 bp, Unknown
  misc_feature (1)..( 17): Result.005 file - promoters50/1976004
tactcatgtgtaatttg

SEQ ID NO: 178709 - DNA, 17 bp, Unknown
  misc_feature (1)..( 17): Result.005 file - promoters50/1976004
ctgcgtttgttaatttg

SEQ ID NO: 178710 - DNA, 14 bp, Unknown
  misc_feature (1)..( 14): Result.005 file - promoters50/1976004
tagaaaataaaaat

SEQ ID NO: 178711 - DNA, 14 bp, Unknown
  misc_feature (1)..( 14): Result.005 file - promoters50/1976004
attaaattaaagaa

SEQ ID NO: 178712 - DNA, 14 bp, Unknown
  misc_feature (1)..( 14): Result.005 file - promoters50/1976004
tagtaaataatatt

SEQ ID NO: 178713 - DNA, 14 bp, Unknown
  misc_feature (1)..( 14): Result.005 file - promoters50/1976004
tgcgttttatattt

SEQ ID NO: 178714 - DNA, 14 bp, Unknown
  misc_feature (1)..( 14): Result.005 file - promoters50/1976004
aaacaattaagaaa

SEQ ID NO: 178715 - DNA, 14 bp, Unknown
  misc_feature (1)..( 14): Result.005 file - promoters50/1976004
gattaattaactta

SEQ ID NO: 178716 - DNA, 14 bp, Unknown
  misc_feature (1)..( 14): Result.005 file - promoters50/1976004
aaagtttgatatat

SEQ ID NO: 178717 - DNA, 15 bp, Unknown
  misc_feature (1)..( 15): Result.005 file - promoters50/1976004
aaaatcaaaaataag

SEQ ID NO: 178718 - DNA, 15 bp, Unknown
  misc_feature (1)..( 15): Result.005 file - promoters50/1976004
agaattaaaatcaat

SEQ ID NO: 178719 - DNA, 15 bp, Unknown
  misc_feature (1)..( 15): Result.005 file - promoters50/1976004
aaaaacaattaagaa

SEQ ID NO: 178720 - DNA, 15 bp, Unknown
  misc_feature (1)..( 15): Result.005 file - promoters50/1976004
attttcaaaaaaatt

SEQ ID NO: 178721 - DNA, 16 bp, Unknown
  misc_feature (1)..( 16): Result.005 file - promoters50/1976004
tatgtcacaaaattta

SEQ ID NO: 178722 - DNA, 16 bp, Unknown
  misc_feature (1)..( 16): Result.005 file - promoters50/1976004
atttcgcaaaactatt

SEQ ID NO: 178723 - DNA, 10 bp, Unknown
  misc_feature (1)..( 10): Result.005 file - promoters50/1976004
tagaaataat

SEQ ID NO: 178724 - DNA, 10 bp, Unknown
  misc_feature (1)..( 10): Result.005 file - promoters50/1976004
aacaaataaa

SEQ ID NO: 178725 - DNA, 10 bp, Unknown
  misc_feature (1)..( 10): Result.005 file - promoters50/1976004
aagatataaa

SEQ ID NO: 178726 - DNA, 10 bp, Unknown
  misc_feature (1)..( 10): Result.005 file - promoters50/1976004
acgaattaat

SEQ ID NO: 178727 - DNA, 10 bp, Unknown
  misc_feature (1)..( 10): Result.005 file - promoters50/1976004
aagatattat

SEQ ID NO: 178728 - DNA, 10 bp, Unknown
  misc_feature (1)..( 10): Result.005 file - promoters50/1976004
aacaaatttc

SEQ ID NO: 178729 - DNA, 10 bp, Unknown
  misc_feature (1)..( 10): Result.005 file - promoters50/1976004
gaaaaataac

SEQ ID NO: 178730 - DNA, 10 bp, Unknown
  misc_feature (1)..( 10): Result.005 file - promoters50/1976004
atacagtata

SEQ ID NO: 178731 - DNA, 10 bp, Unknown
  misc_feature (1)..( 10): Result.005 file - promoters50/1976004
ataaagtttt

SEQ ID NO: 178732 - DNA, 10 bp, Unknown
  misc_feature (1)..( 10): Result.005 file - promoters50/1976004
ataaactttt

SEQ ID NO: 178733 - DNA, 10 bp, Unknown
  misc_feature (1)..( 10): Result.005 file - promoters50/1976004
ccaaaatttt

SEQ ID NO: 178734 - DNA, 10 bp, Unknown
  misc_feature (1)..( 10): Result.005 file - promoters50/1976004
aacaaatttc

SEQ ID NO: 178735 - DNA, 10 bp, Unknown
  misc_feature (1)..( 10): Result.005 file - promoters50/1976004
aacgaattaa

SEQ ID NO: 178736 - DNA, 10 bp, Unknown
  misc_feature (1)..( 10): Result.005 file - promoters50/1976004
ccataatttg

SEQ ID NO: 178737 - DNA, 18 bp, Unknown
  misc_feature (1)..( 18): Result.005 file - promoters50/1976004
tacagtatacaatgatat

SEQ ID NO: 178738 - DNA, 18 bp, Unknown
  misc_feature (1)..( 18): Result.005 file - promoters50/1976004
ttttttatacaaaataca

SEQ ID NO: 178739 - DNA, 18 bp, Unknown
  misc_feature (1)..( 18): Result.005 file - promoters50/1976004
aaaggtatacgtatttgg

SEQ ID NO: 178740 - DNA, 18 bp, Unknown
  misc_feature (1)..( 18): Result.005 file - promoters50/1976004
tgcatcataaaatgttat

SEQ ID NO: 178741 - DNA, 18 bp, Unknown
  misc_feature (1)..( 18): Result.005 file - promoters50/1976004
tttcttataaaaaaaagt

SEQ ID NO: 178742 - DNA, 18 bp, Unknown
  misc_feature (1)..( 18): Result.005 file - promoters50/1976004
aaatttacaagatataaa

SEQ ID NO: 178743 - DNA, 12 bp, Unknown
  misc_feature (1)..( 12): Result.005 file - promoters50/1976004
taaacaaaagat

SEQ ID NO: 178744 - DNA, 12 bp, Unknown
  misc_feature (1)..( 12): Result.005 file - promoters50/1976004
gtcacaaaattt

SEQ ID NO: 178745 - DNA, 11 bp, Unknown
  misc_feature (1)..( 11): Result.005 file - promoters50/1976004
taacaaacaaa

SEQ ID NO: 178746 - DNA, 12 bp, Unknown
  misc_feature (1)..( 12): Result.005 file - promoters50/1976004
taaccaaaattt

SEQ ID NO: 178747 - DNA, 12 bp, Unknown
  misc_feature (1)..( 12): Result.005 file - promoters50/1976004
ttttcaaaaaaa

SEQ ID NO: 178748 - DNA, 12 bp, Unknown
  misc_feature (1)..( 12): Result.005 file - promoters50/1976004
gtcccataattt

SEQ ID NO: 178749 - DNA, 9 bp, Unknown
  misc_feature (1)..( 9): Result.005 file - promoters50/1976004
cggcccatc

SEQ ID NO: 178750 - DNA, 9 bp, Unknown
  misc_feature (1)..( 9): Result.005 file - promoters50/1976004
aggcccata

SEQ ID NO: 178751 - DNA, 9 bp, Unknown
  misc_feature (1)..( 9): Result.005 file - promoters50/1976004
aggcccaat

SEQ ID NO: 178752 - DNA, 9 bp, Unknown
  misc_feature (1)..( 9): Result.005 file - promoters50/1976004
tggcccagt

SEQ ID NO: 178753 - DNA, 9 bp, Unknown
  misc_feature (1)..( 9): Result.005 file - promoters50/1976004
aggcccatt

SEQ ID NO: 178754 - DNA, 9 bp, Unknown
  misc_feature (1)..( 9): Result.005 file - promoters50/1976004
aagcccatt

SEQ ID NO: 178755 - DNA, 10 bp, Unknown
  misc_feature (1)..( 10): Result.005 file - promoters50/1976004
tgcaatttgt

SEQ ID NO: 178756 - DNA, 10 bp, Unknown
  misc_feature (1)..( 10): Result.005 file - promoters50/1976004
tgtaatttgt

SEQ ID NO: 178757 - DNA, 10 bp, Unknown
  misc_feature (1)..( 10): Result.005 file - promoters50/1976004
gttaatttga

SEQ ID NO: 178758 - DNA, 10 bp, Unknown
  misc_feature (1)..( 10): Result.005 file - promoters50/1976004
aattatttta

SEQ ID NO: 178759 - DNA, 10 bp, Unknown
  misc_feature (1)..( 10): Result.005 file - promoters50/1976004
tgttatttat

SEQ ID NO: 178760 - DNA, 10 bp, Unknown
  misc_feature (1)..( 10): Result.005 file - promoters50/1976004
gtttatttta

SEQ ID NO: 178761 - DNA, 9 bp, Unknown
  misc_feature (1)..( 9): Result.005 file - promoters50/1976004
ataaaaatc

SEQ ID NO: 178762 - DNA, 9 bp, Unknown
  misc_feature (1)..( 9): Result.005 file - promoters50/1976004
gtaaaaaca

SEQ ID NO: 178763 - DNA, 9 bp, Unknown
  misc_feature (1)..( 9): Result.005 file - promoters50/1976004
aaaaaaatt

SEQ ID NO: 178764 - DNA, 10 bp, Unknown
  misc_feature (1)..( 10): Result.005 file - promoters50/1976004
ttaaagaatt

SEQ ID NO: 178765 - DNA, 10 bp, Unknown
  misc_feature (1)..( 10): Result.005 file - promoters50/1976004
tcacaaaatt

SEQ ID NO: 178766 - DNA, 10 bp, Unknown
  misc_feature (1)..( 10): Result.005 file - promoters50/1976004
gtaaaacgag

SEQ ID NO: 178767 - DNA, 12 bp, Unknown
  misc_feature (1)..( 12): Result.005 file - promoters50/1976004
atcaaaaataag

SEQ ID NO: 178768 - DNA, 12 bp, Unknown
  misc_feature (1)..( 12): Result.005 file - promoters50/1976004
aagaaaaataac

SEQ ID NO: 178769 - DNA, 11 bp, Unknown
  misc_feature (1)..( 11): Result.005 file - promoters50/1976004
tcaaaaaaatt

SEQ ID NO: 178770 - DNA, 12 bp, Unknown
  misc_feature (1)..( 12): Result.005 file - promoters50/1976004
tcacaaaattta

SEQ ID NO: 178771 - DNA, 12 bp, Unknown
  misc_feature (1)..( 12): Result.005 file - promoters50/1976004
attgacaataac

SEQ ID NO: 178772 - DNA, 12 bp, Unknown
  misc_feature (1)..( 12): Result.005 file - promoters50/1976004
cttaaagatatt

SEQ ID NO: 178773 - DNA, 11 bp, Unknown
  misc_feature (1)..( 11): Result.005 file - promoters50/1976004
aatcaaataaa

SEQ ID NO: 178774 - DNA, 11 bp, Unknown
  misc_feature (1)..( 11): Result.005 file - promoters50/1976004
atttaaataat

SEQ ID NO: 178775 - DNA, 11 bp, Unknown
  misc_feature (1)..( 11): Result.005 file - promoters50/1976004
atttaaataca

SEQ ID NO: 178776 - DNA, 11 bp, Unknown
  misc_feature (1)..( 11): Result.005 file - promoters50/1976004
acttacataaa

SEQ ID NO: 178777 - DNA, 11 bp, Unknown
  misc_feature (1)..( 11): Result.005 file - promoters50/1976004
tcgtaaatata

SEQ ID NO: 178778 - DNA, 11 bp, Unknown
  misc_feature (1)..( 11): Result.005 file - promoters50/1976004
gacaacataaa

SEQ ID NO: 178779 - DNA, 11 bp, Unknown
  misc_feature (1)..( 11): Result.005 file - promoters50/1976004
atgtgattgca

SEQ ID NO: 178780 - DNA, 11 bp, Unknown
  misc_feature (1)..( 11): Result.005 file - promoters50/1976004
atgttatttat

SEQ ID NO: 178781 - DNA, 11 bp, Unknown
  misc_feature (1)..( 11): Result.005 file - promoters50/1976004
tattgattggg

SEQ ID NO: 178782 - DNA, 11 bp, Unknown
  misc_feature (1)..( 11): Result.005 file - promoters50/1976004
atgttagaagt

SEQ ID NO: 178783 - DNA, 11 bp, Unknown
  misc_feature (1)..( 11): Result.005 file - promoters50/1976004
aaattaattaa

SEQ ID NO: 178784 - DNA, 11 bp, Unknown
  misc_feature (1)..( 11): Result.005 file - promoters50/1976004
aggttattcca

SEQ ID NO: 178785 - DNA, 11 bp, Unknown
  misc_feature (1)..( 11): Result.005 file - promoters50/1976004
gtgtaatttgt

SEQ ID NO: 178786 - DNA, 11 bp, Unknown
  misc_feature (1)..( 11): Result.005 file - promoters50/1976004
tgtttatttta

SEQ ID NO: 178787 - DNA, 13 bp, Unknown
  misc_feature (1)..( 13): Result.005 file - promoters50/1976004
aatataatatata

SEQ ID NO: 178788 - DNA, 13 bp, Unknown
  misc_feature (1)..( 13): Result.005 file - promoters50/1976004
aataaaatattaa

SEQ ID NO: 178789 - DNA, 13 bp, Unknown
  misc_feature (1)..( 13): Result.005 file - promoters50/1976004
tgtctaatatcgt

SEQ ID NO: 178790 - DNA, 13 bp, Unknown
  misc_feature (1)..( 13): Result.005 file - promoters50/1976004
gataaaatcaaat

SEQ ID NO: 178791 - DNA, 13 bp, Unknown
  misc_feature (1)..( 13): Result.005 file - promoters50/1976004
aataaatacatct

SEQ ID NO: 178792 - DNA, 13 bp, Unknown
  misc_feature (1)..( 13): Result.005 file - promoters50/1976004
aacaaaaagtaaa

SEQ ID NO: 178793 - DNA, 13 bp, Unknown
  misc_feature (1)..( 13): Result.005 file - promoters50/1976004
aacataaattgtg

SEQ ID NO: 178794 - DNA, 7 bp, Unknown
  misc_feature (1)..( 7): Result.005 file - promoters50/1976011
catattc

SEQ ID NO: 178795 - DNA, 7 bp, Unknown
  misc_feature (1)..( 7): Result.005 file - promoters50/1976011
catattt

SEQ ID NO: 178796 - DNA, 8 bp, Unknown
  misc_feature (1)..( 8): Result.005 file - promoters50/1976011
tatagtta

SEQ ID NO: 178797 - DNA, 10 bp, Unknown
  misc_feature (1)..( 10): Result.005 file - promoters50/1976019
aaaaattcca

SEQ ID NO: 178798 - DNA, 10 bp, Unknown
  misc_feature (1)..( 10): Result.005 file - promoters50/1976019
aaaatttcta

SEQ ID NO: 178799 - DNA, 10 bp, Unknown
  misc_feature (1)..( 10): Result.005 file - promoters50/1976019
aaaataatat

SEQ ID NO: 178800 - DNA, 10 bp, Unknown
  misc_feature (1)..( 10): Result.005 file - promoters50/1976019
aaaaaaaagg

SEQ ID NO: 178801 - DNA, 10 bp, Unknown
  misc_feature (1)..( 10): Result.005 file - promoters50/1976019
ccaatgtcta

SEQ ID NO: 178802 - DNA, 10 bp, Unknown
  misc_feature (1)..( 10): Result.005 file - promoters50/1976019
caaatttcag

SEQ ID NO: 178803 - DNA, 12 bp, Unknown
  misc_feature (1)..( 12): Result.005 file - promoters50/1976047
aattaaaagatc

SEQ ID NO: 178804 - DNA, 12 bp, Unknown
  misc_feature (1)..( 12): Result.005 file - promoters50/1976047
ttttaaaaaatc

SEQ ID NO: 178805 - DNA, 12 bp, Unknown
  misc_feature (1)..( 12): Result.005 file - promoters50/1976047
atttaaatgggc

SEQ ID NO: 178806 - DNA, 7 bp, Unknown
  misc_feature (1)..( 7): Result.005 file - promoters50/1976047
tttctcg

SEQ ID NO: 178807 - DNA, 7 bp, Unknown
  misc_feature (1)..( 7): Result.005 file - promoters50/1976047
cttctcg

SEQ ID NO: 178808 - DNA, 7 bp, Unknown
  misc_feature (1)..( 7): Result.005 file - promoters50/1976047
tttctca

SEQ ID NO: 178809 - DNA, 9 bp, Unknown
  misc_feature (1)..( 9): Result.005 file - promoters50/1976047
gatttccgg

SEQ ID NO: 178810 - DNA, 9 bp, Unknown
  misc_feature (1)..( 9): Result.005 file - promoters50/1976047
gatttcaaa

SEQ ID NO: 178811 - DNA, 9 bp, Unknown
  misc_feature (1)..( 9): Result.005 file - promoters50/1976047
cattacaaa

SEQ ID NO: 178812 - DNA, 11 bp, Unknown
  misc_feature (1)..( 11): Result.005 file - promoters50/1976047
tcaaaaacctt

SEQ ID NO: 178813 - DNA, 11 bp, Unknown
  misc_feature (1)..( 11): Result.005 file - promoters50/1976047
tcataaagctt

SEQ ID NO: 178814 - DNA, 11 bp, Unknown
  misc_feature (1)..( 11): Result.005 file - promoters50/1976047
acataaaaatt

SEQ ID NO: 178815 - DNA, 10 bp, Unknown
  misc_feature (1)..( 10): Result.005 file - promoters50/1976047
actacataaa

SEQ ID NO: 178816 - DNA, 10 bp, Unknown
  misc_feature (1)..( 10): Result.005 file - promoters50/1976047
attacaaaaa

SEQ ID NO: 178817 - DNA, 10 bp, Unknown
  misc_feature (1)..( 10): Result.005 file - promoters50/1976047
atttcaaatt

SEQ ID NO: 178818 - DNA, 7 bp, Unknown
  misc_feature (1)..( 7): Result.005 file - promoters50/1976047
ttagttt

SEQ ID NO: 178819 - DNA, 7 bp, Unknown
  misc_feature (1)..( 7): Result.005 file - promoters50/1976047
ttaattt

SEQ ID NO: 178820 - DNA, 7 bp, Unknown
  misc_feature (1)..( 7): Result.005 file - promoters50/1976047
taaatta

SEQ ID NO: 178821 - DNA, 9 bp, Unknown
  misc_feature (1)..( 9): Result.005 file - promoters50/1976063
gatgatgct

SEQ ID NO: 178822 - DNA, 9 bp, Unknown
  misc_feature (1)..( 9): Result.005 file - promoters50/1976063
catgatgtc

SEQ ID NO: 178823 - DNA, 9 bp, Unknown
  misc_feature (1)..( 9): Result.005 file - promoters50/1976063
aatgaagct

SEQ ID NO: 178824 - DNA, 9 bp, Unknown
  misc_feature (1)..( 9): Result.005 file - promoters50/1976063
aatgaagaa

SEQ ID NO: 178825 - DNA, 7 bp, Unknown
  misc_feature (1)..( 7): Result.005 file - promoters50/1976063
attattc

SEQ ID NO: 178826 - DNA, 7 bp, Unknown
  misc_feature (1)..( 7): Result.005 file - promoters50/1976063
atttttc

SEQ ID NO: 178827 - DNA, 7 bp, Unknown
  misc_feature (1)..( 7): Result.005 file - promoters50/1976063
ttttttc

SEQ ID NO: 178828 - DNA, 13 bp, Unknown
  misc_feature (1)..( 13): Result.005 file - promoters50/1976078
tcaatgcaagtag

SEQ ID NO: 178829 - DNA, 13 bp, Unknown
  misc_feature (1)..( 13): Result.005 file - promoters50/1976078
aaaatgcattaac

SEQ ID NO: 178830 - DNA, 13 bp, Unknown
  misc_feature (1)..( 13): Result.005 file - promoters50/1976078
aaaatgaattctt

SEQ ID NO: 178831 - DNA, 13 bp, Unknown
  misc_feature (1)..( 13): Result.005 file - promoters50/1976078
tttatgaatctgc

SEQ ID NO: 178832 - DNA, 13 bp, Unknown
  misc_feature (1)..( 13): Result.005 file - promoters50/1976078
tgtataaatcatt

SEQ ID NO: 178833 - DNA, 11 bp, Unknown
  misc_feature (1)..( 11): Result.005 file - promoters50/1976078
tgtaaataatt

SEQ ID NO: 178834 - DNA, 12 bp, Unknown
  misc_feature (1)..( 12): Result.005 file - promoters50/1976078
gaataaaaacag

SEQ ID NO: 178835 - DNA, 12 bp, Unknown
  misc_feature (1)..( 12): Result.005 file - promoters50/1976078
gtttaaaaagaa

SEQ ID NO: 178836 - DNA, 12 bp, Unknown
  misc_feature (1)..( 12): Result.005 file - promoters50/1976078
ccagaaaaacag

SEQ ID NO: 178837 - DNA, 12 bp, Unknown
  misc_feature (1)..( 12): Result.005 file - promoters50/1976078
gaatgaaactag

SEQ ID NO: 178838 - DNA, 12 bp, Unknown
  misc_feature (1)..( 12): Result.005 file - promoters50/1976078
ccatgaaagtga

SEQ ID NO: 178839 - DNA, 12 bp, Unknown
  misc_feature (1)..( 12): Result.005 file - promoters50/1976078
aaatgaagaatt

SEQ ID NO: 178840 - DNA, 7 bp, Unknown
  misc_feature (1)..( 7): Result.005 file - promoters50/1976102
tttcaaa

SEQ ID NO: 178841 - DNA, 7 bp, Unknown
  misc_feature (1)..( 7): Result.005 file - promoters50/1976102
tttgaaa

SEQ ID NO: 178842 - DNA, 7 bp, Unknown
  misc_feature (1)..( 7): Result.005 file - promoters50/1976102
tttcaat

SEQ ID NO: 178843 - DNA, 10 bp, Unknown
  misc_feature (1)..( 10): Result.005 file - promoters50/1976102
tttttgctcc

SEQ ID NO: 178844 - DNA, 10 bp, Unknown
  misc_feature (1)..( 10): Result.005 file - promoters50/1976102
tttttgttcc

SEQ ID NO: 178845 - DNA, 10 bp, Unknown
  misc_feature (1)..( 10): Result.005 file - promoters50/1976102
tttgtgttgt

SEQ ID NO: 178846 - DNA, 8 bp, Unknown
  misc_feature (1)..( 8): Result.005 file - promoters50/1976107
tataattt

SEQ ID NO: 178847 - DNA, 8 bp, Unknown
  misc_feature (1)..( 8): Result.005 file - promoters50/1976107
attaattt

SEQ ID NO: 178848 - DNA, 8 bp, Unknown
  misc_feature (1)..( 8): Result.005 file - promoters50/1976107
tattatta

SEQ ID NO: 178849 - DNA, 10 bp, Unknown
  misc_feature (1)..( 10): Result.005 file - promoters50/1976107
tttaatttcc

SEQ ID NO: 178850 - DNA, 10 bp, Unknown
  misc_feature (1)..( 10): Result.005 file - promoters50/1976107
tttaatttat

SEQ ID NO: 178851 - DNA, 10 bp, Unknown
  misc_feature (1)..( 10): Result.005 file - promoters50/1976107
ctcaatctcc

SEQ ID NO: 178852 - DNA, 11 bp, Unknown
  misc_feature (1)..( 11): Result.005 file - promoters50/1976158
gaaattgattt

SEQ ID NO: 178853 - DNA, 11 bp, Unknown
  misc_feature (1)..( 11): Result.005 file - promoters50/1976158
ataatttattt

SEQ ID NO: 178854 - DNA, 11 bp, Unknown
  misc_feature (1)..( 11): Result.005 file - promoters50/1976158
catatctactc

SEQ ID NO: 178855 - DNA, 11 bp, Unknown
  misc_feature (1)..( 11): Result.005 file - promoters50/1976158
catttctacat

SEQ ID NO: 178856 - DNA, 9 bp, Unknown
  misc_feature (1)..( 9): Result.005 file - promoters50/1976158
gatttctta

SEQ ID NO: 178857 - DNA, 9 bp, Unknown
  misc_feature (1)..( 9): Result.005 file - promoters50/1976158
tttttttta

SEQ ID NO: 178858 - DNA, 9 bp, Unknown
  misc_feature (1)..( 9): Result.005 file - promoters50/1976158
catttctac

SEQ ID NO: 178859 - DNA, 9 bp, Unknown
  misc_feature (1)..( 9): Result.005 file - promoters50/1976158
catatctac

SEQ ID NO: 178860 - DNA, 13 bp, Unknown
  misc_feature (1)..( 13): Result.005 file - promoters50/1976158
atcaattttgtat

SEQ ID NO: 178861 - DNA, 13 bp, Unknown
  misc_feature (1)..( 13): Result.005 file - promoters50/1976158
aacaattttctat

SEQ ID NO: 178862 - DNA, 13 bp, Unknown
  misc_feature (1)..( 13): Result.005 file - promoters50/1976158
atcaattcgaatc

SEQ ID NO: 178863 - DNA, 13 bp, Unknown
  misc_feature (1)..( 13): Result.005 file - promoters50/1976158
tataatttttttt

SEQ ID NO: 178864 - DNA, 14 bp, Unknown
  misc_feature (1)..( 14): Result.005 file - promoters50/1976158
ttaatcaaaccaaa

SEQ ID NO: 178865 - DNA, 14 bp, Unknown
  misc_feature (1)..( 14): Result.005 file - promoters50/1976158
ttagtcaaaattct

SEQ ID NO: 178866 - DNA, 14 bp, Unknown
  misc_feature (1)..( 14): Result.005 file - promoters50/1976158
aaaatcaaaccaaa

SEQ ID NO: 178867 - DNA, 14 bp, Unknown
  misc_feature (1)..( 14): Result.005 file - promoters50/1976158
tgactcaaaagcta

SEQ ID NO: 178868 - DNA, 8 bp, Unknown
  misc_feature (1)..( 8): Result.005 file - promoters50/1976158
aaaaatta

SEQ ID NO: 178869 - DNA, 8 bp, Unknown
  misc_feature (1)..( 8): Result.005 file - promoters50/1976158
gaaaattc

SEQ ID NO: 178870 - DNA, 8 bp, Unknown
  misc_feature (1)..( 8): Result.005 file - promoters50/1976158
caaactat

SEQ ID NO: 178871 - DNA, 9 bp, Unknown
  misc_feature (1)..( 9): Result.005 file - promoters50/1976158
aaataattt

SEQ ID NO: 178872 - DNA, 9 bp, Unknown
  misc_feature (1)..( 9): Result.005 file - promoters50/1976158
attgtaatt

SEQ ID NO: 178873 - DNA, 9 bp, Unknown
  misc_feature (1)..( 9): Result.005 file - promoters50/1976158
actgtaatt

SEQ ID NO: 178874 - DNA, 9 bp, Unknown
  misc_feature (1)..( 9): Result.005 file - promoters50/1976158
attataacg

SEQ ID NO: 178875 - DNA, 9 bp, Unknown
  misc_feature (1)..( 9): Result.005 file - promoters50/1976158
cttgaaatc

SEQ ID NO: 178876 - DNA, 13 bp, Unknown
  misc_feature (1)..( 13): Result.005 file - promoters50/1976174
caaacttatccac

SEQ ID NO: 178877 - DNA, 13 bp, Unknown
  misc_feature (1)..( 13): Result.005 file - promoters50/1976174
taaacttaaactc

SEQ ID NO: 178878 - DNA, 13 bp, Unknown
  misc_feature (1)..( 13): Result.005 file - promoters50/1976174
aatacttatattc

SEQ ID NO: 178879 - DNA, 13 bp, Unknown
  misc_feature (1)..( 13): Result.005 file - promoters50/1976174
aatagttaacttt

SEQ ID NO: 178880 - DNA, 13 bp, Unknown
  misc_feature (1)..( 13): Result.005 file - promoters50/1976174
gttacttttatta

SEQ ID NO: 178881 - DNA, 13 bp, Unknown
  misc_feature (1)..( 13): Result.005 file - promoters50/1976174
tgatgtttgatta

SEQ ID NO: 178882 - DNA, 13 bp, Unknown
  misc_feature (1)..( 13): Result.005 file - promoters50/1976174
taatttaattctc

SEQ ID NO: 178883 - DNA, 13 bp, Unknown
  misc_feature (1)..( 13): Result.005 file - promoters50/1976174
ccaattatttcgt

SEQ ID NO: 178884 - DNA, 13 bp, Unknown
  misc_feature (1)..( 13): Result.005 file - promoters50/1976174
agatttaatttgt

SEQ ID NO: 178885 - DNA, 13 bp, Unknown
  misc_feature (1)..( 13): Result.005 file - promoters50/1976174
tcctttcattcct

SEQ ID NO: 178886 - DNA, 13 bp, Unknown
  misc_feature (1)..( 13): Result.005 file - promoters50/1976174
aataggaatgatt

SEQ ID NO: 178887 - DNA, 13 bp, Unknown
  misc_feature (1)..( 13): Result.005 file - promoters50/1976174
tttattatttcaa

SEQ ID NO: 178888 - DNA, 13 bp, Unknown
  misc_feature (1)..( 13): Result.005 file - promoters50/1976174
agatttatgttgt

SEQ ID NO: 178889 - DNA, 13 bp, Unknown
  misc_feature (1)..( 13): Result.005 file - promoters50/1976174
cgatgtaaaaatt

SEQ ID NO: 178890 - DNA, 17 bp, Unknown
  misc_feature (1)..( 17): Result.005 file - promoters50/1976174
actatatacaaaatctc

SEQ ID NO: 178891 - DNA, 17 bp, Unknown
  misc_feature (1)..( 17): Result.005 file - promoters50/1976174
accaataccaaaatatt

SEQ ID NO: 178892 - DNA, 17 bp, Unknown
  misc_feature (1)..( 17): Result.005 file - promoters50/1976174
acttttaacaaaacaat

SEQ ID NO: 178893 - DNA, 17 bp, Unknown
  misc_feature (1)..( 17): Result.005 file - promoters50/1976174
ctatgatttaaaatata

SEQ ID NO: 178894 - DNA, 17 bp, Unknown
  misc_feature (1)..( 17): Result.005 file - promoters50/1976174
tggtggaagaaagtatt

SEQ ID NO: 178895 - DNA, 17 bp, Unknown
  misc_feature (1)..( 17): Result.005 file - promoters50/1976174
aaaaaggataaaattag

SEQ ID NO: 178896 - DNA, 17 bp, Unknown
  misc_feature (1)..( 17): Result.005 file - promoters50/1976174
tattatttcaaatgaca

SEQ ID NO: 178897 - DNA, 11 bp, Unknown
  misc_feature (1)..( 11): Result.005 file - promoters50/1976174
ataaatacaat

SEQ ID NO: 178898 - DNA, 11 bp, Unknown
  misc_feature (1)..( 11): Result.005 file - promoters50/1976174
gtaaaaacaat

SEQ ID NO: 178899 - DNA, 11 bp, Unknown
  misc_feature (1)..( 11): Result.005 file - promoters50/1976174
atatataaaaa

SEQ ID NO: 178900 - DNA, 11 bp, Unknown
  misc_feature (1)..( 11): Result.005 file - promoters50/1976174
tgaaaaaatag

SEQ ID NO: 178901 - DNA, 11 bp, Unknown
  misc_feature (1)..( 11): Result.005 file - promoters50/1976174
gaagaaacaaa

SEQ ID NO: 178902 - DNA, 11 bp, Unknown
  misc_feature (1)..( 11): Result.005 file - promoters50/1976174
cacgaaccaat

SEQ ID NO: 178903 - DNA, 10 bp, Unknown
  misc_feature (1)..( 10): Result.005 file - promoters50/1976174
gatcttgtat

SEQ ID NO: 178904 - DNA, 10 bp, Unknown
  misc_feature (1)..( 10): Result.005 file - promoters50/1976174
gattttgttt

SEQ ID NO: 178905 - DNA, 10 bp, Unknown
  misc_feature (1)..( 10): Result.005 file - promoters50/1976174
tctcttgtaa

SEQ ID NO: 178906 - DNA, 10 bp, Unknown
  misc_feature (1)..( 10): Result.005 file - promoters50/1976174
cttcttttga

SEQ ID NO: 178907 - DNA, 10 bp, Unknown
  misc_feature (1)..( 10): Result.005 file - promoters50/1976174
atccttttgt

SEQ ID NO: 178908 - DNA, 10 bp, Unknown
  misc_feature (1)..( 10): Result.005 file - promoters50/1976174
gtttttgtct

SEQ ID NO: 178909 - DNA, 10 bp, Unknown
  misc_feature (1)..( 10): Result.005 file - promoters50/1976174
catgtttttg

SEQ ID NO: 178910 - DNA, 10 bp, Unknown
  misc_feature (1)..( 10): Result.005 file - promoters50/1976174
attgttttga

SEQ ID NO: 178911 - DNA, 11 bp, Unknown
  misc_feature (1)..( 11): Result.005 file - promoters50/1976174
gtcttttactt

SEQ ID NO: 178912 - DNA, 11 bp, Unknown
  misc_feature (1)..( 11): Result.005 file - promoters50/1976174
gtcatttaaaa

SEQ ID NO: 178913 - DNA, 11 bp, Unknown
  misc_feature (1)..( 11): Result.005 file - promoters50/1976174
aatttttactt

SEQ ID NO: 178914 - DNA, 11 bp, Unknown
  misc_feature (1)..( 11): Result.005 file - promoters50/1976174
actatttaaga

SEQ ID NO: 178915 - DNA, 11 bp, Unknown
  misc_feature (1)..( 11): Result.005 file - promoters50/1976174
atagtttacta

SEQ ID NO: 178916 - DNA, 11 bp, Unknown
  misc_feature (1)..( 11): Result.005 file - promoters50/1976174
tattcttaagc

SEQ ID NO: 178917 - DNA, 12 bp, Unknown
  misc_feature (1)..( 12): Result.005 file - promoters50/1976174
ttatataaagag

SEQ ID NO: 178918 - DNA, 12 bp, Unknown
  misc_feature (1)..( 12): Result.005 file - promoters50/1976174
tcatataagtaa

SEQ ID NO: 178919 - DNA, 12 bp, Unknown
  misc_feature (1)..( 12): Result.005 file - promoters50/1976174
ttatataaatcc

SEQ ID NO: 178920 - DNA, 12 bp, Unknown
  misc_feature (1)..( 12): Result.005 file - promoters50/1976174
taatataaaggt

SEQ ID NO: 178921 - DNA, 12 bp, Unknown
  misc_feature (1)..( 12): Result.005 file - promoters50/1976174
gcataaaagaga

SEQ ID NO: 178922 - DNA, 12 bp, Unknown
  misc_feature (1)..( 12): Result.005 file - promoters50/1976174
atttatgaatcc

SEQ ID NO: 178923 - DNA, 8 bp, Unknown
  misc_feature (1)..( 8): Result.005 file - promoters50/1976223
ctttcatt

SEQ ID NO: 178924 - DNA, 8 bp, Unknown
  misc_feature (1)..( 8): Result.005 file - promoters50/1976223
ctttcaat

SEQ ID NO: 178925 - DNA, 8 bp, Unknown
  misc_feature (1)..( 8): Result.005 file - promoters50/1976223
gtttgatt

SEQ ID NO: 178926 - DNA, 11 bp, Unknown
  misc_feature (1)..( 11): Result.005 file - promoters50/1976226
ctagatacagt

SEQ ID NO: 178927 - DNA, 11 bp, Unknown
  misc_feature (1)..( 11): Result.005 file - promoters50/1976226
acagagacatc

SEQ ID NO: 178928 - DNA, 11 bp, Unknown
  misc_feature (1)..( 11): Result.005 file - promoters50/1976226
tccgatccaga

SEQ ID NO: 178929 - DNA, 11 bp, Unknown
  misc_feature (1)..( 11): Result.005 file - promoters50/1976226
tcttataaagt

SEQ ID NO: 178930 - DNA, 11 bp, Unknown
  misc_feature (1)..( 11): Result.005 file - promoters50/1976226
attgatacaaa

SEQ ID NO: 178931 - DNA, 11 bp, Unknown
  misc_feature (1)..( 11): Result.005 file - promoters50/1976226
ctagatacaaa

SEQ ID NO: 178932 - DNA, 11 bp, Unknown
  misc_feature (1)..( 11): Result.005 file - promoters50/1976226
ttgtataaatc

SEQ ID NO: 178933 - DNA, 17 bp, Unknown
  misc_feature (1)..( 17): Result.005 file - promoters50/1976236
catcttctaaaatctta

SEQ ID NO: 178934 - DNA, 17 bp, Unknown
  misc_feature (1)..( 17): Result.005 file - promoters50/1976236
ctatttcaaaaatactt

SEQ ID NO: 178935 - DNA, 17 bp, Unknown
  misc_feature (1)..( 17): Result.005 file - promoters50/1976236
cattttctagaaataac

SEQ ID NO: 178936 - DNA, 17 bp, Unknown
  misc_feature (1)..( 17): Result.005 file - promoters50/1976236
catcttcaaaattatat

SEQ ID NO: 178937 - DNA, 17 bp, Unknown
  misc_feature (1)..( 17): Result.005 file - promoters50/1976236
ttttgctaaaaatcctt

SEQ ID NO: 178938 - DNA, 18 bp, Unknown
  misc_feature (1)..( 18): Result.005 file - promoters50/1976236
taaacgttaataataaat

SEQ ID NO: 178939 - DNA, 11 bp, Unknown
  misc_feature (1)..( 11): Result.005 file - promoters50/1976236
gattagtaaaa

SEQ ID NO: 178940 - DNA, 11 bp, Unknown
  misc_feature (1)..( 11): Result.005 file - promoters50/1976236
gattactaaca

SEQ ID NO: 178941 - DNA, 11 bp, Unknown
  misc_feature (1)..( 11): Result.005 file - promoters50/1976236
ttttagcaaat

SEQ ID NO: 178942 - DNA, 11 bp, Unknown
  misc_feature (1)..( 11): Result.005 file - promoters50/1976236
aaatacttaca

SEQ ID NO: 178943 - DNA, 11 bp, Unknown
  misc_feature (1)..( 11): Result.005 file - promoters50/1976236
attttttgcat

SEQ ID NO: 178944 - DNA, 11 bp, Unknown
  misc_feature (1)..( 11): Result.005 file - promoters50/1976236
aattttttttt

SEQ ID NO: 178945 - DNA, 9 bp, Unknown
  misc_feature (1)..( 9): Result.005 file - promoters50/1976270
aaatttttt

SEQ ID NO: 178946 - DNA, 9 bp, Unknown
  misc_feature (1)..( 9): Result.005 file - promoters50/1976270
aaacttttg

SEQ ID NO: 178947 - DNA, 9 bp, Unknown
  misc_feature (1)..( 9): Result.005 file - promoters50/1976270
ccatttttt

SEQ ID NO: 178948 - DNA, 7 bp, Unknown
  misc_feature (1)..( 7): Result.005 file - promoters50/1976270
aaaataa

SEQ ID NO: 178949 - DNA, 7 bp, Unknown
  misc_feature (1)..( 7): Result.005 file - promoters50/1976270
aaactaa

SEQ ID NO: 178950 - DNA, 7 bp, Unknown
  misc_feature (1)..( 7): Result.005 file - promoters50/1976270
aaaatat

SEQ ID NO: 178951 - DNA, 9 bp, Unknown
  misc_feature (1)..( 9): Result.005 file - promoters50/1976270
ctaataaaa

SEQ ID NO: 178952 - DNA, 9 bp, Unknown
  misc_feature (1)..( 9): Result.005 file - promoters50/1976270
ctaaaaaaa

SEQ ID NO: 178953 - DNA, 9 bp, Unknown
  misc_feature (1)..( 9): Result.005 file - promoters50/1976270
ataaaaaat

SEQ ID NO: 178954 - DNA, 7 bp, Unknown
  misc_feature (1)..( 7): Result.005 file - promoters50/1976270
aataata

SEQ ID NO: 178955 - DNA, 7 bp, Unknown
  misc_feature (1)..( 7): Result.005 file - promoters50/1976270
aataata

SEQ ID NO: 178956 - DNA, 7 bp, Unknown
  misc_feature (1)..( 7): Result.005 file - promoters50/1976270
aataatt

SEQ ID NO: 178957 - DNA, 8 bp, Unknown
  misc_feature (1)..( 8): Result.005 file - promoters50/1976270
atttattt

SEQ ID NO: 178958 - DNA, 8 bp, Unknown
  misc_feature (1)..( 8): Result.005 file - promoters50/1976270
ttttattg

SEQ ID NO: 178959 - DNA, 8 bp, Unknown
  misc_feature (1)..( 8): Result.005 file - promoters50/1976270
attttttt

SEQ ID NO: 178960 - DNA, 9 bp, Unknown
  misc_feature (1)..( 9): Result.005 file - promoters50/1976270
gattaaaat

SEQ ID NO: 178961 - DNA, 9 bp, Unknown
  misc_feature (1)..( 9): Result.005 file - promoters50/1976270
gataaaaaa

SEQ ID NO: 178962 - DNA, 9 bp, Unknown
  misc_feature (1)..( 9): Result.005 file - promoters50/1976270
tctaaaaaa

SEQ ID NO: 178963 - DNA, 9 bp, Unknown
  misc_feature (1)..( 9): Result.005 file - promoters50/1976270
ttaaaaaaa

SEQ ID NO: 178964 - DNA, 9 bp, Unknown
  misc_feature (1)..( 9): Result.005 file - promoters50/1976270
tcaaaaaaa

SEQ ID NO: 178965 - DNA, 9 bp, Unknown
  misc_feature (1)..( 9): Result.005 file - promoters50/1976270
tcaaaaata

SEQ ID NO: 178966 - DNA, 12 bp, Unknown
  misc_feature (1)..( 12): Result.005 file - promoters50/1976286
aaattttacaag

SEQ ID NO: 178967 - DNA, 12 bp, Unknown
  misc_feature (1)..( 12): Result.005 file - promoters50/1976286
aaattttcacat

SEQ ID NO: 178968 - DNA, 12 bp, Unknown
  misc_feature (1)..( 12): Result.005 file - promoters50/1976286
taattttagaag

SEQ ID NO: 178969 - DNA, 11 bp, Unknown
  misc_feature (1)..( 11): Result.005 file - promoters50/1976286
aattttacaag

SEQ ID NO: 178970 - DNA, 11 bp, Unknown
  misc_feature (1)..( 11): Result.005 file - promoters50/1976286
attttcacata

SEQ ID NO: 178971 - DNA, 11 bp, Unknown
  misc_feature (1)..( 11): Result.005 file - promoters50/1976286
aattttagaag

SEQ ID NO: 178972 - DNA, 9 bp, Unknown
  misc_feature (1)..( 9): Result.005 file - promoters50/1976286
catttttgt

SEQ ID NO: 178973 - DNA, 9 bp, Unknown
  misc_feature (1)..( 9): Result.005 file - promoters50/1976286
tattcttgt

SEQ ID NO: 178974 - DNA, 9 bp, Unknown
  misc_feature (1)..( 9): Result.005 file - promoters50/1976286
cattttagg

SEQ ID NO: 178975 - DNA, 8 bp, Unknown
  misc_feature (1)..( 8): Result.005 file - promoters50/1976286
aaatcaaa

SEQ ID NO: 178976 - DNA, 8 bp, Unknown
  misc_feature (1)..( 8): Result.005 file - promoters50/1976286
aaaacaat

SEQ ID NO: 178977 - DNA, 8 bp, Unknown
  misc_feature (1)..( 8): Result.005 file - promoters50/1976286
caaacaca

SEQ ID NO: 178978 - DNA, 8 bp, Unknown
  misc_feature (1)..( 8): Result.005 file - promoters50/1976286
taattatt

SEQ ID NO: 178979 - DNA, 8 bp, Unknown
  misc_feature (1)..( 8): Result.005 file - promoters50/1976286
aaataatt

SEQ ID NO: 178980 - DNA, 8 bp, Unknown
  misc_feature (1)..( 8): Result.005 file - promoters50/1976286
aaataaaa

SEQ ID NO: 178981 - DNA, 10 bp, Unknown
  misc_feature (1)..( 10): Result.005 file - promoters50/1976286
tactttttta

SEQ ID NO: 178982 - DNA, 10 bp, Unknown
  misc_feature (1)..( 10): Result.005 file - promoters50/1976286
tcctttttta

SEQ ID NO: 178983 - DNA, 10 bp, Unknown
  misc_feature (1)..( 10): Result.005 file - promoters50/1976286
tccttttctt

SEQ ID NO: 178984 - DNA, 8 bp, Unknown
  misc_feature (1)..( 8): Result.005 file - promoters50/1976286
gggctttt

SEQ ID NO: 178985 - DNA, 8 bp, Unknown
  misc_feature (1)..( 8): Result.005 file - promoters50/1976286
ccgctttt

SEQ ID NO: 178986 - DNA, 8 bp, Unknown
  misc_feature (1)..( 8): Result.005 file - promoters50/1976286
ccgatttg

SEQ ID NO: 178987 - DNA, 10 bp, Unknown
  misc_feature (1)..( 10): Result.005 file - promoters50/1976298
ttacaaaaaa

SEQ ID NO: 178988 - DNA, 10 bp, Unknown
  misc_feature (1)..( 10): Result.005 file - promoters50/1976298
agacagaaag

SEQ ID NO: 178989 - DNA, 11 bp, Unknown
  misc_feature (1)..( 11): Result.005 file - promoters50/1976298
caacaaataat

SEQ ID NO: 178990 - DNA, 7 bp, Unknown
  misc_feature (1)..( 7): Result.005 file - promoters50/1976298
attaaaa

SEQ ID NO: 178991 - DNA, 7 bp, Unknown
  misc_feature (1)..( 7): Result.005 file - promoters50/1976298
attaaaa

SEQ ID NO: 178992 - DNA, 7 bp, Unknown
  misc_feature (1)..( 7): Result.005 file - promoters50/1976298
attaaac

SEQ ID NO: 178993 - DNA, 9 bp, Unknown
  misc_feature (1)..( 9): Result.005 file - promoters50/1976298
taattaaat

SEQ ID NO: 178994 - DNA, 9 bp, Unknown
  misc_feature (1)..( 9): Result.005 file - promoters50/1976298
atattaaac

SEQ ID NO: 178995 - DNA, 9 bp, Unknown
  misc_feature (1)..( 9): Result.005 file - promoters50/1976298
taatttaat

SEQ ID NO: 178996 - DNA, 9 bp, Unknown
  misc_feature (1)..( 9): Result.005 file - promoters50/1976298
caattaaaa

SEQ ID NO: 178997 - DNA, 7 bp, Unknown
  misc_feature (1)..( 7): Result.005 file - promoters50/1976298
tctagac

SEQ ID NO: 178998 - DNA, 7 bp, Unknown
  misc_feature (1)..( 7): Result.005 file - promoters50/1976298
tcttgac

SEQ ID NO: 178999 - DNA, 7 bp, Unknown
  misc_feature (1)..( 7): Result.005 file - promoters50/1976298
tctagaa

SEQ ID NO: 179000 - DNA, 7 bp, Unknown
  misc_feature (1)..( 7): Result.005 file - promoters50/1976298
atatttt

SEQ ID NO: 179001 - DNA, 7 bp, Unknown
  misc_feature (1)..( 7): Result.005 file - promoters50/1976298
ttatttt

SEQ ID NO: 179002 - DNA, 7 bp, Unknown
  misc_feature (1)..( 7): Result.005 file - promoters50/1976298
atattta

SEQ ID NO: 179003 - DNA, 9 bp, Unknown
  misc_feature (1)..( 9): Result.005 file - promoters50/1976336
aaataaact

SEQ ID NO: 179004 - DNA, 9 bp, Unknown
  misc_feature (1)..( 9): Result.005 file - promoters50/1976336
aaacaaatc

SEQ ID NO: 179005 - DNA, 9 bp, Unknown
  misc_feature (1)..( 9): Result.005 file - promoters50/1976336
aaacaaata

SEQ ID NO: 179006 - DNA, 9 bp, Unknown
  misc_feature (1)..( 9): Result.005 file - promoters50/1976336
aaaccaatg

SEQ ID NO: 179007 - DNA, 9 bp, Unknown
  misc_feature (1)..( 9): Result.005 file - promoters50/1976336
gaacaaagg

SEQ ID NO: 179008 - DNA, 9 bp, Unknown
  misc_feature (1)..( 9): Result.005 file - promoters50/1976336
acacaaacc

SEQ ID NO: 179009 - DNA, 9 bp, Unknown
  misc_feature (1)..( 9): Result.005 file - promoters50/1976336
agaattttt

SEQ ID NO: 179010 - DNA, 9 bp, Unknown
  misc_feature (1)..( 9): Result.005 file - promoters50/1976336
agatttttt

SEQ ID NO: 179011 - DNA, 9 bp, Unknown
  misc_feature (1)..( 9): Result.005 file - promoters50/1976336
ggaaatttt

SEQ ID NO: 179012 - DNA, 9 bp, Unknown
  misc_feature (1)..( 9): Result.005 file - promoters50/1976336
caaattttt

SEQ ID NO: 179013 - DNA, 9 bp, Unknown
  misc_feature (1)..( 9): Result.005 file - promoters50/1976336
acgtttttt

SEQ ID NO: 179014 - DNA, 9 bp, Unknown
  misc_feature (1)..( 9): Result.005 file - promoters50/1976336
gtaatattt

SEQ ID NO: 179015 - DNA, 12 bp, Unknown
  misc_feature (1)..( 12): Result.005 file - promoters50/1976354
atagttaaactg

SEQ ID NO: 179016 - DNA, 12 bp, Unknown
  misc_feature (1)..( 12): Result.005 file - promoters50/1976354
atagttatcatc

SEQ ID NO: 179017 - DNA, 12 bp, Unknown
  misc_feature (1)..( 12): Result.005 file - promoters50/1976354
tcagttatcctc

SEQ ID NO: 179018 - DNA, 12 bp, Unknown
  misc_feature (1)..( 12): Result.005 file - promoters50/1976354
acagtgatcaaa

SEQ ID NO: 179019 - DNA, 12 bp, Unknown
  misc_feature (1)..( 12): Result.005 file - promoters50/1976354
ggcctgatgaaa

SEQ ID NO: 179020 - DNA, 12 bp, Unknown
  misc_feature (1)..( 12): Result.005 file - promoters50/1976354
gaactgaggaag

SEQ ID NO: 179021 - DNA, 11 bp, Unknown
  misc_feature (1)..( 11): Result.005 file - promoters50/1976373
tgtcaatgctg

SEQ ID NO: 179022 - DNA, 11 bp, Unknown
  misc_feature (1)..( 11): Result.005 file - promoters50/1976373
tgttaattaat

SEQ ID NO: 179023 - DNA, 11 bp, Unknown
  misc_feature (1)..( 11): Result.005 file - promoters50/1976373
atttaatcaat

SEQ ID NO: 179024 - DNA, 9 bp, Unknown
  misc_feature (1)..( 9): Result.005 file - promoters50/1976373
actgcacct

SEQ ID NO: 179025 - DNA, 9 bp, Unknown
  misc_feature (1)..( 9): Result.005 file - promoters50/1976373
actccacgt

SEQ ID NO: 179026 - DNA, 9 bp, Unknown
  misc_feature (1)..( 9): Result.005 file - promoters50/1976373
attccacgt

SEQ ID NO: 179027 - DNA, 9 bp, Unknown
  misc_feature (1)..( 9): Result.005 file - promoters50/1976373
cttatatac

SEQ ID NO: 179028 - DNA, 9 bp, Unknown
  misc_feature (1)..( 9): Result.005 file - promoters50/1976373
aatatatac

SEQ ID NO: 179029 - DNA, 9 bp, Unknown
  misc_feature (1)..( 9): Result.005 file - promoters50/1976373
aatttatct

SEQ ID NO: 179030 - DNA, 13 bp, Unknown
  misc_feature (1)..( 13): Result.005 file - promoters50/1976381
tgtacaagaaaaa

SEQ ID NO: 179031 - DNA, 13 bp, Unknown
  misc_feature (1)..( 13): Result.005 file - promoters50/1976381
gcaacaagaagag

SEQ ID NO: 179032 - DNA, 13 bp, Unknown
  misc_feature (1)..( 13): Result.005 file - promoters50/1976381
atcacaagaacta

SEQ ID NO: 179033 - DNA, 13 bp, Unknown
  misc_feature (1)..( 13): Result.005 file - promoters50/1976381
accacacgaaaaa

SEQ ID NO: 179034 - DNA, 13 bp, Unknown
  misc_feature (1)..( 13): Result.005 file - promoters50/1976381
tctccgagaaaaa

SEQ ID NO: 179035 - DNA, 13 bp, Unknown
  misc_feature (1)..( 13): Result.005 file - promoters50/1976381
gaaacagaaacct

SEQ ID NO: 179036 - DNA, 13 bp, Unknown
  misc_feature (1)..( 13): Result.005 file - promoters50/1976381
agtacacgacatc

SEQ ID NO: 179037 - DNA, 14 bp, Unknown
  misc_feature (1)..( 14): Result.005 file - promoters50/1976381
ttgtataaatcatt

SEQ ID NO: 179038 - DNA, 14 bp, Unknown
  misc_feature (1)..( 14): Result.005 file - promoters50/1976381
gtttatgaatctgc

SEQ ID NO: 179039 - DNA, 14 bp, Unknown
  misc_feature (1)..( 14): Result.005 file - promoters50/1976381
ttatgtaaataatt

SEQ ID NO: 179040 - DNA, 14 bp, Unknown
  misc_feature (1)..( 14): Result.005 file - promoters50/1976381
gtttctgaaacaga

SEQ ID NO: 179041 - DNA, 14 bp, Unknown
  misc_feature (1)..( 14): Result.005 file - promoters50/1976381
tcctttgattcttg

SEQ ID NO: 179042 - DNA, 14 bp, Unknown
  misc_feature (1)..( 14): Result.005 file - promoters50/1976381
cataatgaatgggc

SEQ ID NO: 179043 - DNA, 13 bp, Unknown
  misc_feature (1)..( 13): Result.005 file - promoters50/1976387
ctaaaggcccaat

SEQ ID NO: 179044 - DNA, 13 bp, Unknown
  misc_feature (1)..( 13): Result.005 file - promoters50/1976387
gtgaaagcccaaa

SEQ ID NO: 179045 - DNA, 13 bp, Unknown
  misc_feature (1)..( 13): Result.005 file - promoters50/1976387
ggaatggcccagt

SEQ ID NO: 179046 - DNA, 13 bp, Unknown
  misc_feature (1)..( 13): Result.005 file - promoters50/1976387
ctaaaggcccaat

SEQ ID NO: 179047 - DNA, 13 bp, Unknown
  misc_feature (1)..( 13): Result.005 file - promoters50/1976387
ggcttggcccaaa

SEQ ID NO: 179048 - DNA, 13 bp, Unknown
  misc_feature (1)..( 13): Result.005 file - promoters50/1976387
aattcggcccatc

SEQ ID NO: 179049 - DNA, 14 bp, Unknown
  misc_feature (1)..( 14): Result.005 file - promoters50/1976387
tcatcagaaaagtc

SEQ ID NO: 179050 - DNA, 14 bp, Unknown
  misc_feature (1)..( 14): Result.005 file - promoters50/1976387
acgtaagaaaaaaa

SEQ ID NO: 179051 - DNA, 14 bp, Unknown
  misc_feature (1)..( 14): Result.005 file - promoters50/1976387
attaaagaaaagac

SEQ ID NO: 179052 - DNA, 15 bp, Unknown
  misc_feature (1)..( 15): Result.005 file - promoters50/1976387
aatgtgttaaaagac

SEQ ID NO: 179053 - DNA, 15 bp, Unknown
  misc_feature (1)..( 15): Result.005 file - promoters50/1976387
gcataagataaaatc

SEQ ID NO: 179054 - DNA, 15 bp, Unknown
  misc_feature (1)..( 15): Result.005 file - promoters50/1976387
taatcaaataaaata

SEQ ID NO: 179055 - DNA, 8 bp, Unknown
  misc_feature (1)..( 8): Result.005 file - promoters50/1976412
ctaaaaat

SEQ ID NO: 179056 - DNA, 8 bp, Unknown
  misc_feature (1)..( 8): Result.005 file - promoters50/1976412
ctaataat

SEQ ID NO: 179057 - DNA, 8 bp, Unknown
  misc_feature (1)..( 8): Result.005 file - promoters50/1976412
ttaataat

SEQ ID NO: 179058 - DNA, 8 bp, Unknown
  misc_feature (1)..( 8): Result.005 file - promoters50/1976412
caaaatta

SEQ ID NO: 179059 - DNA, 8 bp, Unknown
  misc_feature (1)..( 8): Result.005 file - promoters50/1976412
aaaaatta

SEQ ID NO: 179060 - DNA, 8 bp, Unknown
  misc_feature (1)..( 8): Result.005 file - promoters50/1976412
caatattt

SEQ ID NO: 179061 - DNA, 8 bp, Unknown
  misc_feature (1)..( 8): Result.005 file - promoters50/1976412
ataaaaac

SEQ ID NO: 179062 - DNA, 8 bp, Unknown
  misc_feature (1)..( 8): Result.005 file - promoters50/1976412
ataataac

SEQ ID NO: 179063 - DNA, 8 bp, Unknown
  misc_feature (1)..( 8): Result.005 file - promoters50/1976412
ataatata

SEQ ID NO: 179064 - DNA, 8 bp, Unknown
  misc_feature (1)..( 8): Result.005 file - promoters50/1976412
ctatttaa

SEQ ID NO: 179065 - DNA, 8 bp, Unknown
  misc_feature (1)..( 8): Result.005 file - promoters50/1976412
ctaattat

SEQ ID NO: 179066 - DNA, 8 bp, Unknown
  misc_feature (1)..( 8): Result.005 file - promoters50/1976412
tgaattat

SEQ ID NO: 179067 - DNA, 7 bp, Unknown
  misc_feature (1)..( 7): Result.005 file - promoters50/1976412
caatttt

SEQ ID NO: 179068 - DNA, 7 bp, Unknown
  misc_feature (1)..( 7): Result.005 file - promoters50/1976412
taatttt

SEQ ID NO: 179069 - DNA, 7 bp, Unknown
  misc_feature (1)..( 7): Result.005 file - promoters50/1976412
taattta

SEQ ID NO: 179070 - DNA, 10 bp, Unknown
  misc_feature (1)..( 10): Result.005 file - promoters50/1976437
ttcttatcac

SEQ ID NO: 179071 - DNA, 10 bp, Unknown
  misc_feature (1)..( 10): Result.005 file - promoters50/1976437
ttcttaattt

SEQ ID NO: 179072 - DNA, 10 bp, Unknown
  misc_feature (1)..( 10): Result.005 file - promoters50/1976437
atcttgattt

SEQ ID NO: 179073 - DNA, 9 bp, Unknown
  misc_feature (1)..( 9): Result.005 file - promoters50/1976437
gaacattgt

SEQ ID NO: 179074 - DNA, 9 bp, Unknown
  misc_feature (1)..( 9): Result.005 file - promoters50/1976437
gaacatgac

SEQ ID NO: 179075 - DNA, 9 bp, Unknown
  misc_feature (1)..( 9): Result.005 file - promoters50/1976437
aaacaggac

SEQ ID NO: 179076 - DNA, 13 bp, Unknown
  misc_feature (1)..( 13): Result.005 file - promoters50/1976457
ttttaatatatat

SEQ ID NO: 179077 - DNA, 13 bp, Unknown
  misc_feature (1)..( 13): Result.005 file - promoters50/1976457
gtttactatttat

SEQ ID NO: 179078 - DNA, 14 bp, Unknown
  misc_feature (1)..( 14): Result.005 file - promoters50/1976457
tttgtaataataac

SEQ ID NO: 179079 - DNA, 14 bp, Unknown
  misc_feature (1)..( 14): Result.005 file - promoters50/1976457
tttttaatttcttt

SEQ ID NO: 179080 - DNA, 14 bp, Unknown
  misc_feature (1)..( 14): Result.005 file - promoters50/1976457
ctattaataaaatt

SEQ ID NO: 179081 - DNA, 14 bp, Unknown
  misc_feature (1)..( 14): Result.005 file - promoters50/1976457
aataaactcttttg

SEQ ID NO: 179082 - DNA, 10 bp, Unknown
  misc_feature (1)..( 10): Result.005 file - promoters50/1976457
taaataatat

SEQ ID NO: 179083 - DNA, 10 bp, Unknown
  misc_feature (1)..( 10): Result.005 file - promoters50/1976457
ataataatgt

SEQ ID NO: 179084 - DNA, 10 bp, Unknown
  misc_feature (1)..( 10): Result.005 file - promoters50/1976457
caaagaataa

SEQ ID NO: 179085 - DNA, 10 bp, Unknown
  misc_feature (1)..( 10): Result.005 file - promoters50/1976457
tatatagtat

SEQ ID NO: 179086 - DNA, 10 bp, Unknown
  misc_feature (1)..( 10): Result.005 file - promoters50/1976457
gtaataataa

SEQ ID NO: 179087 - DNA, 10 bp, Unknown
  misc_feature (1)..( 10): Result.005 file - promoters50/1976457
ttaataaaat

SEQ ID NO: 179088 - DNA, 10 bp, Unknown
  misc_feature (1)..( 10): Result.005 file - promoters50/1976457
ataataaact

SEQ ID NO: 179089 - DNA, 10 bp, Unknown
  misc_feature (1)..( 10): Result.005 file - promoters50/1976457
atactaaaag

SEQ ID NO: 179090 - DNA, 12 bp, Unknown
  misc_feature (1)..( 12): Result.005 file - promoters50/1976504
attttgttttct

SEQ ID NO: 179091 - DNA, 12 bp, Unknown
  misc_feature (1)..( 12): Result.005 file - promoters50/1976504
attatgtcttcc

SEQ ID NO: 179092 - DNA, 12 bp, Unknown
  misc_feature (1)..( 12): Result.005 file - promoters50/1976504
ctattgttttga

SEQ ID NO: 179093 - DNA, 12 bp, Unknown
  misc_feature (1)..( 12): Result.005 file - promoters50/1976504
attttgtggtga

SEQ ID NO: 179094 - DNA, 12 bp, Unknown
  misc_feature (1)..( 12): Result.005 file - promoters50/1976504
gcagcgttttct

SEQ ID NO: 179095 - DNA, 12 bp, Unknown
  misc_feature (1)..( 12): Result.005 file - promoters50/1976504
ttttagtgatat

SEQ ID NO: 179096 - DNA, 12 bp, Unknown
  misc_feature (1)..( 12): Result.005 file - promoters50/1976504
taaaatatatat

SEQ ID NO: 179097 - DNA, 12 bp, Unknown
  misc_feature (1)..( 12): Result.005 file - promoters50/1976504
gaaagtattcag

SEQ ID NO: 179098 - DNA, 12 bp, Unknown
  misc_feature (1)..( 12): Result.005 file - promoters50/1976504
gaaaacataaca

SEQ ID NO: 179099 - DNA, 12 bp, Unknown
  misc_feature (1)..( 12): Result.005 file - promoters50/1976504
taaaattcaagg

SEQ ID NO: 179100 - DNA, 12 bp, Unknown
  misc_feature (1)..( 12): Result.005 file - promoters50/1976504
tgaagtatcctc

SEQ ID NO: 179101 - DNA, 12 bp, Unknown
  misc_feature (1)..( 12): Result.005 file - promoters50/1976504
aaaaacaaattt

SEQ ID NO: 179102 - DNA, 12 bp, Unknown
  misc_feature (1)..( 12): Result.005 file - promoters50/1976504
ctgaacagaaca

SEQ ID NO: 179103 - DNA, 12 bp, Unknown
  misc_feature (1)..( 12): Result.005 file - promoters50/1976504
ggcctaaatact

SEQ ID NO: 179104 - DNA, 12 bp, Unknown
  misc_feature (1)..( 12): Result.005 file - promoters50/1976504
tctgaaaataca

SEQ ID NO: 179105 - DNA, 12 bp, Unknown
  misc_feature (1)..( 12): Result.005 file - promoters50/1976504
agagaaaataaa

SEQ ID NO: 179106 - DNA, 12 bp, Unknown
  misc_feature (1)..( 12): Result.005 file - promoters50/1976504
tattaaaaaaaa

SEQ ID NO: 179107 - DNA, 12 bp, Unknown
  misc_feature (1)..( 12): Result.005 file - promoters50/1976504
atttaaaaacaa

SEQ ID NO: 179108 - DNA, 12 bp, Unknown
  misc_feature (1)..( 12): Result.005 file - promoters50/1976504
cattaataaatt

SEQ ID NO: 179109 - DNA, 12 bp, Unknown
  misc_feature (1)..( 12): Result.005 file - promoters50/1976504
ttttaaaacaag

SEQ ID NO: 179110 - DNA, 12 bp, Unknown
  misc_feature (1)..( 12): Result.005 file - promoters50/1976504
ttttaatctgaa

SEQ ID NO: 179111 - DNA, 12 bp, Unknown
  misc_feature (1)..( 12): Result.005 file - promoters50/1976504
atttaaaaacaa

SEQ ID NO: 179112 - DNA, 12 bp, Unknown
  misc_feature (1)..( 12): Result.005 file - promoters50/1976504
attgaaacgttg

SEQ ID NO: 179113 - DNA, 12 bp, Unknown
  misc_feature (1)..( 12): Result.005 file - promoters50/1976504
attgaataaaag

SEQ ID NO: 179114 - DNA, 12 bp, Unknown
  misc_feature (1)..( 12): Result.005 file - promoters50/1976504
attaaaaaaaaa

SEQ ID NO: 179115 - DNA, 11 bp, Unknown
  misc_feature (1)..( 11): Result.005 file - promoters50/1976511
gagaaagctgg

SEQ ID NO: 179116 - DNA, 11 bp, Unknown
  misc_feature (1)..( 11): Result.005 file - promoters50/1976511
cagagagctca

SEQ ID NO: 179117 - DNA, 11 bp, Unknown
  misc_feature (1)..( 11): Result.005 file - promoters50/1976511
gtcaaacctga

SEQ ID NO: 179118 - DNA, 11 bp, Unknown
  misc_feature (1)..( 11): Result.005 file - promoters50/1976511
cagagactaac

SEQ ID NO: 179119 - DNA, 11 bp, Unknown
  misc_feature (1)..( 11): Result.005 file - promoters50/1976511
ttacaacatga

SEQ ID NO: 179120 - DNA, 11 bp, Unknown
  misc_feature (1)..( 11): Result.005 file - promoters50/1976511
ttggtacatga

SEQ ID NO: 179121 - DNA, 16 bp, Unknown
  misc_feature (1)..( 16): Result.005 file - promoters50/1976511
taccattttgatttga

SEQ ID NO: 179122 - DNA, 16 bp, Unknown
  misc_feature (1)..( 16): Result.005 file - promoters50/1976511
ataaattttgattaaa

SEQ ID NO: 179123 - DNA, 16 bp, Unknown
  misc_feature (1)..( 16): Result.005 file - promoters50/1976511
agtggttttgactaga

SEQ ID NO: 179124 - DNA, 16 bp, Unknown
  misc_feature (1)..( 16): Result.005 file - promoters50/1976511
gtgattactgattaat

SEQ ID NO: 179125 - DNA, 16 bp, Unknown
  misc_feature (1)..( 16): Result.005 file - promoters50/1976511
agtcgttttgttttta

SEQ ID NO: 179126 - DNA, 16 bp, Unknown
  misc_feature (1)..( 16): Result.005 file - promoters50/1976511
gcgaatcaaaattaat

SEQ ID NO: 179127 - DNA, 9 bp, Unknown
  misc_feature (1)..( 9): Result.005 file - promoters50/1976511
gttttttct

SEQ ID NO: 179128 - DNA, 9 bp, Unknown
  misc_feature (1)..( 9): Result.005 file - promoters50/1976511
ctttcttct

SEQ ID NO: 179129 - DNA, 9 bp, Unknown
  misc_feature (1)..( 9): Result.005 file - promoters50/1976511
gtttttgaa

SEQ ID NO: 179130 - DNA, 9 bp, Unknown
  misc_feature (1)..( 9): Result.005 file - promoters50/1976511
gttgtttag

SEQ ID NO: 179131 - DNA, 9 bp, Unknown
  misc_feature (1)..( 9): Result.005 file - promoters50/1976511
tcttcttct

SEQ ID NO: 179132 - DNA, 9 bp, Unknown
  misc_feature (1)..( 9): Result.005 file - promoters50/1976511
tctttttgt

SEQ ID NO: 179133 - DNA, 10 bp, Unknown
  misc_feature (1)..( 10): Result.005 file - promoters50/1976550
taatctgatc

SEQ ID NO: 179134 - DNA, 10 bp, Unknown
  misc_feature (1)..( 10): Result.005 file - promoters50/1976550
caatcttatc

SEQ ID NO: 179135 - DNA, 10 bp, Unknown
  misc_feature (1)..( 10): Result.005 file - promoters50/1976550
taatttgata

SEQ ID NO: 179136 - DNA, 13 bp, Unknown
  misc_feature (1)..( 13): Result.005 file - promoters50/1977519
ttgaatcaatatt

SEQ ID NO: 179137 - DNA, 13 bp, Unknown
  misc_feature (1)..( 13): Result.005 file - promoters50/1977519
ttgattcaaaatt

SEQ ID NO: 179138 - DNA, 13 bp, Unknown
  misc_feature (1)..( 13): Result.005 file - promoters50/1977519
ttgagtcaattat

SEQ ID NO: 179139 - DNA, 9 bp, Unknown
  misc_feature (1)..( 9): Result.005 file - promoters50/1977519
gatttggtt

SEQ ID NO: 179140 - DNA, 9 bp, Unknown
  misc_feature (1)..( 9): Result.005 file - promoters50/1977519
gtcttggtt

SEQ ID NO: 179141 - DNA, 9 bp, Unknown
  misc_feature (1)..( 9): Result.005 file - promoters50/1977519
gattttgtt

SEQ ID NO: 179142 - DNA, 7 bp, Unknown
  misc_feature (1)..( 7): Result.005 file - promoters50/1977529
cttcaat

SEQ ID NO: 179143 - DNA, 7 bp, Unknown
  misc_feature (1)..( 7): Result.005 file - promoters50/1977529
cttcaaa

SEQ ID NO: 179144 - DNA, 7 bp, Unknown
  misc_feature (1)..( 7): Result.005 file - promoters50/1977529
attcaaa

SEQ ID NO: 179145 - DNA, 7 bp, Unknown
  misc_feature (1)..( 7): Result.005 file - promoters50/1977529
ttcaaac

SEQ ID NO: 179146 - DNA, 7 bp, Unknown
  misc_feature (1)..( 7): Result.005 file - promoters50/1977529
ttcaaac

SEQ ID NO: 179147 - DNA, 7 bp, Unknown
  misc_feature (1)..( 7): Result.005 file - promoters50/1977529
ttcaaaa

SEQ ID NO: 179148 - DNA, 9 bp, Unknown
  misc_feature (1)..( 9): Result.005 file - promoters50/1977533
ctaagttta

SEQ ID NO: 179149 - DNA, 9 bp, Unknown
  misc_feature (1)..( 9): Result.005 file - promoters50/1977533
aaaagtttg

SEQ ID NO: 179150 - DNA, 9 bp, Unknown
  misc_feature (1)..( 9): Result.005 file - promoters50/1977533
ataaatttg

SEQ ID NO: 179151 - DNA, 9 bp, Unknown
  misc_feature (1)..( 9): Result.005 file - promoters50/1977533
aaaagtttg

SEQ ID NO: 179152 - DNA, 9 bp, Unknown
  misc_feature (1)..( 9): Result.005 file - promoters50/1977533
catagttta

SEQ ID NO: 179153 - DNA, 9 bp, Unknown
  misc_feature (1)..( 9): Result.005 file - promoters50/1977533
aaaagcttg

SEQ ID NO: 179154 - DNA, 9 bp, Unknown
  misc_feature (1)..( 9): Result.005 file - promoters50/1977533
taaacccta

SEQ ID NO: 179155 - DNA, 9 bp, Unknown
  misc_feature (1)..( 9): Result.005 file - promoters50/1977533
aaaaccctg

SEQ ID NO: 179156 - DNA, 9 bp, Unknown
  misc_feature (1)..( 9): Result.005 file - promoters50/1977533
gaaacccta

SEQ ID NO: 179157 - DNA, 9 bp, Unknown
  misc_feature (1)..( 9): Result.005 file - promoters50/1977533
aaaacctag

SEQ ID NO: 179158 - DNA, 9 bp, Unknown
  misc_feature (1)..( 9): Result.005 file - promoters50/1977533
taaatctaa

SEQ ID NO: 179159 - DNA, 9 bp, Unknown
  misc_feature (1)..( 9): Result.005 file - promoters50/1977533
aaaaactag

SEQ ID NO: 179160 - DNA, 12 bp, Unknown
  misc_feature (1)..( 12): Result.005 file - promoters50/1977533
ctcttaaaattg

SEQ ID NO: 179161 - DNA, 12 bp, Unknown
  misc_feature (1)..( 12): Result.005 file - promoters50/1977533
agaacaaacttg

SEQ ID NO: 179162 - DNA, 12 bp, Unknown
  misc_feature (1)..( 12): Result.005 file - promoters50/1977533
ttgttaaaatat

SEQ ID NO: 179163 - DNA, 12 bp, Unknown
  misc_feature (1)..( 12): Result.005 file - promoters50/1977533
aaaaaaaacttg

SEQ ID NO: 179164 - DNA, 12 bp, Unknown
  misc_feature (1)..( 12): Result.005 file - promoters50/1977533
taagcaaactta

SEQ ID NO: 179165 - DNA, 12 bp, Unknown
  misc_feature (1)..( 12): Result.005 file - promoters50/1977533
ttgttaaatctc

SEQ ID NO: 179166 - DNA, 10 bp, Unknown
  misc_feature (1)..( 10): Result.005 file - promoters50/1977537
agattttgag

SEQ ID NO: 179167 - DNA, 10 bp, Unknown
  misc_feature (1)..( 10): Result.005 file - promoters50/1977537
tgattttttt

SEQ ID NO: 179168 - DNA, 10 bp, Unknown
  misc_feature (1)..( 10): Result.005 file - promoters50/1977537
ctattttttt

SEQ ID NO: 179169 - DNA, 10 bp, Unknown
  misc_feature (1)..( 10): Result.005 file - promoters50/1977537
tgatttggtt

SEQ ID NO: 179170 - DNA, 10 bp, Unknown
  misc_feature (1)..( 10): Result.005 file - promoters50/1977537
tgaattgtta

SEQ ID NO: 179171 - DNA, 11 bp, Unknown
  misc_feature (1)..( 11): Result.005 file - promoters50/1977537
aaatttaatta

SEQ ID NO: 179172 - DNA, 11 bp, Unknown
  misc_feature (1)..( 11): Result.005 file - promoters50/1977537
aaatttggtaa

SEQ ID NO: 179173 - DNA, 11 bp, Unknown
  misc_feature (1)..( 11): Result.005 file - promoters50/1977537
caatataagtc

SEQ ID NO: 179174 - DNA, 11 bp, Unknown
  misc_feature (1)..( 11): Result.005 file - promoters50/1977537
caatatcccta

SEQ ID NO: 179175 - DNA, 11 bp, Unknown
  misc_feature (1)..( 11): Result.005 file - promoters50/1977537
acgtatacgtc

SEQ ID NO: 179176 - DNA, 7 bp, Unknown
  misc_feature (1)..( 7): Result.005 file - promoters50/1985373
ttttttt

SEQ ID NO: 179177 - DNA, 7 bp, Unknown
  misc_feature (1)..( 7): Result.005 file - promoters50/1985373
ttttttt

SEQ ID NO: 179178 - DNA, 7 bp, Unknown
  misc_feature (1)..( 7): Result.005 file - promoters50/1985373
tttttta

SEQ ID NO: 179179 - DNA, 15 bp, Unknown
  misc_feature (1)..( 15): Result.005 file - promoters50/1985373
tatgcttatttttca

SEQ ID NO: 179180 - DNA, 15 bp, Unknown
  misc_feature (1)..( 15): Result.005 file - promoters50/1985373
tatgtttaatttaca

SEQ ID NO: 179181 - DNA, 15 bp, Unknown
  misc_feature (1)..( 15): Result.005 file - promoters50/1985373
aatatataatttaca

SEQ ID NO: 179182 - DNA, 9 bp, Unknown
  misc_feature (1)..( 9): Result.005 file - promoters50/1985373
atacagtat

SEQ ID NO: 179183 - DNA, 9 bp, Unknown
  misc_feature (1)..( 9): Result.005 file - promoters50/1985373
ataaagtat

SEQ ID NO: 179184 - DNA, 9 bp, Unknown
  misc_feature (1)..( 9): Result.005 file - promoters50/1985373
ttaaaaacc

SEQ ID NO: 179185 - DNA, 9 bp, Unknown
  misc_feature (1)..( 9): Result.005 file - promoters50/1985373
aaaacaaaa

SEQ ID NO: 179186 - DNA, 9 bp, Unknown
  misc_feature (1)..( 9): Result.005 file - promoters50/1985373
gaaataaaa

SEQ ID NO: 179187 - DNA, 9 bp, Unknown
  misc_feature (1)..( 9): Result.005 file - promoters50/1985373
gaaatacaa

SEQ ID NO: 179188 - DNA, 10 bp, Unknown
  misc_feature (1)..( 10): Result.005 file - promoters50/1985415
aatatacagt

SEQ ID NO: 179189 - DNA, 10 bp, Unknown
  misc_feature (1)..( 10): Result.005 file - promoters50/1985415
tataaacact

SEQ ID NO: 179190 - DNA, 10 bp, Unknown
  misc_feature (1)..( 10): Result.005 file - promoters50/1985415
tatatagagt

SEQ ID NO: 179191 - DNA, 10 bp, Unknown
  misc_feature (1)..( 10): Result.005 file - promoters50/1985415
tttaaaaaaa

SEQ ID NO: 179192 - DNA, 10 bp, Unknown
  misc_feature (1)..( 10): Result.005 file - promoters50/1985415
ttttaacaaa

SEQ ID NO: 179193 - DNA, 8 bp, Unknown
  misc_feature (1)..( 8): Result.005 file - promoters50/1985415
ctcatttc

SEQ ID NO: 179194 - DNA, 8 bp, Unknown
  misc_feature (1)..( 8): Result.005 file - promoters50/1985415
ctcatttt

SEQ ID NO: 179195 - DNA, 9 bp, Unknown
  misc_feature (1)..( 9): Result.005 file - promoters50/1985415
aacatgttg

SEQ ID NO: 179196 - DNA, 9 bp, Unknown
  misc_feature (1)..( 9): Result.005 file - promoters50/1985415
aacattttt

SEQ ID NO: 179197 - DNA, 9 bp, Unknown
  misc_feature (1)..( 9): Result.005 file - promoters50/1985415
ttaatattt

SEQ ID NO: 179198 - DNA, 8 bp, Unknown
  misc_feature (1)..( 8): Result.005 file - promoters50/1985415
cttttaaa

SEQ ID NO: 179199 - DNA, 8 bp, Unknown
  misc_feature (1)..( 8): Result.005 file - promoters50/1985415
tttttaac

SEQ ID NO: 179200 - DNA, 8 bp, Unknown
  misc_feature (1)..( 8): Result.005 file - promoters50/1985415
attttaaa

SEQ ID NO: 179201 - DNA, 8 bp, Unknown
  misc_feature (1)..( 8): Result.005 file - promoters50/1985415
cttataaa

SEQ ID NO: 179202 - DNA, 8 bp, Unknown
  misc_feature (1)..( 8): Result.005 file - promoters50/1985415
cttttatc

SEQ ID NO: 179203 - DNA, 10 bp, Unknown
  misc_feature (1)..( 10): Result.005 file - promoters50/1985477
cgttagaaac

SEQ ID NO: 179204 - DNA, 10 bp, Unknown
  misc_feature (1)..( 10): Result.005 file - promoters50/1985477
tattataaaa

SEQ ID NO: 179205 - DNA, 11 bp, Unknown
  misc_feature (1)..( 11): Result.005 file - promoters50/1985477
tattattaaaa

SEQ ID NO: 179206 - DNA, 9 bp, Unknown
  misc_feature (1)..( 9): Result.005 file - promoters50/1985588
aattttatt

SEQ ID NO: 179207 - DNA, 9 bp, Unknown
  misc_feature (1)..( 9): Result.005 file - promoters50/1985588
gttttgatt

SEQ ID NO: 179208 - DNA, 9 bp, Unknown
  misc_feature (1)..( 9): Result.005 file - promoters50/1985588
aatcttata

SEQ ID NO: 179209 - DNA, 9 bp, Unknown
  misc_feature (1)..( 9): Result.005 file - promoters50/1985590
caaaataaa

SEQ ID NO: 179210 - DNA, 9 bp, Unknown
  misc_feature (1)..( 9): Result.005 file - promoters50/1985590
aaaactaat

SEQ ID NO: 179211 - DNA, 9 bp, Unknown
  misc_feature (1)..( 9): Result.005 file - promoters50/1985590
caaaataca

SEQ ID NO: 179212 - DNA, 9 bp, Unknown
  misc_feature (1)..( 9): Result.005 file - promoters50/1985590
aaaacttaa

SEQ ID NO: 179213 - DNA, 9 bp, Unknown
  misc_feature (1)..( 9): Result.005 file - promoters50/1985590
gaaaattta

SEQ ID NO: 179214 - DNA, 7 bp, Unknown
  misc_feature (1)..( 7): Result.005 file - promoters50/1985621
aaagtaa

SEQ ID NO: 179215 - DNA, 7 bp, Unknown
  misc_feature (1)..( 7): Result.005 file - promoters50/1985621
aaaataa

SEQ ID NO: 179216 - DNA, 7 bp, Unknown
  misc_feature (1)..( 7): Result.005 file - promoters50/1985621
aaactaa

SEQ ID NO: 179217 - DNA, 6 bp, Unknown
  misc_feature (1)..( 6): Result.005 file - promoters50/1985854
ttttct

SEQ ID NO: 179218 - DNA, 6 bp, Unknown
  misc_feature (1)..( 6): Result.005 file - promoters50/1985854
ttttct

SEQ ID NO: 179219 - DNA, 6 bp, Unknown
  misc_feature (1)..( 6): Result.005 file - promoters50/1985854
ttttct

SEQ ID NO: 179220 - DNA, 13 bp, Unknown
  misc_feature (1)..( 13): Result.005 file - promoters50/1985854
gaatcaaacgaaa

SEQ ID NO: 179221 - DNA, 13 bp, Unknown
  misc_feature (1)..( 13): Result.005 file - promoters50/1985854
aaataaaaccaaa

SEQ ID NO: 179222 - DNA, 13 bp, Unknown
  misc_feature (1)..( 13): Result.005 file - promoters50/1985854
aaataatatagtt

SEQ ID NO: 179223 - DNA, 8 bp, Unknown
  misc_feature (1)..( 8): Result.005 file - promoters50/1985854
caaccaac

SEQ ID NO: 179224 - DNA, 8 bp, Unknown
  misc_feature (1)..( 8): Result.005 file - promoters50/1985854
gtaccaac

SEQ ID NO: 179225 - DNA, 8 bp, Unknown
  misc_feature (1)..( 8): Result.005 file - promoters50/1985854
caatcaaa

SEQ ID NO: 179226 - DNA, 8 bp, Unknown
  misc_feature (1)..( 8): Result.005 file - promoters50/1985854
aattttta

SEQ ID NO: 179227 - DNA, 8 bp, Unknown
  misc_feature (1)..( 8): Result.005 file - promoters50/1985854
aatattta

SEQ ID NO: 179228 - DNA, 8 bp, Unknown
  misc_feature (1)..( 8): Result.005 file - promoters50/1985854
aattttta

SEQ ID NO: 179229 - DNA, 9 bp, Unknown
  misc_feature (1)..( 9): Result.005 file - promoters50/2024838
ggtgttttg

SEQ ID NO: 179230 - DNA, 9 bp, Unknown
  misc_feature (1)..( 9): Result.005 file - promoters50/2024838
tttgttttg

SEQ ID NO: 179231 - DNA, 9 bp, Unknown
  misc_feature (1)..( 9): Result.005 file - promoters50/2024838
tttgtttgg

SEQ ID NO: 179232 - DNA, 9 bp, Unknown
  misc_feature (1)..( 9): Result.005 file - promoters50/2024873
aaatgaaga

SEQ ID NO: 179233 - DNA, 9 bp, Unknown
  misc_feature (1)..( 9): Result.005 file - promoters50/2024873
aaaggaaaa

SEQ ID NO: 179234 - DNA, 9 bp, Unknown
  misc_feature (1)..( 9): Result.005 file - promoters50/2024873
aaataaagc

SEQ ID NO: 179235 - DNA, 9 bp, Unknown
  misc_feature (1)..( 9): Result.005 file - promoters50/2024873
aaataaata

SEQ ID NO: 179236 - DNA, 9 bp, Unknown
  misc_feature (1)..( 9): Result.005 file - promoters50/2024873
tcataaatc

SEQ ID NO: 179237 - DNA, 8 bp, Unknown
  misc_feature (1)..( 8): Result.005 file - promoters50/2024930
tattttag

SEQ ID NO: 179238 - DNA, 8 bp, Unknown
  misc_feature (1)..( 8): Result.005 file - promoters50/2024930
tattatag

SEQ ID NO: 179239 - DNA, 8 bp, Unknown
  misc_feature (1)..( 8): Result.005 file - promoters50/2024930
tattatgt

SEQ ID NO: 179240 - DNA, 9 bp, Unknown
  misc_feature (1)..( 9): Result.005 file - promoters50/2024930
caaatttta

SEQ ID NO: 179241 - DNA, 9 bp, Unknown
  misc_feature (1)..( 9): Result.005 file - promoters50/2024930
ataattttt

SEQ ID NO: 179242 - DNA, 9 bp, Unknown
  misc_feature (1)..( 9): Result.005 file - promoters50/2024930
tttatttta

SEQ ID NO: 179243 - DNA, 10 bp, Unknown
  misc_feature (1)..( 10): Result.005 file - promoters50/2024930
ataatgtttg

SEQ ID NO: 179244 - DNA, 8 bp, Unknown
  misc_feature (1)..( 8): Result.005 file - promoters50/2024930
ttgagtct

SEQ ID NO: 179245 - DNA, 8 bp, Unknown
  misc_feature (1)..( 8): Result.005 file - promoters50/2024930
atgattct

SEQ ID NO: 179246 - DNA, 8 bp, Unknown
  misc_feature (1)..( 8): Result.005 file - promoters50/2024930
ttgagtca

SEQ ID NO: 179247 - DNA, 9 bp, Unknown
  misc_feature (1)..( 9): Result.005 file - promoters50/2024930
taatttagt

SEQ ID NO: 179248 - DNA, 9 bp, Unknown
  misc_feature (1)..( 9): Result.005 file - promoters50/2024930
gaatctagt

SEQ ID NO: 179249 - DNA, 9 bp, Unknown
  misc_feature (1)..( 9): Result.005 file - promoters50/2024930
gaatctcct

SEQ ID NO: 179250 - DNA, 9 bp, Unknown
  misc_feature (1)..( 9): Result.005 file - promoters50/2024930
caaaataag

SEQ ID NO: 179251 - DNA, 9 bp, Unknown
  misc_feature (1)..( 9): Result.005 file - promoters50/2024930
tcaaaaaag

SEQ ID NO: 179252 - DNA, 9 bp, Unknown
  misc_feature (1)..( 9): Result.005 file - promoters50/2024930
tcaaaaaaa

SEQ ID NO: 179253 - DNA, 9 bp, Unknown
  misc_feature (1)..( 9): Result.005 file - promoters50/2024930
gtcaaaaaa

SEQ ID NO: 179254 - DNA, 9 bp, Unknown
  misc_feature (1)..( 9): Result.005 file - promoters50/2024930
gtcaaatcc

SEQ ID NO: 179255 - DNA, 9 bp, Unknown
  misc_feature (1)..( 9): Result.005 file - promoters50/2024930
ctcaaaaaa

SEQ ID NO: 179256 - DNA, 12 bp, Unknown
  misc_feature (1)..( 12): Result.005 file - promoters50/2025006
tcttaaataaat

SEQ ID NO: 179257 - DNA, 12 bp, Unknown
  misc_feature (1)..( 12): Result.005 file - promoters50/2025006
caataaataaaa

SEQ ID NO: 179258 - DNA, 12 bp, Unknown
  misc_feature (1)..( 12): Result.005 file - promoters50/2025006
gaggaaagaaaa

SEQ ID NO: 179259 - DNA, 12 bp, Unknown
  misc_feature (1)..( 12): Result.005 file - promoters50/2025006
ccttctataaaa

SEQ ID NO: 179260 - DNA, 12 bp, Unknown
  misc_feature (1)..( 12): Result.005 file - promoters50/2025006
caatacataatt

SEQ ID NO: 179261 - DNA, 12 bp, Unknown
  misc_feature (1)..( 12): Result.005 file - promoters50/2025006
ttaaaagaaaaa

SEQ ID NO: 179262 - DNA, 12 bp, Unknown
  misc_feature (1)..( 12): Result.005 file - promoters50/2025006
ataaaagaatta

SEQ ID NO: 179263 - DNA, 12 bp, Unknown
  misc_feature (1)..( 12): Result.005 file - promoters50/2025006
ttataagcccat

SEQ ID NO: 179264 - DNA, 12 bp, Unknown
  misc_feature (1)..( 12): Result.005 file - promoters50/2025006
aggaaagaaaaa

SEQ ID NO: 179265 - DNA, 12 bp, Unknown
  misc_feature (1)..( 12): Result.005 file - promoters50/2025006
ataaaatttgtt

SEQ ID NO: 179266 - DNA, 11 bp, Unknown
  misc_feature (1)..( 11): Result.005 file - promoters50/2025006
cataaattgag

SEQ ID NO: 179267 - DNA, 11 bp, Unknown
  misc_feature (1)..( 11): Result.005 file - promoters50/2025006
aataaatatct

SEQ ID NO: 179268 - DNA, 11 bp, Unknown
  misc_feature (1)..( 11): Result.005 file - promoters50/2025006
gataaattttg

SEQ ID NO: 179269 - DNA, 11 bp, Unknown
  misc_feature (1)..( 11): Result.005 file - promoters50/2025006
tttaaaaaaaa

SEQ ID NO: 179270 - DNA, 12 bp, Unknown
  misc_feature (1)..( 12): Result.005 file - promoters50/2025006
tttcaaaattta

SEQ ID NO: 179271 - DNA, 10 bp, Unknown
  misc_feature (1)..( 10): Result.005 file - promoters50/2025006
gaattttttt

SEQ ID NO: 179272 - DNA, 10 bp, Unknown
  misc_feature (1)..( 10): Result.005 file - promoters50/2025006
caattttttt

SEQ ID NO: 179273 - DNA, 10 bp, Unknown
  misc_feature (1)..( 10): Result.005 file - promoters50/2025006
cgctttcttt

SEQ ID NO: 179274 - DNA, 10 bp, Unknown
  misc_feature (1)..( 10): Result.005 file - promoters50/2025006
gaactttaat

SEQ ID NO: 179275 - DNA, 10 bp, Unknown
  misc_feature (1)..( 10): Result.005 file - promoters50/2025006
taactttgta

SEQ ID NO: 179276 - DNA, 9 bp, Unknown
  misc_feature (1)..( 9): Result.005 file - promoters50/2025006
ataaactca

SEQ ID NO: 179277 - DNA, 9 bp, Unknown
  misc_feature (1)..( 9): Result.005 file - promoters50/2025006
ataaacaat

SEQ ID NO: 179278 - DNA, 9 bp, Unknown
  misc_feature (1)..( 9): Result.005 file - promoters50/2025006
atatacaca

SEQ ID NO: 179279 - DNA, 9 bp, Unknown
  misc_feature (1)..( 9): Result.005 file - promoters50/2025006
ataaaaagt

SEQ ID NO: 179280 - DNA, 9 bp, Unknown
  misc_feature (1)..( 9): Result.005 file - promoters50/2025006
acaaacaat

SEQ ID NO: 179281 - DNA, 9 bp, Unknown
  misc_feature (1)..( 9): Result.005 file - promoters50/2025006
aaatttgaa

SEQ ID NO: 179282 - DNA, 9 bp, Unknown
  misc_feature (1)..( 9): Result.005 file - promoters50/2025006
ttgtttgaa

SEQ ID NO: 179283 - DNA, 9 bp, Unknown
  misc_feature (1)..( 9): Result.005 file - promoters50/2025006
aaaattgaa

SEQ ID NO: 179284 - DNA, 9 bp, Unknown
  misc_feature (1)..( 9): Result.005 file - promoters50/2025006
gagttcgaa

SEQ ID NO: 179285 - DNA, 9 bp, Unknown
  misc_feature (1)..( 9): Result.005 file - promoters50/2025006
aaaattaac

SEQ ID NO: 179286 - DNA, 10 bp, Unknown
  misc_feature (1)..( 10): Result.005 file - promoters50/2025306
aaacttgaaa

SEQ ID NO: 179287 - DNA, 10 bp, Unknown
  misc_feature (1)..( 10): Result.005 file - promoters50/2025306
aaacatgaag

SEQ ID NO: 179288 - DNA, 11 bp, Unknown
  misc_feature (1)..( 11): Result.005 file - promoters50/2025306
ctccttgtaaa

SEQ ID NO: 179289 - DNA, 12 bp, Unknown
  misc_feature (1)..( 12): Result.005 file - promoters50/2025306
aagtaataaaac

SEQ ID NO: 179290 - DNA, 12 bp, Unknown
  misc_feature (1)..( 12): Result.005 file - promoters50/2025306
tggttatataac

SEQ ID NO: 179291 - DNA, 12 bp, Unknown
  misc_feature (1)..( 12): Result.005 file - promoters50/2025306
aagaaataaata

SEQ ID NO: 179292 - DNA, 7 bp, Unknown
  misc_feature (1)..( 7): Result.005 file - promoters50/2025306
aaataat

SEQ ID NO: 179293 - DNA, 7 bp, Unknown
  misc_feature (1)..( 7): Result.005 file - promoters50/2025306
aaataag

SEQ ID NO: 179294 - DNA, 7 bp, Unknown
  misc_feature (1)..( 7): Result.005 file - promoters50/2025306
aaacaag

SEQ ID NO: 179295 - DNA, 12 bp, Unknown
  misc_feature (1)..( 12): Result.005 file - promoters50/2025592
caattaatattt

SEQ ID NO: 179296 - DNA, 12 bp, Unknown
  misc_feature (1)..( 12): Result.005 file - promoters50/2025592
caaataatattc

SEQ ID NO: 179297 - DNA, 12 bp, Unknown
  misc_feature (1)..( 12): Result.005 file - promoters50/2025592
tcagtaatgttt

SEQ ID NO: 179298 - DNA, 10 bp, Unknown
  misc_feature (1)..( 10): Result.005 file - promoters50/2025592
tttgttgtga

SEQ ID NO: 179299 - DNA, 10 bp, Unknown
  misc_feature (1)..( 10): Result.005 file - promoters50/2025592
gaagttttga

SEQ ID NO: 179300 - DNA, 10 bp, Unknown
  misc_feature (1)..( 10): Result.005 file - promoters50/2025592
ttttttttgt

SEQ ID NO: 179301 - DNA, 8 bp, Unknown
  misc_feature (1)..( 8): Result.005 file - promoters50/2025592
ataataaa

SEQ ID NO: 179302 - DNA, 8 bp, Unknown
  misc_feature (1)..( 8): Result.005 file - promoters50/2025592
ataaaaaa

SEQ ID NO: 179303 - DNA, 9 bp, Unknown
  misc_feature (1)..( 9): Result.005 file - promoters50/2025592
tcaaacaaa

SEQ ID NO: 179304 - DNA, 9 bp, Unknown
  misc_feature (1)..( 9): Result.005 file - promoters50/2025592
ccaatcaaa

SEQ ID NO: 179305 - DNA, 7 bp, Unknown
  misc_feature (1)..( 7): Result.005 file - promoters50/2025592
acatttc

SEQ ID NO: 179306 - DNA, 7 bp, Unknown
  misc_feature (1)..( 7): Result.005 file - promoters50/2025592
ccatttc

SEQ ID NO: 179307 - DNA, 7 bp, Unknown
  misc_feature (1)..( 7): Result.005 file - promoters50/2025592
ccatttt

SEQ ID NO: 179308 - DNA, 9 bp, Unknown
  misc_feature (1)..( 9): Result.005 file - promoters50/2025592
aattatcat

SEQ ID NO: 179309 - DNA, 9 bp, Unknown
  misc_feature (1)..( 9): Result.005 file - promoters50/2025592
tactatcat

SEQ ID NO: 179310 - DNA, 9 bp, Unknown
  misc_feature (1)..( 9): Result.005 file - promoters50/2025592
tacaatcat

SEQ ID NO: 179311 - DNA, 9 bp, Unknown
  misc_feature (1)..( 9): Result.005 file - promoters50/2025627
atttttttc

SEQ ID NO: 179312 - DNA, 9 bp, Unknown
  misc_feature (1)..( 9): Result.005 file - promoters50/2025627
cttttgttc

SEQ ID NO: 179313 - DNA, 9 bp, Unknown
  misc_feature (1)..( 9): Result.005 file - promoters50/2025627
atttattta

SEQ ID NO: 179314 - DNA, 9 bp, Unknown
  misc_feature (1)..( 9): Result.005 file - promoters50/2025627
attgtttta

SEQ ID NO: 179315 - DNA, 9 bp, Unknown
  misc_feature (1)..( 9): Result.005 file - promoters50/2025627
attaaaaaa

SEQ ID NO: 179316 - DNA, 9 bp, Unknown
  misc_feature (1)..( 9): Result.005 file - promoters50/2025627
aataataaa

SEQ ID NO: 179317 - DNA, 9 bp, Unknown
  misc_feature (1)..( 9): Result.005 file - promoters50/2025627
attagaaat

SEQ ID NO: 179318 - DNA, 10 bp, Unknown
  misc_feature (1)..( 10): Result.005 file - promoters50/2025627
gaatattacg

SEQ ID NO: 179319 - DNA, 10 bp, Unknown
  misc_feature (1)..( 10): Result.005 file - promoters50/2025627
taatattttt

SEQ ID NO: 179320 - DNA, 10 bp, Unknown
  misc_feature (1)..( 10): Result.005 file - promoters50/2025627
taattttttt

SEQ ID NO: 179321 - DNA, 8 bp, Unknown
  misc_feature (1)..( 8): Result.005 file - promoters50/2025627
ccaaaact

SEQ ID NO: 179322 - DNA, 8 bp, Unknown
  misc_feature (1)..( 8): Result.005 file - promoters50/2025627
ttaaaact

SEQ ID NO: 179323 - DNA, 8 bp, Unknown
  misc_feature (1)..( 8): Result.005 file - promoters50/2025627
ttaaaaca

SEQ ID NO: 179324 - DNA, 7 bp, Unknown
  misc_feature (1)..( 7): Result.005 file - promoters50/2026177
ttttata

SEQ ID NO: 179325 - DNA, 7 bp, Unknown
  misc_feature (1)..( 7): Result.005 file - promoters50/2026177
ttttatt

SEQ ID NO: 179326 - DNA, 7 bp, Unknown
  misc_feature (1)..( 7): Result.005 file - promoters50/2026177
atttata

SEQ ID NO: 179327 - DNA, 7 bp, Unknown
  misc_feature (1)..( 7): Result.005 file - promoters50/2026177
aaaataa

SEQ ID NO: 179328 - DNA, 7 bp, Unknown
  misc_feature (1)..( 7): Result.005 file - promoters50/2026177
taaataa

SEQ ID NO: 179329 - DNA, 8 bp, Unknown
  misc_feature (1)..( 8): Result.005 file - promoters50/2026177
caaactaa

SEQ ID NO: 179330 - DNA, 7 bp, Unknown
  misc_feature (1)..( 7): Result.005 file - promoters50/2026177
ttgtttg

SEQ ID NO: 179331 - DNA, 7 bp, Unknown
  misc_feature (1)..( 7): Result.005 file - promoters50/2026177
ttgtttt

SEQ ID NO: 179332 - DNA, 8 bp, Unknown
  misc_feature (1)..( 8): Result.005 file - promoters50/2026177
gtgtattg

SEQ ID NO: 179333 - DNA, 8 bp, Unknown
  misc_feature (1)..( 8): Result.005 file - promoters50/2026177
aaaattta

SEQ ID NO: 179334 - DNA, 8 bp, Unknown
  misc_feature (1)..( 8): Result.005 file - promoters50/2026177
aaaatttc

SEQ ID NO: 179335 - DNA, 8 bp, Unknown
  misc_feature (1)..( 8): Result.005 file - promoters50/2026177
aaaattcc

SEQ ID NO: 179336 - DNA, 8 bp, Unknown
  misc_feature (1)..( 8): Result.005 file - promoters50/2026177
aaagttct

SEQ ID NO: 179337 - DNA, 8 bp, Unknown
  misc_feature (1)..( 8): Result.005 file - promoters50/2026177
aaaatcaa

SEQ ID NO: 179338 - DNA, 8 bp, Unknown
  misc_feature (1)..( 8): Result.005 file - promoters50/2026177
aaaatcaa

SEQ ID NO: 179339 - DNA, 8 bp, Unknown
  misc_feature (1)..( 8): Result.005 file - promoters50/2026177
aaagtcac

SEQ ID NO: 179340 - DNA, 7 bp, Unknown
  misc_feature (1)..( 7): Result.005 file - promoters50/2026177
ttcatct

SEQ ID NO: 179341 - DNA, 7 bp, Unknown
  misc_feature (1)..( 7): Result.005 file - promoters50/2026177
ttcctct

SEQ ID NO: 179342 - DNA, 7 bp, Unknown
  misc_feature (1)..( 7): Result.005 file - promoters50/2026177
ttcttct

SEQ ID NO: 179343 - DNA, 11 bp, Unknown
  misc_feature (1)..( 11): Result.005 file - promoters50/2026721
caccttttaga

SEQ ID NO: 179344 - DNA, 11 bp, Unknown
  misc_feature (1)..( 11): Result.005 file - promoters50/2026721
ttgcttttaga

SEQ ID NO: 179345 - DNA, 11 bp, Unknown
  misc_feature (1)..( 11): Result.005 file - promoters50/2026721
ctgcttttatc

SEQ ID NO: 179346 - DNA, 11 bp, Unknown
  misc_feature (1)..( 11): Result.005 file - promoters50/2026721
ttgcgtttgtg

SEQ ID NO: 179347 - DNA, 8 bp, Unknown
  misc_feature (1)..( 8): Result.005 file - promoters50/2026721
tttttatt

SEQ ID NO: 179348 - DNA, 8 bp, Unknown
  misc_feature (1)..( 8): Result.005 file - promoters50/2026721
tttttaac

SEQ ID NO: 179349 - DNA, 8 bp, Unknown
  misc_feature (1)..( 8): Result.005 file - promoters50/2026721
tttttatt

SEQ ID NO: 179350 - DNA, 8 bp, Unknown
  misc_feature (1)..( 8): Result.005 file - promoters50/2026721
tttctaac

SEQ ID NO: 179351 - DNA, 10 bp, Unknown
  misc_feature (1)..( 10): Result.005 file - promoters50/2026757
aagaggattg

SEQ ID NO: 179352 - DNA, 10 bp, Unknown
  misc_feature (1)..( 10): Result.005 file - promoters50/2026757
aagatgatgt

SEQ ID NO: 179353 - DNA, 10 bp, Unknown
  misc_feature (1)..( 10): Result.005 file - promoters50/2026757
gagaggcttg

SEQ ID NO: 179354 - DNA, 9 bp, Unknown
  misc_feature (1)..( 9): Result.005 file - promoters50/2026757
aaaaaggcc

SEQ ID NO: 179355 - DNA, 9 bp, Unknown
  misc_feature (1)..( 9): Result.005 file - promoters50/2026757
aaaaagagt

SEQ ID NO: 179356 - DNA, 9 bp, Unknown
  misc_feature (1)..( 9): Result.005 file - promoters50/2026757
ttaaaggag

SEQ ID NO: 179357 - DNA, 14 bp, Unknown
  misc_feature (1)..( 14): Result.005 file - promoters50/2026771
aataacattaaaaa

SEQ ID NO: 179358 - DNA, 14 bp, Unknown
  misc_feature (1)..( 14): Result.005 file - promoters50/2026771
tcctttattaaatt

SEQ ID NO: 179359 - DNA, 14 bp, Unknown
  misc_feature (1)..( 14): Result.005 file - promoters50/2026771
tatgtgattaaata

SEQ ID NO: 179360 - DNA, 15 bp, Unknown
  misc_feature (1)..( 15): Result.005 file - promoters50/2026771
caagattttagaaaa

SEQ ID NO: 179361 - DNA, 15 bp, Unknown
  misc_feature (1)..( 15): Result.005 file - promoters50/2026771
attgtaattagaaaa

SEQ ID NO: 179362 - DNA, 15 bp, Unknown
  misc_feature (1)..( 15): Result.005 file - promoters50/2026771
ctaacgtttatatat

SEQ ID NO: 179363 - DNA, 15 bp, Unknown
  misc_feature (1)..( 15): Result.005 file - promoters50/2026771
aacctttttataatc

SEQ ID NO: 179364 - DNA, 12 bp, Unknown
  misc_feature (1)..( 12): Result.005 file - promoters50/2026771
tgtaaataaata

SEQ ID NO: 179365 - DNA, 12 bp, Unknown
  misc_feature (1)..( 12): Result.005 file - promoters50/2026771
tgtgattaaata

SEQ ID NO: 179366 - DNA, 12 bp, Unknown
  misc_feature (1)..( 12): Result.005 file - promoters50/2026771
cgtttatatata

SEQ ID NO: 179367 - DNA, 12 bp, Unknown
  misc_feature (1)..( 12): Result.005 file - promoters50/2026771
tcttgataaata

SEQ ID NO: 179368 - DNA, 12 bp, Unknown
  misc_feature (1)..( 12): Result.005 file - promoters50/2026771
gacttttacata

SEQ ID NO: 179369 - DNA, 12 bp, Unknown
  misc_feature (1)..( 12): Result.005 file - promoters50/2026771
aacctttttata

SEQ ID NO: 179370 - DNA, 9 bp, Unknown
  misc_feature (1)..( 9): Result.005 file - promoters50/2027233
agtttaagg

SEQ ID NO: 179371 - DNA, 9 bp, Unknown
  misc_feature (1)..( 9): Result.005 file - promoters50/2027233
ggttcaagg

SEQ ID NO: 179372 - DNA, 9 bp, Unknown
  misc_feature (1)..( 9): Result.005 file - promoters50/2027233
cttttaagc

SEQ ID NO: 179373 - DNA, 9 bp, Unknown
  misc_feature (1)..( 9): Result.005 file - promoters50/2027233
agtttgagg

SEQ ID NO: 179374 - DNA, 9 bp, Unknown
  misc_feature (1)..( 9): Result.005 file - promoters50/2027233
agtttggcc

SEQ ID NO: 179375 - DNA, 7 bp, Unknown
  misc_feature (1)..( 7): Result.005 file - promoters50/2027242
aaatctt

SEQ ID NO: 179376 - DNA, 7 bp, Unknown
  misc_feature (1)..( 7): Result.005 file - promoters50/2027242
gaatctt

SEQ ID NO: 179377 - DNA, 7 bp, Unknown
  misc_feature (1)..( 7): Result.005 file - promoters50/2027242
gaatctc

SEQ ID NO: 179378 - DNA, 14 bp, Unknown
  misc_feature (1)..( 14): Result.005 file - promoters50/2027242
gaaatggtaaaaag

SEQ ID NO: 179379 - DNA, 14 bp, Unknown
  misc_feature (1)..( 14): Result.005 file - promoters50/2027242
gaaatgtattttgt

SEQ ID NO: 179380 - DNA, 14 bp, Unknown
  misc_feature (1)..( 14): Result.005 file - promoters50/2027242
aaaagggtcaaaag

SEQ ID NO: 179381 - DNA, 14 bp, Unknown
  misc_feature (1)..( 14): Result.005 file - promoters50/2027253
atttaaaatataga

SEQ ID NO: 179382 - DNA, 14 bp, Unknown
  misc_feature (1)..( 14): Result.005 file - promoters50/2027253
tttttaaattttcg

SEQ ID NO: 179383 - DNA, 14 bp, Unknown
  misc_feature (1)..( 14): Result.005 file - promoters50/2027253
atccaaaattatag

SEQ ID NO: 179384 - DNA, 14 bp, Unknown
  misc_feature (1)..( 14): Result.005 file - promoters50/2027253
tagtaagattctag

SEQ ID NO: 179385 - DNA, 14 bp, Unknown
  misc_feature (1)..( 14): Result.005 file - promoters50/2027253
tttttatatatttt

SEQ ID NO: 179386 - DNA, 14 bp, Unknown
  misc_feature (1)..( 14): Result.005 file - promoters50/2027253
gccctatattataa

SEQ ID NO: 179387 - DNA, 17 bp, Unknown
  misc_feature (1)..( 17): Result.005 file - promoters50/2027253
aaaagaaaatattgggg

SEQ ID NO: 179388 - DNA, 17 bp, Unknown
  misc_feature (1)..( 17): Result.005 file - promoters50/2027253
aaaacaaaatcataaag

SEQ ID NO: 179389 - DNA, 17 bp, Unknown
  misc_feature (1)..( 17): Result.005 file - promoters50/2027253
aaaaaattgaaacttta

SEQ ID NO: 179390 - DNA, 17 bp, Unknown
  misc_feature (1)..( 17): Result.005 file - promoters50/2027253
atataattgcaacctta

SEQ ID NO: 179391 - DNA, 17 bp, Unknown
  misc_feature (1)..( 17): Result.005 file - promoters50/2027253
agaccattgcagatgcc

SEQ ID NO: 179392 - DNA, 17 bp, Unknown
  misc_feature (1)..( 17): Result.005 file - promoters50/2027253
aaaagaaaaagaaaaaa

SEQ ID NO: 179393 - DNA, 11 bp, Unknown
  misc_feature (1)..( 11): Result.005 file - promoters50/2027268
atctgctaatg

SEQ ID NO: 179394 - DNA, 11 bp, Unknown
  misc_feature (1)..( 11): Result.005 file - promoters50/2027268
ttttgctaaaa

SEQ ID NO: 179395 - DNA, 11 bp, Unknown
  misc_feature (1)..( 11): Result.005 file - promoters50/2027268
tttttctaaaa

SEQ ID NO: 179396 - DNA, 9 bp, Unknown
  misc_feature (1)..( 9): Result.005 file - promoters50/2028939
gatcacact

SEQ ID NO: 179397 - DNA, 9 bp, Unknown
  misc_feature (1)..( 9): Result.005 file - promoters50/2028939
catctcact

SEQ ID NO: 179398 - DNA, 9 bp, Unknown
  misc_feature (1)..( 9): Result.005 file - promoters50/2028939
catctctga

SEQ ID NO: 179399 - DNA, 7 bp, Unknown
  misc_feature (1)..( 7): Result.005 file - promoters50/2028939
gttttga

SEQ ID NO: 179400 - DNA, 7 bp, Unknown
  misc_feature (1)..( 7): Result.005 file - promoters50/2028939
cttttga

SEQ ID NO: 179401 - DNA, 7 bp, Unknown
  misc_feature (1)..( 7): Result.005 file - promoters50/2028939
cttttgt

SEQ ID NO: 179402 - DNA, 8 bp, Unknown
  misc_feature (1)..( 8): Result.005 file - promoters50/2028939
aattctat

SEQ ID NO: 179403 - DNA, 8 bp, Unknown
  misc_feature (1)..( 8): Result.005 file - promoters50/2028939
tgttctat

SEQ ID NO: 179404 - DNA, 8 bp, Unknown
  misc_feature (1)..( 8): Result.005 file - promoters50/2028939
tgtgctac

SEQ ID NO: 179405 - DNA, 8 bp, Unknown
  misc_feature (1)..( 8): Result.005 file - promoters50/2028939
acactttt

SEQ ID NO: 179406 - DNA, 8 bp, Unknown
  misc_feature (1)..( 8): Result.005 file - promoters50/2028939
acaccttt

SEQ ID NO: 179407 - DNA, 8 bp, Unknown
  misc_feature (1)..( 8): Result.005 file - promoters50/2028939
taactttt

SEQ ID NO: 179408 - DNA, 8 bp, Unknown
  misc_feature (1)..( 8): Result.005 file - promoters50/2028939
gtctttat

SEQ ID NO: 179409 - DNA, 8 bp, Unknown
  misc_feature (1)..( 8): Result.005 file - promoters50/2028939
atctgtat

SEQ ID NO: 179410 - DNA, 8 bp, Unknown
  misc_feature (1)..( 8): Result.005 file - promoters50/2028939
atctgttg

SEQ ID NO: 179411 - DNA, 6 bp, Unknown
  misc_feature (1)..( 6): Result.005 file - promoters50/2028939
agtttt

SEQ ID NO: 179412 - DNA, 6 bp, Unknown
  misc_feature (1)..( 6): Result.005 file - promoters50/2028939
agtttt

SEQ ID NO: 179413 - DNA, 6 bp, Unknown
  misc_feature (1)..( 6): Result.005 file - promoters50/2028939
agtttt

SEQ ID NO: 179414 - DNA, 9 bp, Unknown
  misc_feature (1)..( 9): Result.005 file - promoters50/2028939
tgtgtcaga

SEQ ID NO: 179415 - DNA, 9 bp, Unknown
  misc_feature (1)..( 9): Result.005 file - promoters50/2028939
tgtttcaaa

SEQ ID NO: 179416 - DNA, 9 bp, Unknown
  misc_feature (1)..( 9): Result.005 file - promoters50/2028939
ctttttaaa

SEQ ID NO: 179417 - DNA, 8 bp, Unknown
  misc_feature (1)..( 8): Result.005 file - promoters50/2028939
atgcgctt

SEQ ID NO: 179418 - DNA, 8 bp, Unknown
  misc_feature (1)..( 8): Result.005 file - promoters50/2028939
atgtgcta

SEQ ID NO: 179419 - DNA, 8 bp, Unknown
  misc_feature (1)..( 8): Result.005 file - promoters50/2028939
ctgttcta

SEQ ID NO: 179420 - DNA, 7 bp, Unknown
  misc_feature (1)..( 7): Result.005 file - promoters50/2028945
ttgaaat

SEQ ID NO: 179421 - DNA, 7 bp, Unknown
  misc_feature (1)..( 7): Result.005 file - promoters50/2028945
ttgaaat

SEQ ID NO: 179422 - DNA, 7 bp, Unknown
  misc_feature (1)..( 7): Result.005 file - promoters50/2028945
ctgaaat

SEQ ID NO: 179423 - DNA, 13 bp, Unknown
  misc_feature (1)..( 13): Result.005 file - promoters50/2028945
taaatatttaaat

SEQ ID NO: 179424 - DNA, 13 bp, Unknown
  misc_feature (1)..( 13): Result.005 file - promoters50/2028945
taaaaatttaaat

SEQ ID NO: 179425 - DNA, 13 bp, Unknown
  misc_feature (1)..( 13): Result.005 file - promoters50/2028945
agcagttttaaaa

SEQ ID NO: 179426 - DNA, 9 bp, Unknown
  misc_feature (1)..( 9): Result.005 file - promoters50/2028945
cataaacta

SEQ ID NO: 179427 - DNA, 9 bp, Unknown
  misc_feature (1)..( 9): Result.005 file - promoters50/2028945
cataaaaat

SEQ ID NO: 179428 - DNA, 9 bp, Unknown
  misc_feature (1)..( 9): Result.005 file - promoters50/2028945
catacacta

SEQ ID NO: 179429 - DNA, 8 bp, Unknown
  misc_feature (1)..( 8): Result.005 file - promoters50/2028945
attatttt

SEQ ID NO: 179430 - DNA, 8 bp, Unknown
  misc_feature (1)..( 8): Result.005 file - promoters50/2028945
tttaattt

SEQ ID NO: 179431 - DNA, 8 bp, Unknown
  misc_feature (1)..( 8): Result.005 file - promoters50/2028945
tttaattt

SEQ ID NO: 179432 - DNA, 7 bp, Unknown
  misc_feature (1)..( 7): Result.005 file - promoters50/2028945
ttttaaa

SEQ ID NO: 179433 - DNA, 7 bp, Unknown
  misc_feature (1)..( 7): Result.005 file - promoters50/2028945
ttttaaa

SEQ ID NO: 179434 - DNA, 7 bp, Unknown
  misc_feature (1)..( 7): Result.005 file - promoters50/2028945
atttaaa

SEQ ID NO: 179435 - DNA, 8 bp, Unknown
  misc_feature (1)..( 8): Result.005 file - promoters50/2028945
atcataat

SEQ ID NO: 179436 - DNA, 8 bp, Unknown
  misc_feature (1)..( 8): Result.005 file - promoters50/2028945
atcttaat

SEQ ID NO: 179437 - DNA, 8 bp, Unknown
  misc_feature (1)..( 8): Result.005 file - promoters50/2028945
ctctcaat

SEQ ID NO: 179438 - DNA, 9 bp, Unknown
  misc_feature (1)..( 9): Result.005 file - promoters50/2028945
tctaagtta

SEQ ID NO: 179439 - DNA, 9 bp, Unknown
  misc_feature (1)..( 9): Result.005 file - promoters50/2028945
tttaattta

SEQ ID NO: 179440 - DNA, 9 bp, Unknown
  misc_feature (1)..( 9): Result.005 file - promoters50/2028945
tttaatttc

SEQ ID NO: 179441 - DNA, 8 bp, Unknown
  misc_feature (1)..( 8): Result.005 file - promoters50/2028945
gaacttta

SEQ ID NO: 179442 - DNA, 8 bp, Unknown
  misc_feature (1)..( 8): Result.005 file - promoters50/2028945
aaacatta

SEQ ID NO: 179443 - DNA, 8 bp, Unknown
  misc_feature (1)..( 8): Result.005 file - promoters50/2028945
aaaaatta

SEQ ID NO: 179444 - DNA, 9 bp, Unknown
  misc_feature (1)..( 9): Result.005 file - promoters50/2028948
agtaaaaac

SEQ ID NO: 179445 - DNA, 9 bp, Unknown
  misc_feature (1)..( 9): Result.005 file - promoters50/2028948
agtaaaaca

SEQ ID NO: 179446 - DNA, 9 bp, Unknown
  misc_feature (1)..( 9): Result.005 file - promoters50/2028948
cataaaaca

SEQ ID NO: 179447 - DNA, 9 bp, Unknown
  misc_feature (1)..( 9): Result.005 file - promoters50/2028948
catagtaaa

SEQ ID NO: 179448 - DNA, 9 bp, Unknown
  misc_feature (1)..( 9): Result.005 file - promoters50/2028948
cataataat

SEQ ID NO: 179449 - DNA, 9 bp, Unknown
  misc_feature (1)..( 9): Result.005 file - promoters50/2028948
tggaataat

SEQ ID NO: 179450 - DNA, 11 bp, Unknown
  misc_feature (1)..( 11): Result.005 file - promoters50/2028948
atcttacaaaa

SEQ ID NO: 179451 - DNA, 11 bp, Unknown
  misc_feature (1)..( 11): Result.005 file - promoters50/2028948
tttatacaaaa

SEQ ID NO: 179452 - DNA, 11 bp, Unknown
  misc_feature (1)..( 11): Result.005 file - promoters50/2028948
tttatgcaaag

SEQ ID NO: 179453 - DNA, 9 bp, Unknown
  misc_feature (1)..( 9): Result.005 file - promoters50/2028979
attatataa

SEQ ID NO: 179454 - DNA, 9 bp, Unknown
  misc_feature (1)..( 9): Result.005 file - promoters50/2028979
aatatataa

SEQ ID NO: 179455 - DNA, 9 bp, Unknown
  misc_feature (1)..( 9): Result.005 file - promoters50/2028979
attttatac

SEQ ID NO: 179456 - DNA, 8 bp, Unknown
  misc_feature (1)..( 8): Result.005 file - promoters50/2028979
ttaaaaat

SEQ ID NO: 179457 - DNA, 8 bp, Unknown
  misc_feature (1)..( 8): Result.005 file - promoters50/2028979
ttaaaaag

SEQ ID NO: 179458 - DNA, 8 bp, Unknown
  misc_feature (1)..( 8): Result.005 file - promoters50/2028979
gaaaaaat

SEQ ID NO: 179459 - DNA, 8 bp, Unknown
  misc_feature (1)..( 8): Result.005 file - promoters50/2028979
aactaaga

SEQ ID NO: 179460 - DNA, 8 bp, Unknown
  misc_feature (1)..( 8): Result.005 file - promoters50/2028979
aactaata

SEQ ID NO: 179461 - DNA, 8 bp, Unknown
  misc_feature (1)..( 8): Result.005 file - promoters50/2028979
aacaaata

SEQ ID NO: 179462 - DNA, 9 bp, Unknown
  misc_feature (1)..( 9): Result.005 file - promoters50/2028993
tatatacca

SEQ ID NO: 179463 - DNA, 9 bp, Unknown
  misc_feature (1)..( 9): Result.005 file - promoters50/2028993
cataaacca

SEQ ID NO: 179464 - DNA, 9 bp, Unknown
  misc_feature (1)..( 9): Result.005 file - promoters50/2028993
cataaataa

SEQ ID NO: 179465 - DNA, 9 bp, Unknown
  misc_feature (1)..( 9): Result.005 file - promoters50/2028993
cttaaccaa

SEQ ID NO: 179466 - DNA, 9 bp, Unknown
  misc_feature (1)..( 9): Result.005 file - promoters50/2028993
attaaccaa

SEQ ID NO: 179467 - DNA, 9 bp, Unknown
  misc_feature (1)..( 9): Result.005 file - promoters50/2028993
attcacctc

SEQ ID NO: 179468 - DNA, 12 bp, Unknown
  misc_feature (1)..( 12): Result.005 file - promoters50/2028993
aatagaaattta

SEQ ID NO: 179469 - DNA, 12 bp, Unknown
  misc_feature (1)..( 12): Result.005 file - promoters50/2028993
ttactaaaatta

SEQ ID NO: 179470 - DNA, 12 bp, Unknown
  misc_feature (1)..( 12): Result.005 file - promoters50/2028993
ttactaaaatat

SEQ ID NO: 179471 - DNA, 9 bp, Unknown
  misc_feature (1)..( 9): Result.005 file - promoters50/2028997
cttctatgt

SEQ ID NO: 179472 - DNA, 9 bp, Unknown
  misc_feature (1)..( 9): Result.005 file - promoters50/2028997
cttgtataa

SEQ ID NO: 179473 - DNA, 9 bp, Unknown
  misc_feature (1)..( 9): Result.005 file - promoters50/2028997
cgtctatgt

SEQ ID NO: 179474 - DNA, 11 bp, Unknown
  misc_feature (1)..( 11): Result.005 file - promoters50/2028997
agatttcattg

SEQ ID NO: 179475 - DNA, 11 bp, Unknown
  misc_feature (1)..( 11): Result.005 file - promoters50/2028997
tactttgatta

SEQ ID NO: 179476 - DNA, 11 bp, Unknown
  misc_feature (1)..( 11): Result.005 file - promoters50/2028997
aactttaatta

SEQ ID NO: 179477 - DNA, 12 bp, Unknown
  misc_feature (1)..( 12): Result.005 file - promoters50/2028997
cagcttaagttt

SEQ ID NO: 179478 - DNA, 13 bp, Unknown
  misc_feature (1)..( 13): Result.005 file - promoters50/2028997
tctaatgttcttt

SEQ ID NO: 179479 - DNA, 13 bp, Unknown
  misc_feature (1)..( 13): Result.005 file - promoters50/2028997
gcttaagtttttt

SEQ ID NO: 179480 - DNA, 13 bp, Unknown
  misc_feature (1)..( 13): Result.005 file - promoters50/2028997
cttaaatttgttt

SEQ ID NO: 179481 - DNA, 8 bp, Unknown
  misc_feature (1)..( 8): Result.005 file - promoters50/2029009
ttttaaaa

SEQ ID NO: 179482 - DNA, 8 bp, Unknown
  misc_feature (1)..( 8): Result.005 file - promoters50/2029009
acttaaaa

SEQ ID NO: 179483 - DNA, 8 bp, Unknown
  misc_feature (1)..( 8): Result.005 file - promoters50/2029009
actgaaat

SEQ ID NO: 179484 - DNA, 9 bp, Unknown
  misc_feature (1)..( 9): Result.005 file - promoters50/2029016
agtaaatca

SEQ ID NO: 179485 - DNA, 9 bp, Unknown
  misc_feature (1)..( 9): Result.005 file - promoters50/2029016
ttaaaatca

SEQ ID NO: 179486 - DNA, 9 bp, Unknown
  misc_feature (1)..( 9): Result.005 file - promoters50/2029016
aataaattg

SEQ ID NO: 179487 - DNA, 9 bp, Unknown
  misc_feature (1)..( 9): Result.005 file - promoters50/2029016
attaaatca

SEQ ID NO: 179488 - DNA, 8 bp, Unknown
  misc_feature (1)..( 8): Result.005 file - promoters50/2029027
ccccaatt

SEQ ID NO: 179489 - DNA, 8 bp, Unknown
  misc_feature (1)..( 8): Result.005 file - promoters50/2029027
cccccatt

SEQ ID NO: 179490 - DNA, 8 bp, Unknown
  misc_feature (1)..( 8): Result.005 file - promoters50/2029027
gtccaatt

SEQ ID NO: 179491 - DNA, 9 bp, Unknown
  misc_feature (1)..( 9): Result.005 file - promoters50/2029027
aaccttttt

SEQ ID NO: 179492 - DNA, 9 bp, Unknown
  misc_feature (1)..( 9): Result.005 file - promoters50/2029027
aacattttg

SEQ ID NO: 179493 - DNA, 10 bp, Unknown
  misc_feature (1)..( 10): Result.005 file - promoters50/2029027
tttcttgttt

SEQ ID NO: 179494 - DNA, 15 bp, Unknown
  misc_feature (1)..( 15): Result.005 file - promoters50/2029033
ttcatttatttactt

SEQ ID NO: 179495 - DNA, 15 bp, Unknown
  misc_feature (1)..( 15): Result.005 file - promoters50/2029033
gctatttatttcctt

SEQ ID NO: 179496 - DNA, 15 bp, Unknown
  misc_feature (1)..( 15): Result.005 file - promoters50/2029033
atgatttatttttta

SEQ ID NO: 179497 - DNA, 15 bp, Unknown
  misc_feature (1)..( 15): Result.005 file - promoters50/2029033
ttggattctttccta

SEQ ID NO: 179498 - DNA, 15 bp, Unknown
  misc_feature (1)..( 15): Result.005 file - promoters50/2029033
gctttttatccacat

SEQ ID NO: 179499 - DNA, 15 bp, Unknown
  misc_feature (1)..( 15): Result.005 file - promoters50/2029033
tcacggctttttcta

SEQ ID NO: 179500 - DNA, 15 bp, Unknown
  misc_feature (1)..( 15): Result.005 file - promoters50/2029033
gaaacatattttcga

SEQ ID NO: 179501 - DNA, 11 bp, Unknown
  misc_feature (1)..( 11): Result.005 file - promoters50/2029033
ctttctataat

SEQ ID NO: 179502 - DNA, 11 bp, Unknown
  misc_feature (1)..( 11): Result.005 file - promoters50/2029033
atttttattct

SEQ ID NO: 179503 - DNA, 11 bp, Unknown
  misc_feature (1)..( 11): Result.005 file - promoters50/2029033
tattctatttg

SEQ ID NO: 179504 - DNA, 11 bp, Unknown
  misc_feature (1)..( 11): Result.005 file - promoters50/2029033
ttttcgataat

SEQ ID NO: 179505 - DNA, 11 bp, Unknown
  misc_feature (1)..( 11): Result.005 file - promoters50/2029033
attttttataa

SEQ ID NO: 179506 - DNA, 11 bp, Unknown
  misc_feature (1)..( 11): Result.005 file - promoters50/2029033
ctttttatcca

SEQ ID NO: 179507 - DNA, 11 bp, Unknown
  misc_feature (1)..( 11): Result.005 file - promoters50/2029033
ctttggatctt

SEQ ID NO: 179508 - DNA, 10 bp, Unknown
  misc_feature (1)..( 10): Result.005 file - promoters50/2029033
aaaatatata

SEQ ID NO: 179509 - DNA, 10 bp, Unknown
  misc_feature (1)..( 10): Result.005 file - promoters50/2029033
tgtatatatt

SEQ ID NO: 179510 - DNA, 10 bp, Unknown
  misc_feature (1)..( 10): Result.005 file - promoters50/2029033
aaattataaa

SEQ ID NO: 179511 - DNA, 10 bp, Unknown
  misc_feature (1)..( 10): Result.005 file - promoters50/2029033
cgaataaata

SEQ ID NO: 179512 - DNA, 10 bp, Unknown
  misc_feature (1)..( 10): Result.005 file - promoters50/2029033
taattaacct

SEQ ID NO: 179513 - DNA, 10 bp, Unknown
  misc_feature (1)..( 10): Result.005 file - promoters50/2029033
ccaatgaatt

SEQ ID NO: 179514 - DNA, 18 bp, Unknown
  misc_feature (1)..( 18): Result.005 file - promoters50/2029033
tatttataaccaaatcct

SEQ ID NO: 179515 - DNA, 18 bp, Unknown
  misc_feature (1)..( 18): Result.005 file - promoters50/2029033
tatatataatcttctcag

SEQ ID NO: 179516 - DNA, 18 bp, Unknown
  misc_feature (1)..( 18): Result.005 file - promoters50/2029033
gctttataaacacatctc

SEQ ID NO: 179517 - DNA, 18 bp, Unknown
  misc_feature (1)..( 18): Result.005 file - promoters50/2029033
gagatataatacagacaa

SEQ ID NO: 179518 - DNA, 18 bp, Unknown
  misc_feature (1)..( 18): Result.005 file - promoters50/2029033
cctctataaagacaaaca

SEQ ID NO: 179519 - DNA, 18 bp, Unknown
  misc_feature (1)..( 18): Result.005 file - promoters50/2029033
attaaataaatactcttc

SEQ ID NO: 179520 - DNA, 18 bp, Unknown
  misc_feature (1)..( 18): Result.005 file - promoters50/2029033
tttatattctcattcact

SEQ ID NO: 179521 - DNA, 18 bp, Unknown
  misc_feature (1)..( 18): Result.005 file - promoters50/2029033
ttcttattcttctatcaa

SEQ ID NO: 179522 - DNA, 10 bp, Unknown
  misc_feature (1)..( 10): Result.005 file - promoters50/2029041
gaaattatgg

SEQ ID NO: 179523 - DNA, 10 bp, Unknown
  misc_feature (1)..( 10): Result.005 file - promoters50/2029041
gaaattacta

SEQ ID NO: 179524 - DNA, 10 bp, Unknown
  misc_feature (1)..( 10): Result.005 file - promoters50/2029041
ttaattacta

SEQ ID NO: 179525 - DNA, 10 bp, Unknown
  misc_feature (1)..( 10): Result.005 file - promoters50/2029041
aaatacccaa

SEQ ID NO: 179526 - DNA, 10 bp, Unknown
  misc_feature (1)..( 10): Result.005 file - promoters50/2029041
caataaccaa

SEQ ID NO: 179527 - DNA, 10 bp, Unknown
  misc_feature (1)..( 10): Result.005 file - promoters50/2029041
taattactaa

SEQ ID NO: 179528 - DNA, 7 bp, Unknown
  misc_feature (1)..( 7): Result.005 file - promoters50/2029041
agttttg

SEQ ID NO: 179529 - DNA, 7 bp, Unknown
  misc_feature (1)..( 7): Result.005 file - promoters50/2029041
agttttt

SEQ ID NO: 179530 - DNA, 7 bp, Unknown
  misc_feature (1)..( 7): Result.005 file - promoters50/2029041
tgttttg

SEQ ID NO: 179531 - DNA, 7 bp, Unknown
  misc_feature (1)..( 7): Result.005 file - promoters50/2029054
ctaccaa

SEQ ID NO: 179532 - DNA, 7 bp, Unknown
  misc_feature (1)..( 7): Result.005 file - promoters50/2029054
ataccaa

SEQ ID NO: 179533 - DNA, 7 bp, Unknown
  misc_feature (1)..( 7): Result.005 file - promoters50/2029054
atagcaa

SEQ ID NO: 179534 - DNA, 7 bp, Unknown
  misc_feature (1)..( 7): Result.005 file - promoters50/2029075
caataag

SEQ ID NO: 179535 - DNA, 7 bp, Unknown
  misc_feature (1)..( 7): Result.005 file - promoters50/2029075
aaataag

SEQ ID NO: 179536 - DNA, 7 bp, Unknown
  misc_feature (1)..( 7): Result.005 file - promoters50/2029075
aaataaa

SEQ ID NO: 179537 - DNA, 7 bp, Unknown
  misc_feature (1)..( 7): Result.005 file - promoters50/2029075
aaataaa

SEQ ID NO: 179538 - DNA, 8 bp, Unknown
  misc_feature (1)..( 8): Result.005 file - promoters50/2029075
aaagtaat

SEQ ID NO: 179539 - DNA, 8 bp, Unknown
  misc_feature (1)..( 8): Result.005 file - promoters50/2029075
aaaaaaag

SEQ ID NO: 179540 - DNA, 8 bp, Unknown
  misc_feature (1)..( 8): Result.005 file - promoters50/2029075
gaagcaat

SEQ ID NO: 179541 - DNA, 10 bp, Unknown
  misc_feature (1)..( 10): Result.005 file - promoters50/2029083
ataattgtaa

SEQ ID NO: 179542 - DNA, 10 bp, Unknown
  misc_feature (1)..( 10): Result.005 file - promoters50/2029083
tgaattgtga

SEQ ID NO: 179543 - DNA, 10 bp, Unknown
  misc_feature (1)..( 10): Result.005 file - promoters50/2029083
ataattataa

SEQ ID NO: 179544 - DNA, 11 bp, Unknown
  misc_feature (1)..( 11): Result.005 file - promoters50/2029087
gaaaatgtttt

SEQ ID NO: 179545 - DNA, 11 bp, Unknown
  misc_feature (1)..( 11): Result.005 file - promoters50/2029087
acaaaagttta

SEQ ID NO: 179546 - DNA, 11 bp, Unknown
  misc_feature (1)..( 11): Result.005 file - promoters50/2029087
ttcaatatttt

SEQ ID NO: 179547 - DNA, 11 bp, Unknown
  misc_feature (1)..( 11): Result.005 file - promoters50/2029087
gaaaatggatc

SEQ ID NO: 179548 - DNA, 15 bp, Unknown
  misc_feature (1)..( 15): Result.005 file - promoters50/2029087
atcactgatccaaca

SEQ ID NO: 179549 - DNA, 15 bp, Unknown
  misc_feature (1)..( 15): Result.005 file - promoters50/2029087
atcactgatccaaca

SEQ ID NO: 179550 - DNA, 15 bp, Unknown
  misc_feature (1)..( 15): Result.005 file - promoters50/2029087
atcactgatccaaca

SEQ ID NO: 179551 - DNA, 7 bp, Unknown
  misc_feature (1)..( 7): Result.005 file - promoters50/2029087
cattata

SEQ ID NO: 179552 - DNA, 7 bp, Unknown
  misc_feature (1)..( 7): Result.005 file - promoters50/2029087
cattatc

SEQ ID NO: 179553 - DNA, 7 bp, Unknown
  misc_feature (1)..( 7): Result.005 file - promoters50/2029087
aattatc

SEQ ID NO: 179554 - DNA, 7 bp, Unknown
  misc_feature (1)..( 7): Result.005 file - promoters50/2029087
aattatc

SEQ ID NO: 179555 - DNA, 10 bp, Unknown
  misc_feature (1)..( 10): Result.005 file - promoters50/2033137
ggttacttgg

SEQ ID NO: 179556 - DNA, 10 bp, Unknown
  misc_feature (1)..( 10): Result.005 file - promoters50/2033137
aattagttgc

SEQ ID NO: 179557 - DNA, 10 bp, Unknown
  misc_feature (1)..( 10): Result.005 file - promoters50/2033137
aataagttaa

SEQ ID NO: 179558 - DNA, 10 bp, Unknown
  misc_feature (1)..( 10): Result.005 file - promoters50/2033137
aataaattaa

SEQ ID NO: 179559 - DNA, 12 bp, Unknown
  misc_feature (1)..( 12): Result.005 file - promoters50/2033137
agatatattaag

SEQ ID NO: 179560 - DNA, 12 bp, Unknown
  misc_feature (1)..( 12): Result.005 file - promoters50/2033137
agacatatgaac

SEQ ID NO: 179561 - DNA, 12 bp, Unknown
  misc_feature (1)..( 12): Result.005 file - promoters50/2033137
ttgtatatttta

SEQ ID NO: 179562 - DNA, 12 bp, Unknown
  misc_feature (1)..( 12): Result.005 file - promoters50/2033137
aaaattattttt

SEQ ID NO: 179563 - DNA, 6 bp, Unknown
  misc_feature (1)..( 6): Result.005 file - promoters50/2052918
aacttt

SEQ ID NO: 179564 - DNA, 6 bp, Unknown
  misc_feature (1)..( 6): Result.005 file - promoters50/2052918
aacttt

SEQ ID NO: 179565 - DNA, 6 bp, Unknown
  misc_feature (1)..( 6): Result.005 file - promoters50/2052918
aacttt

SEQ ID NO: 179566 - DNA, 14 bp, Unknown
  misc_feature (1)..( 14): Result.005 file - promoters50/2056926
atcgaataaaatac

SEQ ID NO: 179567 - DNA, 14 bp, Unknown
  misc_feature (1)..( 14): Result.005 file - promoters50/2056926
agtcaataaaagcc

SEQ ID NO: 179568 - DNA, 14 bp, Unknown
  misc_feature (1)..( 14): Result.005 file - promoters50/2056926
acacgatacaatac

SEQ ID NO: 179569 - DNA, 14 bp, Unknown
  misc_feature (1)..( 14): Result.005 file - promoters50/2056926
agataataaataag

SEQ ID NO: 179570 - DNA, 14 bp, Unknown
  misc_feature (1)..( 14): Result.005 file - promoters50/2056926
agagaatacaagtt

SEQ ID NO: 179571 - DNA, 14 bp, Unknown
  misc_feature (1)..( 14): Result.005 file - promoters50/2056926
agtaaataaagtgt

SEQ ID NO: 179572 - DNA, 14 bp, Unknown
  misc_feature (1)..( 14): Result.005 file - promoters50/2056926
cataaataaacaaa

SEQ ID NO: 179573 - DNA, 14 bp, Unknown
  misc_feature (1)..( 14): Result.005 file - promoters50/2056926
tcgaaatagataac

SEQ ID NO: 179574 - DNA, 8 bp, Unknown
  misc_feature (1)..( 8): Result.005 file - promoters50/2104855
aatataat

SEQ ID NO: 179575 - DNA, 8 bp, Unknown
  misc_feature (1)..( 8): Result.005 file - promoters50/2104855
tttataat

SEQ ID NO: 179576 - DNA, 8 bp, Unknown
  misc_feature (1)..( 8): Result.005 file - promoters50/2104855
aatttaaa

SEQ ID NO: 179577 - DNA, 8 bp, Unknown
  misc_feature (1)..( 8): Result.005 file - promoters50/2104855
aatctaac

SEQ ID NO: 179578 - DNA, 7 bp, Unknown
  misc_feature (1)..( 7): Result.005 file - promoters50/2104855
aatataa

SEQ ID NO: 179579 - DNA, 7 bp, Unknown
  misc_feature (1)..( 7): Result.005 file - promoters50/2104855
aatatat

SEQ ID NO: 179580 - DNA, 7 bp, Unknown
  misc_feature (1)..( 7): Result.005 file - promoters50/2104855
aatttaa

SEQ ID NO: 179581 - DNA, 7 bp, Unknown
  misc_feature (1)..( 7): Result.005 file - promoters50/2104855
aatctaa

SEQ ID NO: 179582 - DNA, 7 bp, Unknown
  misc_feature (1)..( 7): Result.005 file - promoters50/2104855
ctaaaag

SEQ ID NO: 179583 - DNA, 7 bp, Unknown
  misc_feature (1)..( 7): Result.005 file - promoters50/2104855
ttaaaag

SEQ ID NO: 179584 - DNA, 7 bp, Unknown
  misc_feature (1)..( 7): Result.005 file - promoters50/2104855
ctaaaac

SEQ ID NO: 179585 - DNA, 10 bp, Unknown
  misc_feature (1)..( 10): Result.005 file - promoters50/2104855
cttctttttc

SEQ ID NO: 179586 - DNA, 10 bp, Unknown
  misc_feature (1)..( 10): Result.005 file - promoters50/2104855
aatttttttc

SEQ ID NO: 179587 - DNA, 10 bp, Unknown
  misc_feature (1)..( 10): Result.005 file - promoters50/2104855
attgttttgg

SEQ ID NO: 179588 - DNA, 9 bp, Unknown
  misc_feature (1)..( 9): Result.005 file - promoters50/2104855
gactacaaa

SEQ ID NO: 179589 - DNA, 9 bp, Unknown
  misc_feature (1)..( 9): Result.005 file - promoters50/2104855
ttctacaat

SEQ ID NO: 179590 - DNA, 9 bp, Unknown
  misc_feature (1)..( 9): Result.005 file - promoters50/2104855
ttctaaaat

SEQ ID NO: 179591 - DNA, 8 bp, Unknown
  misc_feature (1)..( 8): Result.005 file - promoters50/2104855
ccaattat

SEQ ID NO: 179592 - DNA, 8 bp, Unknown
  misc_feature (1)..( 8): Result.005 file - promoters50/2104855
ataattat

SEQ ID NO: 179593 - DNA, 8 bp, Unknown
  misc_feature (1)..( 8): Result.005 file - promoters50/2104855
ataattat

SEQ ID NO: 179594 - DNA, 9 bp, Unknown
  misc_feature (1)..( 9): Result.005 file - promoters50/2104855
cgcaatgaa

SEQ ID NO: 179595 - DNA, 9 bp, Unknown
  misc_feature (1)..( 9): Result.005 file - promoters50/2104855
cgccatgaa

SEQ ID NO: 179596 - DNA, 9 bp, Unknown
  misc_feature (1)..( 9): Result.005 file - promoters50/2104855
tgccatgta

SEQ ID NO: 179597 - DNA, 9 bp, Unknown
  misc_feature (1)..( 9): Result.005 file - promoters50/2104855
aggcccaat

SEQ ID NO: 179598 - DNA, 9 bp, Unknown
  misc_feature (1)..( 9): Result.005 file - promoters50/2104855
aggcccaat

SEQ ID NO: 179599 - DNA, 9 bp, Unknown
  misc_feature (1)..( 9): Result.005 file - promoters50/2104855
cggcccatc

SEQ ID NO: 179600 - DNA, 9 bp, Unknown
  misc_feature (1)..( 9): Result.005 file - promoters50/2104874
aaaaaatta

SEQ ID NO: 179601 - DNA, 9 bp, Unknown
  misc_feature (1)..( 9): Result.005 file - promoters50/2104874
caaaaattt

SEQ ID NO: 179602 - DNA, 9 bp, Unknown
  misc_feature (1)..( 9): Result.005 file - promoters50/2104874
aaaaaatta

SEQ ID NO: 179603 - DNA, 9 bp, Unknown
  misc_feature (1)..( 9): Result.005 file - promoters50/2104874
cctaaattt

SEQ ID NO: 179604 - DNA, 9 bp, Unknown
  misc_feature (1)..( 9): Result.005 file - promoters50/2104874
taaatattc

SEQ ID NO: 179605 - DNA, 9 bp, Unknown
  misc_feature (1)..( 9): Result.005 file - promoters50/2104874
caaaaagca

SEQ ID NO: 179606 - DNA, 14 bp, Unknown
  misc_feature (1)..( 14): Result.005 file - promoters50/2104874
tttggttttctaca

SEQ ID NO: 179607 - DNA, 14 bp, Unknown
  misc_feature (1)..( 14): Result.005 file - promoters50/2104874
cttggttggaacta

SEQ ID NO: 179608 - DNA, 14 bp, Unknown
  misc_feature (1)..( 14): Result.005 file - promoters50/2104874
tttgatttgatttt

SEQ ID NO: 179609 - DNA, 14 bp, Unknown
  misc_feature (1)..( 14): Result.005 file - promoters50/2104874
attgtttgttgcgt

SEQ ID NO: 179610 - DNA, 15 bp, Unknown
  misc_feature (1)..( 15): Result.005 file - promoters50/2104874
cgtgacttggagcta

SEQ ID NO: 179611 - DNA, 15 bp, Unknown
  misc_feature (1)..( 15): Result.005 file - promoters50/2104874
cttaatttttttttg

SEQ ID NO: 179612 - DNA, 10 bp, Unknown
  misc_feature (1)..( 10): Result.005 file - promoters50/2105109
atataaaagc

SEQ ID NO: 179613 - DNA, 10 bp, Unknown
  misc_feature (1)..( 10): Result.005 file - promoters50/2105109
aaataaaaac

SEQ ID NO: 179614 - DNA, 10 bp, Unknown
  misc_feature (1)..( 10): Result.005 file - promoters50/2105109
atataaatgg

SEQ ID NO: 179615 - DNA, 10 bp, Unknown
  misc_feature (1)..( 10): Result.005 file - promoters50/2105109
ctattaaagc

SEQ ID NO: 179616 - DNA, 10 bp, Unknown
  misc_feature (1)..( 10): Result.005 file - promoters50/2105109
caataaagat

SEQ ID NO: 179617 - DNA, 10 bp, Unknown
  misc_feature (1)..( 10): Result.005 file - promoters50/2105109
caataaagat

SEQ ID NO: 179618 - DNA, 10 bp, Unknown
  misc_feature (1)..( 10): Result.005 file - promoters50/2105109
ctatatatat

SEQ ID NO: 179619 - DNA, 10 bp, Unknown
  misc_feature (1)..( 10): Result.005 file - promoters50/2105109
cctaaggcca

SEQ ID NO: 179620 - DNA, 10 bp, Unknown
  misc_feature (1)..( 10): Result.005 file - promoters50/2105109
aataaagccc

SEQ ID NO: 179621 - DNA, 10 bp, Unknown
  misc_feature (1)..( 10): Result.005 file - promoters50/2105109
cctaagccca

SEQ ID NO: 179622 - DNA, 10 bp, Unknown
  misc_feature (1)..( 10): Result.005 file - promoters50/2105109
ctaaaggccc

SEQ ID NO: 179623 - DNA, 10 bp, Unknown
  misc_feature (1)..( 10): Result.005 file - promoters50/2105109
tttaagtccc

SEQ ID NO: 179624 - DNA, 10 bp, Unknown
  misc_feature (1)..( 10): Result.005 file - promoters50/2105109
ctcaaaaccc

SEQ ID NO: 179625 - DNA, 8 bp, Unknown
  misc_feature (1)..( 8): Result.005 file - promoters50/2105141
gtggtaaa

SEQ ID NO: 179626 - DNA, 8 bp, Unknown
  misc_feature (1)..( 8): Result.005 file - promoters50/2105141
gtgctaaa

SEQ ID NO: 179627 - DNA, 8 bp, Unknown
  misc_feature (1)..( 8): Result.005 file - promoters50/2105141
atgctaat

SEQ ID NO: 179628 - DNA, 10 bp, Unknown
  misc_feature (1)..( 10): Result.005 file - promoters50/2105141
aaaacaaact

SEQ ID NO: 179629 - DNA, 10 bp, Unknown
  misc_feature (1)..( 10): Result.005 file - promoters50/2105141
aaatcaaatt

SEQ ID NO: 179630 - DNA, 10 bp, Unknown
  misc_feature (1)..( 10): Result.005 file - promoters50/2105141
ctgtcatatt

SEQ ID NO: 179631 - DNA, 7 bp, Unknown
  misc_feature (1)..( 7): Result.005 file - promoters50/2105141
tttttat

SEQ ID NO: 179632 - DNA, 7 bp, Unknown
  misc_feature (1)..( 7): Result.005 file - promoters50/2105141
tttttat

SEQ ID NO: 179633 - DNA, 7 bp, Unknown
  misc_feature (1)..( 7): Result.005 file - promoters50/2105141
attttat

SEQ ID NO: 179634 - DNA, 9 bp, Unknown
  misc_feature (1)..( 9): Result.005 file - promoters50/2105141
tttatttta

SEQ ID NO: 179635 - DNA, 9 bp, Unknown
  misc_feature (1)..( 9): Result.005 file - promoters50/2105141
catattttc

SEQ ID NO: 179636 - DNA, 9 bp, Unknown
  misc_feature (1)..( 9): Result.005 file - promoters50/2105141
aagatttta

SEQ ID NO: 179637 - DNA, 9 bp, Unknown
  misc_feature (1)..( 9): Result.005 file - promoters50/2105141
catatttat

SEQ ID NO: 179638 - DNA, 7 bp, Unknown
  misc_feature (1)..( 7): Result.005 file - promoters50/2105141
taaataa

SEQ ID NO: 179639 - DNA, 7 bp, Unknown
  misc_feature (1)..( 7): Result.005 file - promoters50/2105141
taaataa

SEQ ID NO: 179640 - DNA, 7 bp, Unknown
  misc_feature (1)..( 7): Result.005 file - promoters50/2105141
taaataa

SEQ ID NO: 179641 - DNA, 8 bp, Unknown
  misc_feature (1)..( 8): Result.005 file - promoters50/2105141
ttttgaat

SEQ ID NO: 179642 - DNA, 8 bp, Unknown
  misc_feature (1)..( 8): Result.005 file - promoters50/2105141
ttttcaat

SEQ ID NO: 179643 - DNA, 8 bp, Unknown
  misc_feature (1)..( 8): Result.005 file - promoters50/2105141
ggttcaat

SEQ ID NO: 179644 - DNA, 11 bp, Unknown
  misc_feature (1)..( 11): Result.005 file - promoters50/2105141
cacaaatcatt

SEQ ID NO: 179645 - DNA, 11 bp, Unknown
  misc_feature (1)..( 11): Result.005 file - promoters50/2105141
cactaatcact

SEQ ID NO: 179646 - DNA, 11 bp, Unknown
  misc_feature (1)..( 11): Result.005 file - promoters50/2105141
tatgaattatt

SEQ ID NO: 179647 - DNA, 10 bp, Unknown
  misc_feature (1)..( 10): Result.005 file - promoters50/2105141
aaaaaaaccc

SEQ ID NO: 179648 - DNA, 10 bp, Unknown
  misc_feature (1)..( 10): Result.005 file - promoters50/2105141
cagaaatccc

SEQ ID NO: 179649 - DNA, 10 bp, Unknown
  misc_feature (1)..( 10): Result.005 file - promoters50/2105141
aaaaaaacat

SEQ ID NO: 179650 - DNA, 14 bp, Unknown
  misc_feature (1)..( 14): Result.005 file - promoters50/2105141
tagtagatatagta

SEQ ID NO: 179651 - DNA, 14 bp, Unknown
  misc_feature (1)..( 14): Result.005 file - promoters50/2105141
ataattataaagta

SEQ ID NO: 179652 - DNA, 14 bp, Unknown
  misc_feature (1)..( 14): Result.005 file - promoters50/2105141
atatttataaataa

SEQ ID NO: 179653 - DNA, 10 bp, Unknown
  misc_feature (1)..( 10): Result.005 file - promoters50/2105141
attttatata

SEQ ID NO: 179654 - DNA, 10 bp, Unknown
  misc_feature (1)..( 10): Result.005 file - promoters50/2105141
ataatatata

SEQ ID NO: 179655 - DNA, 10 bp, Unknown
  misc_feature (1)..( 10): Result.005 file - promoters50/2105141
ataaaatatc

SEQ ID NO: 179656 - DNA, 9 bp, Unknown
  misc_feature (1)..( 9): Result.005 file - promoters50/2105141
tgaatctat

SEQ ID NO: 179657 - DNA, 9 bp, Unknown
  misc_feature (1)..( 9): Result.005 file - promoters50/2105141
acaatttat

SEQ ID NO: 179658 - DNA, 9 bp, Unknown
  misc_feature (1)..( 9): Result.005 file - promoters50/2105141
acaaattaa

SEQ ID NO: 179659 - DNA, 7 bp, Unknown
  misc_feature (1)..( 7): Result.005 file - promoters50/2105141
ttattta

SEQ ID NO: 179660 - DNA, 7 bp, Unknown
  misc_feature (1)..( 7): Result.005 file - promoters50/2105141
ttattta

SEQ ID NO: 179661 - DNA, 7 bp, Unknown
  misc_feature (1)..( 7): Result.005 file - promoters50/2105141
atattta

SEQ ID NO: 179662 - DNA, 7 bp, Unknown
  misc_feature (1)..( 7): Result.005 file - promoters50/2105141
tttgtta

SEQ ID NO: 179663 - DNA, 7 bp, Unknown
  misc_feature (1)..( 7): Result.005 file - promoters50/2105141
tttttta

SEQ ID NO: 179664 - DNA, 7 bp, Unknown
  misc_feature (1)..( 7): Result.005 file - promoters50/2105141
attttta

SEQ ID NO: 179665 - DNA, 7 bp, Unknown
  misc_feature (1)..( 7): Result.005 file - promoters50/2105250
agtttaa

SEQ ID NO: 179666 - DNA, 7 bp, Unknown
  misc_feature (1)..( 7): Result.005 file - promoters50/2105250
agtttat

SEQ ID NO: 179667 - DNA, 7 bp, Unknown
  misc_feature (1)..( 7): Result.005 file - promoters50/2105250
cgtttat

SEQ ID NO: 179668 - DNA, 10 bp, Unknown
  misc_feature (1)..( 10): Result.005 file - promoters50/2105394
cttagtcaat

SEQ ID NO: 179669 - DNA, 10 bp, Unknown
  misc_feature (1)..( 10): Result.005 file - promoters50/2105394
attattcaac

SEQ ID NO: 179670 - DNA, 10 bp, Unknown
  misc_feature (1)..( 10): Result.005 file - promoters50/2105394
attatttcac

SEQ ID NO: 179671 - DNA, 10 bp, Unknown
  misc_feature (1)..( 10): Result.005 file - promoters50/2105394
gatcttcaac

SEQ ID NO: 179672 - DNA, 9 bp, Unknown
  misc_feature (1)..( 9): Result.005 file - promoters50/2105398
caaaataaa

SEQ ID NO: 179673 - DNA, 9 bp, Unknown
  misc_feature (1)..( 9): Result.005 file - promoters50/2105398
gaaaatatt

SEQ ID NO: 179674 - DNA, 9 bp, Unknown
  misc_feature (1)..( 9): Result.005 file - promoters50/2105398
aaaaataag

SEQ ID NO: 179675 - DNA, 9 bp, Unknown
  misc_feature (1)..( 9): Result.005 file - promoters50/2105398
taaaaaaaa

SEQ ID NO: 179676 - DNA, 10 bp, Unknown
  misc_feature (1)..( 10): Result.005 file - promoters50/2105398
taaacatatt

SEQ ID NO: 179677 - DNA, 10 bp, Unknown
  misc_feature (1)..( 10): Result.005 file - promoters50/2105398
taaaaaaaaa

SEQ ID NO: 179678 - DNA, 11 bp, Unknown
  misc_feature (1)..( 11): Result.005 file - promoters50/2105398
aaaactgaacc

SEQ ID NO: 179679 - DNA, 11 bp, Unknown
  misc_feature (1)..( 11): Result.005 file - promoters50/2105398
caaaatgaaaa

SEQ ID NO: 179680 - DNA, 11 bp, Unknown
  misc_feature (1)..( 11): Result.005 file - promoters50/2105398
aaaaataaact

SEQ ID NO: 179681 - DNA, 11 bp, Unknown
  misc_feature (1)..( 11): Result.005 file - promoters50/2105398
tttaatgaaat

SEQ ID NO: 179682 - DNA, 11 bp, Unknown
  misc_feature (1)..( 11): Result.005 file - promoters50/2105398
atcaatcaaat

SEQ ID NO: 179683 - DNA, 11 bp, Unknown
  misc_feature (1)..( 11): Result.005 file - promoters50/2105398
taaaaaaaagg

SEQ ID NO: 179684 - DNA, 10 bp, Unknown
  misc_feature (1)..( 10): Result.005 file - promoters50/2105398
aaaacaaact

SEQ ID NO: 179685 - DNA, 10 bp, Unknown
  misc_feature (1)..( 10): Result.005 file - promoters50/2105398
aaaacaaacg

SEQ ID NO: 179686 - DNA, 10 bp, Unknown
  misc_feature (1)..( 10): Result.005 file - promoters50/2105398
aaaaaaagaa

SEQ ID NO: 179687 - DNA, 10 bp, Unknown
  misc_feature (1)..( 10): Result.005 file - promoters50/2105398
taaacaaact

SEQ ID NO: 179688 - DNA, 10 bp, Unknown
  misc_feature (1)..( 10): Result.005 file - promoters50/2105398
aaaataaact

SEQ ID NO: 179689 - DNA, 10 bp, Unknown
  misc_feature (1)..( 10): Result.005 file - promoters50/2105398
acaacaaagt

SEQ ID NO: 179690 - DNA, 10 bp, Unknown
  misc_feature (1)..( 10): Result.005 file - promoters50/2105398
aaaaaaaaga

SEQ ID NO: 179691 - DNA, 10 bp, Unknown
  misc_feature (1)..( 10): Result.005 file - promoters50/2105398
aaaaaaaagg

SEQ ID NO: 179692 - DNA, 12 bp, Unknown
  misc_feature (1)..( 12): Result.005 file - promoters50/2105398
agaaaaaaaaac

SEQ ID NO: 179693 - DNA, 12 bp, Unknown
  misc_feature (1)..( 12): Result.005 file - promoters50/2105398
ctaaaaaaaagg

SEQ ID NO: 179694 - DNA, 12 bp, Unknown
  misc_feature (1)..( 12): Result.005 file - promoters50/2105398
agaaagaaacat

SEQ ID NO: 179695 - DNA, 13 bp, Unknown
  misc_feature (1)..( 13): Result.005 file - promoters50/2105398
acaaaaataaact

SEQ ID NO: 179696 - DNA, 13 bp, Unknown
  misc_feature (1)..( 13): Result.005 file - promoters50/2105398
taaaagcaactaa

SEQ ID NO: 179697 - DNA, 13 bp, Unknown
  misc_feature (1)..( 13): Result.005 file - promoters50/2105398
tgaaattcatttt

SEQ ID NO: 179698 - DNA, 10 bp, Unknown
  misc_feature (1)..( 10): Result.005 file - promoters50/2105398
taaaaataat

SEQ ID NO: 179699 - DNA, 10 bp, Unknown
  misc_feature (1)..( 10): Result.005 file - promoters50/2105398
caaaattaaa

SEQ ID NO: 179700 - DNA, 10 bp, Unknown
  misc_feature (1)..( 10): Result.005 file - promoters50/2105398
taaatataaa

SEQ ID NO: 179701 - DNA, 10 bp, Unknown
  misc_feature (1)..( 10): Result.005 file - promoters50/2105398
caacattgct

SEQ ID NO: 179702 - DNA, 10 bp, Unknown
  misc_feature (1)..( 10): Result.005 file - promoters50/2105398
caacatttat

SEQ ID NO: 179703 - DNA, 10 bp, Unknown
  misc_feature (1)..( 10): Result.005 file - promoters50/2105398
ttaatataaa

SEQ ID NO: 179704 - DNA, 11 bp, Unknown
  misc_feature (1)..( 11): Result.005 file - promoters50/2105507
aagggaagttg

SEQ ID NO: 179705 - DNA, 11 bp, Unknown
  misc_feature (1)..( 11): Result.005 file - promoters50/2105507
aagcgaatttg

SEQ ID NO: 179706 - DNA, 11 bp, Unknown
  misc_feature (1)..( 11): Result.005 file - promoters50/2105507
ttaagaatttg

SEQ ID NO: 179707 - DNA, 8 bp, Unknown
  misc_feature (1)..( 8): Result.005 file - promoters50/2105533
ggtggaaa

SEQ ID NO: 179708 - DNA, 8 bp, Unknown
  misc_feature (1)..( 8): Result.005 file - promoters50/2105533
tttggaaa

SEQ ID NO: 179709 - DNA, 8 bp, Unknown
  misc_feature (1)..( 8): Result.005 file - promoters50/2105533
ttttgaat

SEQ ID NO: 179710 - DNA, 9 bp, Unknown
  misc_feature (1)..( 9): Result.005 file - promoters50/2105533
aagaagtta

SEQ ID NO: 179711 - DNA, 9 bp, Unknown
  misc_feature (1)..( 9): Result.005 file - promoters50/2105533
ttgaattta

SEQ ID NO: 179712 - DNA, 9 bp, Unknown
  misc_feature (1)..( 9): Result.005 file - promoters50/2105533
aagacgttg

SEQ ID NO: 179713 - DNA, 7 bp, Unknown
  misc_feature (1)..( 7): Result.005 file - promoters50/2105533
gatgaaa

SEQ ID NO: 179714 - DNA, 7 bp, Unknown
  misc_feature (1)..( 7): Result.005 file - promoters50/2105533
gattaaa

SEQ ID NO: 179715 - DNA, 7 bp, Unknown
  misc_feature (1)..( 7): Result.005 file - promoters50/2105533
gattaat

SEQ ID NO: 179716 - DNA, 11 bp, Unknown
  misc_feature (1)..( 11): Result.005 file - promoters50/2105535
gatacaatggt

SEQ ID NO: 179717 - DNA, 11 bp, Unknown
  misc_feature (1)..( 11): Result.005 file - promoters50/2105535
gattcaaaatt

SEQ ID NO: 179718 - DNA, 11 bp, Unknown
  misc_feature (1)..( 11): Result.005 file - promoters50/2105535
aataaaataaa

SEQ ID NO: 179719 - DNA, 11 bp, Unknown
  misc_feature (1)..( 11): Result.005 file - promoters50/2105535
gatacagactt

SEQ ID NO: 179720 - DNA, 12 bp, Unknown
  misc_feature (1)..( 12): Result.005 file - promoters50/2105535
cattccaaagtt

SEQ ID NO: 179721 - DNA, 12 bp, Unknown
  misc_feature (1)..( 12): Result.005 file - promoters50/2105535
gtgtcaaataaa

SEQ ID NO: 179722 - DNA, 10 bp, Unknown
  misc_feature (1)..( 10): Result.005 file - promoters50/2105578
agttagagtc

SEQ ID NO: 179723 - DNA, 10 bp, Unknown
  misc_feature (1)..( 10): Result.005 file - promoters50/2105578
agttagtata

SEQ ID NO: 179724 - DNA, 10 bp, Unknown
  misc_feature (1)..( 10): Result.005 file - promoters50/2105578
ggttattata

SEQ ID NO: 179725 - DNA, 9 bp, Unknown
  misc_feature (1)..( 9): Result.005 file - promoters50/2105578
ttattttct

SEQ ID NO: 179726 - DNA, 9 bp, Unknown
  misc_feature (1)..( 9): Result.005 file - promoters50/2105578
ttattttct

SEQ ID NO: 179727 - DNA, 9 bp, Unknown
  misc_feature (1)..( 9): Result.005 file - promoters50/2105578
ttttttgta

SEQ ID NO: 179728 - DNA, 7 bp, Unknown
  misc_feature (1)..( 7): Result.005 file - promoters50/2105578
attgtag

SEQ ID NO: 179729 - DNA, 7 bp, Unknown
  misc_feature (1)..( 7): Result.005 file - promoters50/2105578
attgtat

SEQ ID NO: 179730 - DNA, 7 bp, Unknown
  misc_feature (1)..( 7): Result.005 file - promoters50/2105578
attttat

SEQ ID NO: 179731 - DNA, 11 bp, Unknown
  misc_feature (1)..( 11): Result.005 file - promoters50/2105578
gtttcaagcct

SEQ ID NO: 179732 - DNA, 11 bp, Unknown
  misc_feature (1)..( 11): Result.005 file - promoters50/2105578
ttctcaatcct

SEQ ID NO: 179733 - DNA, 11 bp, Unknown
  misc_feature (1)..( 11): Result.005 file - promoters50/2105578
ttcttaattat

SEQ ID NO: 179734 - DNA, 7 bp, Unknown
  misc_feature (1)..( 7): Result.005 file - promoters50/2105819
aacatat

SEQ ID NO: 179735 - DNA, 7 bp, Unknown
  misc_feature (1)..( 7): Result.005 file - promoters50/2105819
gacatat

SEQ ID NO: 179736 - DNA, 7 bp, Unknown
  misc_feature (1)..( 7): Result.005 file - promoters50/2105819
aacttat

SEQ ID NO: 179737 - DNA, 8 bp, Unknown
  misc_feature (1)..( 8): Result.005 file - promoters50/2105819
ttaatgat

SEQ ID NO: 179738 - DNA, 8 bp, Unknown
  misc_feature (1)..( 8): Result.005 file - promoters50/2105819
ctaatgat

SEQ ID NO: 179739 - DNA, 8 bp, Unknown
  misc_feature (1)..( 8): Result.005 file - promoters50/2105819
ttattgat

SEQ ID NO: 179740 - DNA, 10 bp, Unknown
  misc_feature (1)..( 10): Result.005 file - promoters50/2105819
aaatgtcata

SEQ ID NO: 179741 - DNA, 10 bp, Unknown
  misc_feature (1)..( 10): Result.005 file - promoters50/2105819
aaatgtcaaa

SEQ ID NO: 179742 - DNA, 10 bp, Unknown
  misc_feature (1)..( 10): Result.005 file - promoters50/2105819
gaatgtaaaa

SEQ ID NO: 179743 - DNA, 8 bp, Unknown
  misc_feature (1)..( 8): Result.005 file - promoters50/2105912
atttgtta

SEQ ID NO: 179744 - DNA, 8 bp, Unknown
  misc_feature (1)..( 8): Result.005 file - promoters50/2105912
atttgtta

SEQ ID NO: 179745 - DNA, 8 bp, Unknown
  misc_feature (1)..( 8): Result.005 file - promoters50/2105912
atttttta

SEQ ID NO: 179746 - DNA, 8 bp, Unknown
  misc_feature (1)..( 8): Result.005 file - promoters50/2105912
gtttgttg

SEQ ID NO: 179747 - DNA, 8 bp, Unknown
  misc_feature (1)..( 8): Result.005 file - promoters50/2105912
atttgttt

SEQ ID NO: 179748 - DNA, 8 bp, Unknown
  misc_feature (1)..( 8): Result.005 file - promoters50/2105912
ttttgtta

SEQ ID NO: 179749 - DNA, 11 bp, Unknown
  misc_feature (1)..( 11): Result.005 file - promoters50/2105912
aagttataagt

SEQ ID NO: 179750 - DNA, 11 bp, Unknown
  misc_feature (1)..( 11): Result.005 file - promoters50/2105912
aatttaaaagt

SEQ ID NO: 179751 - DNA, 11 bp, Unknown
  misc_feature (1)..( 11): Result.005 file - promoters50/2105912
aagctatcagt

SEQ ID NO: 179752 - DNA, 11 bp, Unknown
  misc_feature (1)..( 11): Result.005 file - promoters50/2105912
atgttaaaaac

SEQ ID NO: 179753 - DNA, 11 bp, Unknown
  misc_feature (1)..( 11): Result.005 file - promoters50/2105912
acactaaaagg

SEQ ID NO: 179754 - DNA, 11 bp, Unknown
  misc_feature (1)..( 11): Result.005 file - promoters50/2105912
tggttaaaagt

SEQ ID NO: 179755 - DNA, 9 bp, Unknown
  misc_feature (1)..( 9): Result.005 file - promoters50/2106017
tttcaaaat

SEQ ID NO: 179756 - DNA, 9 bp, Unknown
  misc_feature (1)..( 9): Result.005 file - promoters50/2106017
gttcaaatc

SEQ ID NO: 179757 - DNA, 9 bp, Unknown
  misc_feature (1)..( 9): Result.005 file - promoters50/2106017
tttgaaata

SEQ ID NO: 179758 - DNA, 9 bp, Unknown
  misc_feature (1)..( 9): Result.005 file - promoters50/2106017
agtcaaatc

SEQ ID NO: 179759 - DNA, 9 bp, Unknown
  misc_feature (1)..( 9): Result.005 file - promoters50/2106017
ggtgaaatc

SEQ ID NO: 179760 - DNA, 9 bp, Unknown
  misc_feature (1)..( 9): Result.005 file - promoters50/2106017
gttcaaatc

SEQ ID NO: 179761 - DNA, 11 bp, Unknown
  misc_feature (1)..( 11): Result.005 file - promoters50/2106017
taatgaattaa

SEQ ID NO: 179762 - DNA, 11 bp, Unknown
  misc_feature (1)..( 11): Result.005 file - promoters50/2106017
ttttgagttat

SEQ ID NO: 179763 - DNA, 11 bp, Unknown
  misc_feature (1)..( 11): Result.005 file - promoters50/2106017
aaatgcattaa

SEQ ID NO: 179764 - DNA, 11 bp, Unknown
  misc_feature (1)..( 11): Result.005 file - promoters50/2106017
taataaattag

SEQ ID NO: 179765 - DNA, 11 bp, Unknown
  misc_feature (1)..( 11): Result.005 file - promoters50/2106017
acataaacatt

SEQ ID NO: 179766 - DNA, 11 bp, Unknown
  misc_feature (1)..( 11): Result.005 file - promoters50/2106017
ttgtaagaaaa

SEQ ID NO: 179767 - DNA, 11 bp, Unknown
  misc_feature (1)..( 11): Result.005 file - promoters50/2106017
taattgacaaa

SEQ ID NO: 179768 - DNA, 12 bp, Unknown
  misc_feature (1)..( 12): Result.005 file - promoters50/2106017
gcttgaaatcag

SEQ ID NO: 179769 - DNA, 12 bp, Unknown
  misc_feature (1)..( 12): Result.005 file - promoters50/2106017
gtttgaaatttt

SEQ ID NO: 179770 - DNA, 12 bp, Unknown
  misc_feature (1)..( 12): Result.005 file - promoters50/2106017
gttttaaagttt

SEQ ID NO: 179771 - DNA, 12 bp, Unknown
  misc_feature (1)..( 12): Result.005 file - promoters50/2106017
gttttagatctg

SEQ ID NO: 179772 - DNA, 12 bp, Unknown
  misc_feature (1)..( 12): Result.005 file - promoters50/2106017
ccattaaagctc

SEQ ID NO: 179773 - DNA, 12 bp, Unknown
  misc_feature (1)..( 12): Result.005 file - promoters50/2106017
tgattaaaaagc

SEQ ID NO: 179774 - DNA, 12 bp, Unknown
  misc_feature (1)..( 12): Result.005 file - promoters50/2106017
tattgaagacta

SEQ ID NO: 179775 - DNA, 8 bp, Unknown
  misc_feature (1)..( 8): Result.005 file - promoters50/2106109
aaatggtt

SEQ ID NO: 179776 - DNA, 8 bp, Unknown
  misc_feature (1)..( 8): Result.005 file - promoters50/2106109
aaaaggta

SEQ ID NO: 179777 - DNA, 8 bp, Unknown
  misc_feature (1)..( 8): Result.005 file - promoters50/2106109
taattgtt

SEQ ID NO: 179778 - DNA, 8 bp, Unknown
  misc_feature (1)..( 8): Result.005 file - promoters50/2106109
attttttt

SEQ ID NO: 179779 - DNA, 8 bp, Unknown
  misc_feature (1)..( 8): Result.005 file - promoters50/2106109
attgtttt

SEQ ID NO: 179780 - DNA, 8 bp, Unknown
  misc_feature (1)..( 8): Result.005 file - promoters50/2106109
atttttat

SEQ ID NO: 179781 - DNA, 13 bp, Unknown
  misc_feature (1)..( 13): Result.005 file - promoters50/2106505
gagtaatttcaaa

SEQ ID NO: 179782 - DNA, 13 bp, Unknown
  misc_feature (1)..( 13): Result.005 file - promoters50/2106505
ttcttttttcaat

SEQ ID NO: 179783 - DNA, 13 bp, Unknown
  misc_feature (1)..( 13): Result.005 file - promoters50/2106505
aattaatttaaaa

SEQ ID NO: 179784 - DNA, 13 bp, Unknown
  misc_feature (1)..( 13): Result.005 file - promoters50/2106505
aattgatttagta

SEQ ID NO: 179785 - DNA, 13 bp, Unknown
  misc_feature (1)..( 13): Result.005 file - promoters50/2106505
aatcaattgaatt

SEQ ID NO: 179786 - DNA, 13 bp, Unknown
  misc_feature (1)..( 13): Result.005 file - promoters50/2106505
cgataatttatag

SEQ ID NO: 179787 - DNA, 13 bp, Unknown
  misc_feature (1)..( 13): Result.005 file - promoters50/2106505
aattgatccatga

SEQ ID NO: 179788 - DNA, 7 bp, Unknown
  misc_feature (1)..( 7): Result.005 file - promoters50/2106682
tgtttca

SEQ ID NO: 179789 - DNA, 7 bp, Unknown
  misc_feature (1)..( 7): Result.005 file - promoters50/2106682
tgtttcg

SEQ ID NO: 179790 - DNA, 7 bp, Unknown
  misc_feature (1)..( 7): Result.005 file - promoters50/2106682
cgtttcg

SEQ ID NO: 179791 - DNA, 8 bp, Unknown
  misc_feature (1)..( 8): Result.005 file - promoters50/2106682
attatgat

SEQ ID NO: 179792 - DNA, 8 bp, Unknown
  misc_feature (1)..( 8): Result.005 file - promoters50/2106682
attttgag

SEQ ID NO: 179793 - DNA, 8 bp, Unknown
  misc_feature (1)..( 8): Result.005 file - promoters50/2106682
ttttcgag

SEQ ID NO: 179794 - DNA, 9 bp, Unknown
  misc_feature (1)..( 9): Result.005 file - promoters50/2106758
caaatgaaa

SEQ ID NO: 179795 - DNA, 9 bp, Unknown
  misc_feature (1)..( 9): Result.005 file - promoters50/2106758
taaaagaag

SEQ ID NO: 179796 - DNA, 9 bp, Unknown
  misc_feature (1)..( 9): Result.005 file - promoters50/2106758
caaattaaa

SEQ ID NO: 179797 - DNA, 10 bp, Unknown
  misc_feature (1)..( 10): Result.005 file - promoters50/2106789
atttagaaaa

SEQ ID NO: 179798 - DNA, 10 bp, Unknown
  misc_feature (1)..( 10): Result.005 file - promoters50/2106789
atttataaag

SEQ ID NO: 179799 - DNA, 10 bp, Unknown
  misc_feature (1)..( 10): Result.005 file - promoters50/2106789
tccgataaag

SEQ ID NO: 179800 - DNA, 10 bp, Unknown
  misc_feature (1)..( 10): Result.005 file - promoters50/2106908
agatttttcc

SEQ ID NO: 179801 - DNA, 10 bp, Unknown
  misc_feature (1)..( 10): Result.005 file - promoters50/2106908
agatgtttaa

SEQ ID NO: 179802 - DNA, 10 bp, Unknown
  misc_feature (1)..( 10): Result.005 file - promoters50/2106908
ccatttctcc

SEQ ID NO: 179803 - DNA, 14 bp, Unknown
  misc_feature (1)..( 14): Result.005 file - promoters50/2106908
ataagcggattcgg

SEQ ID NO: 179804 - DNA, 14 bp, Unknown
  misc_feature (1)..( 14): Result.005 file - promoters50/2106908
ataagcctaatcaa

SEQ ID NO: 179805 - DNA, 14 bp, Unknown
  misc_feature (1)..( 14): Result.005 file - promoters50/2106908
gtaaacctaaacaa

SEQ ID NO: 179806 - DNA, 14 bp, Unknown
  misc_feature (1)..( 14): Result.005 file - promoters50/2106908
caaaacaaaaaaaa

SEQ ID NO: 179807 - DNA, 7 bp, Unknown
  misc_feature (1)..( 7): Result.005 file - promoters50/2106908
aaataat

SEQ ID NO: 179808 - DNA, 7 bp, Unknown
  misc_feature (1)..( 7): Result.005 file - promoters50/2106908
aaataaa

SEQ ID NO: 179809 - DNA, 7 bp, Unknown
  misc_feature (1)..( 7): Result.005 file - promoters50/2106908
aaagaaa

SEQ ID NO: 179810 - DNA, 10 bp, Unknown
  misc_feature (1)..( 10): Result.005 file - promoters50/2106908
taatatattt

SEQ ID NO: 179811 - DNA, 10 bp, Unknown
  misc_feature (1)..( 10): Result.005 file - promoters50/2106908
aaataaattg

SEQ ID NO: 179812 - DNA, 10 bp, Unknown
  misc_feature (1)..( 10): Result.005 file - promoters50/2106908
aaagaaaaag

SEQ ID NO: 179813 - DNA, 10 bp, Unknown
  misc_feature (1)..( 10): Result.005 file - promoters50/2106908
atagaaattg

SEQ ID NO: 179814 - DNA, 9 bp, Unknown
  misc_feature (1)..( 9): Result.005 file - promoters50/2106908
aacaaaacc

SEQ ID NO: 179815 - DNA, 9 bp, Unknown
  misc_feature (1)..( 9): Result.005 file - promoters50/2106908
atcaaaacc

SEQ ID NO: 179816 - DNA, 9 bp, Unknown
  misc_feature (1)..( 9): Result.005 file - promoters50/2106908
atctaaatc

SEQ ID NO: 179817 - DNA, 7 bp, Unknown
  misc_feature (1)..( 7): Result.005 file - promoters50/2106908
aaacaaa

SEQ ID NO: 179818 - DNA, 7 bp, Unknown
  misc_feature (1)..( 7): Result.005 file - promoters50/2106908
aaacaaa

SEQ ID NO: 179819 - DNA, 7 bp, Unknown
  misc_feature (1)..( 7): Result.005 file - promoters50/2106908
aaacaaa

SEQ ID NO: 179820 - DNA, 9 bp, Unknown
  misc_feature (1)..( 9): Result.005 file - promoters50/2106908
tatttaaat

SEQ ID NO: 179821 - DNA, 9 bp, Unknown
  misc_feature (1)..( 9): Result.005 file - promoters50/2106908
tatctaaat

SEQ ID NO: 179822 - DNA, 9 bp, Unknown
  misc_feature (1)..( 9): Result.005 file - promoters50/2106908
aatcaaaac

SEQ ID NO: 179823 - DNA, 8 bp, Unknown
  misc_feature (1)..( 8): Result.005 file - promoters50/2106908
aaaataaa

SEQ ID NO: 179824 - DNA, 8 bp, Unknown
  misc_feature (1)..( 8): Result.005 file - promoters50/2106908
aaaaaaaa

SEQ ID NO: 179825 - DNA, 8 bp, Unknown
  misc_feature (1)..( 8): Result.005 file - promoters50/2106908
aaaaaagt

SEQ ID NO: 179826 - DNA, 9 bp, Unknown
  misc_feature (1)..( 9): Result.005 file - promoters50/2107016
cttgttatt

SEQ ID NO: 179827 - DNA, 9 bp, Unknown
  misc_feature (1)..( 9): Result.005 file - promoters50/2107016
ctttttatt

SEQ ID NO: 179828 - DNA, 9 bp, Unknown
  misc_feature (1)..( 9): Result.005 file - promoters50/2107016
ggtttgatt

SEQ ID NO: 179829 - DNA, 9 bp, Unknown
  misc_feature (1)..( 9): Result.005 file - promoters50/2107016
gtcaaaaaa

SEQ ID NO: 179830 - DNA, 9 bp, Unknown
  misc_feature (1)..( 9): Result.005 file - promoters50/2107016
gtcaaatcc

SEQ ID NO: 179831 - DNA, 9 bp, Unknown
  misc_feature (1)..( 9): Result.005 file - promoters50/2107016
ctcaaaaaa

SEQ ID NO: 179832 - DNA, 14 bp, Unknown
  misc_feature (1)..( 14): Result.005 file - promoters50/2107065
aaattgaataaaag

SEQ ID NO: 179833 - DNA, 14 bp, Unknown
  misc_feature (1)..( 14): Result.005 file - promoters50/2107065
gtactgaagaaaaa

SEQ ID NO: 179834 - DNA, 14 bp, Unknown
  misc_feature (1)..( 14): Result.005 file - promoters50/2107065
tgcattaataaatg

SEQ ID NO: 179835 - DNA, 14 bp, Unknown
  misc_feature (1)..( 14): Result.005 file - promoters50/2107065
ttattcaatccaaa

SEQ ID NO: 179836 - DNA, 14 bp, Unknown
  misc_feature (1)..( 14): Result.005 file - promoters50/2107065
ccaaataagaaatt

SEQ ID NO: 179837 - DNA, 14 bp, Unknown
  misc_feature (1)..( 14): Result.005 file - promoters50/2107065
tattccaatacatg

SEQ ID NO: 179838 - DNA, 14 bp, Unknown
  misc_feature (1)..( 14): Result.005 file - promoters50/2107065
ttatgcaaagccat

SEQ ID NO: 179839 - DNA, 10 bp, Unknown
  misc_feature (1)..( 10): Result.005 file - promoters50/2107065
tgctaattta

SEQ ID NO: 179840 - DNA, 10 bp, Unknown
  misc_feature (1)..( 10): Result.005 file - promoters50/2107065
caataatttg

SEQ ID NO: 179841 - DNA, 10 bp, Unknown
  misc_feature (1)..( 10): Result.005 file - promoters50/2107065
acttaactta

SEQ ID NO: 179842 - DNA, 10 bp, Unknown
  misc_feature (1)..( 10): Result.005 file - promoters50/2107065
tgctcatttt

SEQ ID NO: 179843 - DNA, 10 bp, Unknown
  misc_feature (1)..( 10): Result.005 file - promoters50/2107065
aaataattct

SEQ ID NO: 179844 - DNA, 10 bp, Unknown
  misc_feature (1)..( 10): Result.005 file - promoters50/2107065
aaacaattca

SEQ ID NO: 179845 - DNA, 8 bp, Unknown
  misc_feature (1)..( 8): Result.005 file - promoters50/2107069
gttggaga

SEQ ID NO: 179846 - DNA, 8 bp, Unknown
  misc_feature (1)..( 8): Result.005 file - promoters50/2107069
gttggaag

SEQ ID NO: 179847 - DNA, 8 bp, Unknown
  misc_feature (1)..( 8): Result.005 file - promoters50/2107069
cttggaga

SEQ ID NO: 179848 - DNA, 7 bp, Unknown
  misc_feature (1)..( 7): Result.005 file - promoters50/2107069
ctgttgg

SEQ ID NO: 179849 - DNA, 7 bp, Unknown
  misc_feature (1)..( 7): Result.005 file - promoters50/2107069
atgttgg

SEQ ID NO: 179850 - DNA, 7 bp, Unknown
  misc_feature (1)..( 7): Result.005 file - promoters50/2107069
atgttgc

SEQ ID NO: 179851 - DNA, 12 bp, Unknown
  misc_feature (1)..( 12): Result.005 file - promoters50/2107069
gtgttttagttt

SEQ ID NO: 179852 - DNA, 12 bp, Unknown
  misc_feature (1)..( 12): Result.005 file - promoters50/2107069
gtgattttgttt

SEQ ID NO: 179853 - DNA, 12 bp, Unknown
  misc_feature (1)..( 12): Result.005 file - promoters50/2107069
gtgattccatta

SEQ ID NO: 179854 - DNA, 9 bp, Unknown
  misc_feature (1)..( 9): Result.005 file - promoters50/2108834
aatgaaaaa

SEQ ID NO: 179855 - DNA, 9 bp, Unknown
  misc_feature (1)..( 9): Result.005 file - promoters50/2108834
aattaaaat

SEQ ID NO: 179856 - DNA, 9 bp, Unknown
  misc_feature (1)..( 9): Result.005 file - promoters50/2108834
tccgaaaaa

SEQ ID NO: 179857 - DNA, 8 bp, Unknown
  misc_feature (1)..( 8): Result.005 file - promoters50/2108834
tttcgtaa

SEQ ID NO: 179858 - DNA, 8 bp, Unknown
  misc_feature (1)..( 8): Result.005 file - promoters50/2108834
tttcgtgg

SEQ ID NO: 179859 - DNA, 8 bp, Unknown
  misc_feature (1)..( 8): Result.005 file - promoters50/2108834
tttcttgg

SEQ ID NO: 179860 - DNA, 8 bp, Unknown
  misc_feature (1)..( 8): Result.005 file - promoters50/2109486
ggaaagat

SEQ ID NO: 179861 - DNA, 8 bp, Unknown
  misc_feature (1)..( 8): Result.005 file - promoters50/2109486
tgaaagat

SEQ ID NO: 179862 - DNA, 8 bp, Unknown
  misc_feature (1)..( 8): Result.005 file - promoters50/2109486
tgagagat

SEQ ID NO: 179863 - DNA, 8 bp, Unknown
  misc_feature (1)..( 8): Result.005 file - promoters50/2109486
gattattg

SEQ ID NO: 179864 - DNA, 8 bp, Unknown
  misc_feature (1)..( 8): Result.005 file - promoters50/2109486
gattattt

SEQ ID NO: 179865 - DNA, 8 bp, Unknown
  misc_feature (1)..( 8): Result.005 file - promoters50/2109486
atttattt

SEQ ID NO: 179866 - DNA, 7 bp, Unknown
  misc_feature (1)..( 7): Result.005 file - promoters50/2109486
aatatta

SEQ ID NO: 179867 - DNA, 7 bp, Unknown
  misc_feature (1)..( 7): Result.005 file - promoters50/2109486
catatta

SEQ ID NO: 179868 - DNA, 7 bp, Unknown
  misc_feature (1)..( 7): Result.005 file - promoters50/2109486
catgtta

SEQ ID NO: 179869 - DNA, 9 bp, Unknown
  misc_feature (1)..( 9): Result.005 file - promoters50/2113269
cgtttgata

SEQ ID NO: 179870 - DNA, 9 bp, Unknown
  misc_feature (1)..( 9): Result.005 file - promoters50/2113269
tgtttcata

SEQ ID NO: 179871 - DNA, 9 bp, Unknown
  misc_feature (1)..( 9): Result.005 file - promoters50/2113269
tttttgata

SEQ ID NO: 179872 - DNA, 9 bp, Unknown
  misc_feature (1)..( 9): Result.005 file - promoters50/2113269
agtttaata

SEQ ID NO: 179873 - DNA, 9 bp, Unknown
  misc_feature (1)..( 9): Result.005 file - promoters50/2113269
attttgaca

SEQ ID NO: 179874 - DNA, 9 bp, Unknown
  misc_feature (1)..( 9): Result.005 file - promoters50/2113269
agtataaaa

SEQ ID NO: 179875 - DNA, 10 bp, Unknown
  misc_feature (1)..( 10): Result.005 file - promoters50/2113269
atctacatat

SEQ ID NO: 179876 - DNA, 10 bp, Unknown
  misc_feature (1)..( 10): Result.005 file - promoters50/2113269
atcttcatat

SEQ ID NO: 179877 - DNA, 10 bp, Unknown
  misc_feature (1)..( 10): Result.005 file - promoters50/2113269
tactatataa

SEQ ID NO: 179878 - DNA, 10 bp, Unknown
  misc_feature (1)..( 10): Result.005 file - promoters50/2113269
ttctttataa

SEQ ID NO: 179879 - DNA, 10 bp, Unknown
  misc_feature (1)..( 10): Result.005 file - promoters50/2113269
ctttatatag

SEQ ID NO: 179880 - DNA, 10 bp, Unknown
  misc_feature (1)..( 10): Result.005 file - promoters50/2113269
gtctatataa

SEQ ID NO: 179881 - DNA, 13 bp, Unknown
  misc_feature (1)..( 13): Result.005 file - promoters50/2113269
acgattattcctg

SEQ ID NO: 179882 - DNA, 13 bp, Unknown
  misc_feature (1)..( 13): Result.005 file - promoters50/2113269
acgattataaaca

SEQ ID NO: 179883 - DNA, 13 bp, Unknown
  misc_feature (1)..( 13): Result.005 file - promoters50/2113269
gttattatttaat

SEQ ID NO: 179884 - DNA, 13 bp, Unknown
  misc_feature (1)..( 13): Result.005 file - promoters50/2113269
ctcattttaacat

SEQ ID NO: 179885 - DNA, 13 bp, Unknown
  misc_feature (1)..( 13): Result.005 file - promoters50/2113269
ttttttttaacaa

SEQ ID NO: 179886 - DNA, 13 bp, Unknown
  misc_feature (1)..( 13): Result.005 file - promoters50/2113269
catatttttataa

SEQ ID NO: 179887 - DNA, 13 bp, Unknown
  misc_feature (1)..( 13): Result.005 file - promoters50/2113269
tactttttaaaat

SEQ ID NO: 179888 - DNA, 18 bp, Unknown
  misc_feature (1)..( 18): Result.005 file - promoters50/2113269
atagtcaaatatcaccga

SEQ ID NO: 179889 - DNA, 18 bp, Unknown
  misc_feature (1)..( 18): Result.005 file - promoters50/2113269
ctagtcataagagtaagg

SEQ ID NO: 179890 - DNA, 18 bp, Unknown
  misc_feature (1)..( 18): Result.005 file - promoters50/2113269
atagtaaaaaaatcttgg

SEQ ID NO: 179891 - DNA, 18 bp, Unknown
  misc_feature (1)..( 18): Result.005 file - promoters50/2113269
aatataaaaaaataactt

SEQ ID NO: 179892 - DNA, 18 bp, Unknown
  misc_feature (1)..( 18): Result.005 file - promoters50/2113269
aaaataaaaagttttggg

SEQ ID NO: 179893 - DNA, 18 bp, Unknown
  misc_feature (1)..( 18): Result.005 file - promoters50/2113269
gatgtaaaaaaaaacttt

SEQ ID NO: 179894 - DNA, 11 bp, Unknown
  misc_feature (1)..( 11): Result.005 file - promoters50/2113269
taactttcact

SEQ ID NO: 179895 - DNA, 11 bp, Unknown
  misc_feature (1)..( 11): Result.005 file - promoters50/2113269
aaacttttgag

SEQ ID NO: 179896 - DNA, 11 bp, Unknown
  misc_feature (1)..( 11): Result.005 file - promoters50/2113269
aaacttttact

SEQ ID NO: 179897 - DNA, 11 bp, Unknown
  misc_feature (1)..( 11): Result.005 file - promoters50/2113269
aaacttttttt

SEQ ID NO: 179898 - DNA, 12 bp, Unknown
  misc_feature (1)..( 12): Result.005 file - promoters50/2113269
aaagctttccaa

SEQ ID NO: 179899 - DNA, 12 bp, Unknown
  misc_feature (1)..( 12): Result.005 file - promoters50/2113269
aacatttttttc

SEQ ID NO: 179900 - DNA, 13 bp, Unknown
  misc_feature (1)..( 13): Result.005 file - promoters50/2113269
gacatatttttat

SEQ ID NO: 179901 - DNA, 13 bp, Unknown
  misc_feature (1)..( 13): Result.005 file - promoters50/2113269
agaatataaaaaa

SEQ ID NO: 179902 - DNA, 13 bp, Unknown
  misc_feature (1)..( 13): Result.005 file - promoters50/2113269
cgattataaacac

SEQ ID NO: 179903 - DNA, 13 bp, Unknown
  misc_feature (1)..( 13): Result.005 file - promoters50/2113269
ttaaaataaaaag

SEQ ID NO: 179904 - DNA, 13 bp, Unknown
  misc_feature (1)..( 13): Result.005 file - promoters50/2113269
tcattttaacatc

SEQ ID NO: 179905 - DNA, 13 bp, Unknown
  misc_feature (1)..( 13): Result.005 file - promoters50/2113269
tttttttaacaaa

SEQ ID NO: 179906 - DNA, 13 bp, Unknown
  misc_feature (1)..( 13): Result.005 file - promoters50/2113269
tttttataaatag

SEQ ID NO: 179907 - DNA, 13 bp, Unknown
  misc_feature (1)..( 13): Result.005 file - promoters50/2113269
ttgatgtaaaaaa

SEQ ID NO: 179908 - DNA, 13 bp, Unknown
  misc_feature (1)..( 13): Result.005 file - promoters50/2113269
aaactttttctaa

SEQ ID NO: 179909 - DNA, 13 bp, Unknown
  misc_feature (1)..( 13): Result.005 file - promoters50/2113269
aaacttttttttt

SEQ ID NO: 179910 - DNA, 13 bp, Unknown
  misc_feature (1)..( 13): Result.005 file - promoters50/2113269
ttactttttaaaa

SEQ ID NO: 179911 - DNA, 13 bp, Unknown
  misc_feature (1)..( 13): Result.005 file - promoters50/2113269
catttttttcacc

SEQ ID NO: 179912 - DNA, 13 bp, Unknown
  misc_feature (1)..( 13): Result.005 file - promoters50/2113269
catatttttataa

SEQ ID NO: 179913 - DNA, 13 bp, Unknown
  misc_feature (1)..( 13): Result.005 file - promoters50/2113269
ttactatttgatg

SEQ ID NO: 179914 - DNA, 13 bp, Unknown
  misc_feature (1)..( 13): Result.005 file - promoters50/2113269
aaacttttgagag

SEQ ID NO: 179915 - DNA, 11 bp, Unknown
  misc_feature (1)..( 11): Result.005 file - promoters50/2113269
tttttctaata

SEQ ID NO: 179916 - DNA, 11 bp, Unknown
  misc_feature (1)..( 11): Result.005 file - promoters50/2113269
aatttctagtc

SEQ ID NO: 179917 - DNA, 11 bp, Unknown
  misc_feature (1)..( 11): Result.005 file - promoters50/2113269
actttttaaaa

SEQ ID NO: 179918 - DNA, 11 bp, Unknown
  misc_feature (1)..( 11): Result.005 file - promoters50/2113269
tatttttataa

SEQ ID NO: 179919 - DNA, 11 bp, Unknown
  misc_feature (1)..( 11): Result.005 file - promoters50/2113269
ggcttttaaag

SEQ ID NO: 179920 - DNA, 11 bp, Unknown
  misc_feature (1)..( 11): Result.005 file - promoters50/2113269
tcattttaaca

SEQ ID NO: 179921 - DNA, 11 bp, Unknown
  misc_feature (1)..( 11): Result.005 file - promoters50/2113269
actatttatct

SEQ ID NO: 179922 - DNA, 12 bp, Unknown
  misc_feature (1)..( 12): Result.005 file - promoters50/2113269
atataaaaaaat

SEQ ID NO: 179923 - DNA, 12 bp, Unknown
  misc_feature (1)..( 12): Result.005 file - promoters50/2113269
ttttaacaaatt

SEQ ID NO: 179924 - DNA, 12 bp, Unknown
  misc_feature (1)..( 12): Result.005 file - promoters50/2113269
aaataaaaagtt

SEQ ID NO: 179925 - DNA, 12 bp, Unknown
  misc_feature (1)..( 12): Result.005 file - promoters50/2113269
tagtaaaaaaat

SEQ ID NO: 179926 - DNA, 12 bp, Unknown
  misc_feature (1)..( 12): Result.005 file - promoters50/2113269
ttttaacatctt

SEQ ID NO: 179927 - DNA, 12 bp, Unknown
  misc_feature (1)..( 12): Result.005 file - promoters50/2113269
atgtaaaaaaaa

SEQ ID NO: 179928 - DNA, 9 bp, Unknown
  misc_feature (1)..( 9): Result.005 file - promoters50/2113269
cttttaaag

SEQ ID NO: 179929 - DNA, 9 bp, Unknown
  misc_feature (1)..( 9): Result.005 file - promoters50/2113269
tttttaaca

SEQ ID NO: 179930 - DNA, 9 bp, Unknown
  misc_feature (1)..( 9): Result.005 file - promoters50/2113269
tttttaaaa

SEQ ID NO: 179931 - DNA, 9 bp, Unknown
  misc_feature (1)..( 9): Result.005 file - promoters50/2113269
attttaaca

SEQ ID NO: 179932 - DNA, 9 bp, Unknown
  misc_feature (1)..( 9): Result.005 file - promoters50/2113269
tttttataa

SEQ ID NO: 179933 - DNA, 9 bp, Unknown
  misc_feature (1)..( 9): Result.005 file - promoters50/2113269
actttaact

SEQ ID NO: 179934 - DNA, 9 bp, Unknown
  misc_feature (1)..( 9): Result.005 file - promoters50/2113299
catatttca

SEQ ID NO: 179935 - DNA, 9 bp, Unknown
  misc_feature (1)..( 9): Result.005 file - promoters50/2113299
tttatttcg

SEQ ID NO: 179936 - DNA, 9 bp, Unknown
  misc_feature (1)..( 9): Result.005 file - promoters50/2113299
catattttc

SEQ ID NO: 179937 - DNA, 9 bp, Unknown
  misc_feature (1)..( 9): Result.005 file - promoters50/2113299
catttttat

SEQ ID NO: 179938 - DNA, 9 bp, Unknown
  misc_feature (1)..( 9): Result.005 file - promoters50/2113299
agtatatca

SEQ ID NO: 179939 - DNA, 9 bp, Unknown
  misc_feature (1)..( 9): Result.005 file - promoters50/2113299
tgtatttta

SEQ ID NO: 179940 - DNA, 13 bp, Unknown
  misc_feature (1)..( 13): Result.005 file - promoters50/2113299
atgtgtataaata

SEQ ID NO: 179941 - DNA, 13 bp, Unknown
  misc_feature (1)..( 13): Result.005 file - promoters50/2113299
ctccctataaatt

SEQ ID NO: 179942 - DNA, 13 bp, Unknown
  misc_feature (1)..( 13): Result.005 file - promoters50/2113299
gtttttatatata

SEQ ID NO: 179943 - DNA, 13 bp, Unknown
  misc_feature (1)..( 13): Result.005 file - promoters50/2113299
tccattatatata

SEQ ID NO: 179944 - DNA, 14 bp, Unknown
  misc_feature (1)..( 14): Result.005 file - promoters50/2113299
agtgagatataata

SEQ ID NO: 179945 - DNA, 14 bp, Unknown
  misc_feature (1)..( 14): Result.005 file - promoters50/2113299
tcctttatattctc

SEQ ID NO: 179946 - DNA, 12 bp, Unknown
  misc_feature (1)..( 12): Result.005 file - promoters50/2113299
aacaaaaataaa

SEQ ID NO: 179947 - DNA, 12 bp, Unknown
  misc_feature (1)..( 12): Result.005 file - promoters50/2113299
cccaaaaataag

SEQ ID NO: 179948 - DNA, 12 bp, Unknown
  misc_feature (1)..( 12): Result.005 file - promoters50/2113299
tacaaaactaca

SEQ ID NO: 179949 - DNA, 12 bp, Unknown
  misc_feature (1)..( 12): Result.005 file - promoters50/2113299
cccaaaattgac

SEQ ID NO: 179950 - DNA, 12 bp, Unknown
  misc_feature (1)..( 12): Result.005 file - promoters50/2113299
aataaacatatt

SEQ ID NO: 179951 - DNA, 12 bp, Unknown
  misc_feature (1)..( 12): Result.005 file - promoters50/2113299
gctaaccatatt

SEQ ID NO: 179952 - DNA, 12 bp, Unknown
  misc_feature (1)..( 12): Result.005 file - promoters50/2113299
ggcaaaaccagt

SEQ ID NO: 179953 - DNA, 9 bp, Unknown
  misc_feature (1)..( 9): Result.005 file - promoters50/2113315
taaaatgcg

SEQ ID NO: 179954 - DNA, 9 bp, Unknown
  misc_feature (1)..( 9): Result.005 file - promoters50/2113315
taaaataat

SEQ ID NO: 179955 - DNA, 9 bp, Unknown
  misc_feature (1)..( 9): Result.005 file - promoters50/2113315
gaaaatgat

SEQ ID NO: 179956 - DNA, 9 bp, Unknown
  misc_feature (1)..( 9): Result.005 file - promoters50/2113315
taaagtaat

SEQ ID NO: 179957 - DNA, 9 bp, Unknown
  misc_feature (1)..( 9): Result.005 file - promoters50/2113315
caaattaaa

SEQ ID NO: 179958 - DNA, 9 bp, Unknown
  misc_feature (1)..( 9): Result.005 file - promoters50/2113315
aaaattgac

SEQ ID NO: 179959 - DNA, 9 bp, Unknown
  misc_feature (1)..( 9): Result.005 file - promoters50/2113323
atatttttt

SEQ ID NO: 179960 - DNA, 9 bp, Unknown
  misc_feature (1)..( 9): Result.005 file - promoters50/2113323
caattattt

SEQ ID NO: 179961 - DNA, 9 bp, Unknown
  misc_feature (1)..( 9): Result.005 file - promoters50/2113323
aactttttt

SEQ ID NO: 179962 - DNA, 9 bp, Unknown
  misc_feature (1)..( 9): Result.005 file - promoters50/2113323
caaatattt

SEQ ID NO: 179963 - DNA, 10 bp, Unknown
  misc_feature (1)..( 10): Result.005 file - promoters50/2113323
aattgtttaa

SEQ ID NO: 179964 - DNA, 10 bp, Unknown
  misc_feature (1)..( 10): Result.005 file - promoters50/2113323
gattgttttc

SEQ ID NO: 179965 - DNA, 10 bp, Unknown
  misc_feature (1)..( 10): Result.005 file - promoters50/2113323
tattttttaa

SEQ ID NO: 179966 - DNA, 10 bp, Unknown
  misc_feature (1)..( 10): Result.005 file - promoters50/2113323
gattgtaatg

SEQ ID NO: 179967 - DNA, 9 bp, Unknown
  misc_feature (1)..( 9): Result.005 file - promoters50/2113323
tttatattt

SEQ ID NO: 179968 - DNA, 9 bp, Unknown
  misc_feature (1)..( 9): Result.005 file - promoters50/2113323
caaatattt

SEQ ID NO: 179969 - DNA, 9 bp, Unknown
  misc_feature (1)..( 9): Result.005 file - promoters50/2113323
caattattt

SEQ ID NO: 179970 - DNA, 7 bp, Unknown
  misc_feature (1)..( 7): Result.005 file - promoters50/2113323
ttatata

SEQ ID NO: 179971 - DNA, 7 bp, Unknown
  misc_feature (1)..( 7): Result.005 file - promoters50/2113323
atatata

SEQ ID NO: 179972 - DNA, 7 bp, Unknown
  misc_feature (1)..( 7): Result.005 file - promoters50/2113323
atatatg

SEQ ID NO: 179973 - DNA, 14 bp, Unknown
  misc_feature (1)..( 14): Result.005 file - promoters50/2113323
ctcatatatataca

SEQ ID NO: 179974 - DNA, 14 bp, Unknown
  misc_feature (1)..( 14): Result.005 file - promoters50/2113323
ctcatataaataca

SEQ ID NO: 179975 - DNA, 14 bp, Unknown
  misc_feature (1)..( 14): Result.005 file - promoters50/2113323
cccctataaaacaa

SEQ ID NO: 179976 - DNA, 9 bp, Unknown
  misc_feature (1)..( 9): Result.005 file - promoters50/2113323
gtaaatgta

SEQ ID NO: 179977 - DNA, 9 bp, Unknown
  misc_feature (1)..( 9): Result.005 file - promoters50/2113323
gtaaatact

SEQ ID NO: 179978 - DNA, 9 bp, Unknown
  misc_feature (1)..( 9): Result.005 file - promoters50/2113323
ataaatact

SEQ ID NO: 179979 - DNA, 9 bp, Unknown
  misc_feature (1)..( 9): Result.005 file - promoters50/2113338
caaacactt

SEQ ID NO: 179980 - DNA, 9 bp, Unknown
  misc_feature (1)..( 9): Result.005 file - promoters50/2113338
caaccactg

SEQ ID NO: 179981 - DNA, 9 bp, Unknown
  misc_feature (1)..( 9): Result.005 file - promoters50/2113338
agaacgctt

SEQ ID NO: 179982 - DNA, 7 bp, Unknown
  misc_feature (1)..( 7): Result.005 file - promoters50/2113338
gaatcaa

SEQ ID NO: 179983 - DNA, 7 bp, Unknown
  misc_feature (1)..( 7): Result.005 file - promoters50/2113338
aaatcaa

SEQ ID NO: 179984 - DNA, 7 bp, Unknown
  misc_feature (1)..( 7): Result.005 file - promoters50/2113338
gaaccaa

SEQ ID NO: 179985 - DNA, 12 bp, Unknown
  misc_feature (1)..( 12): Result.005 file - promoters50/2113418
aacttgtctgag

SEQ ID NO: 179986 - DNA, 12 bp, Unknown
  misc_feature (1)..( 12): Result.005 file - promoters50/2113418
aacatgtatgaa

SEQ ID NO: 179987 - DNA, 12 bp, Unknown
  misc_feature (1)..( 12): Result.005 file - promoters50/2113418
aacaggtacaga

SEQ ID NO: 179988 - DNA, 12 bp, Unknown
  misc_feature (1)..( 12): Result.005 file - promoters50/2113418
aaaacgtatgaa

SEQ ID NO: 179989 - DNA, 7 bp, Unknown
  misc_feature (1)..( 7): Result.005 file - promoters50/2113418
ggaaaac

SEQ ID NO: 179990 - DNA, 7 bp, Unknown
  misc_feature (1)..( 7): Result.005 file - promoters50/2113418
ggaaaaa

SEQ ID NO: 179991 - DNA, 7 bp, Unknown
  misc_feature (1)..( 7): Result.005 file - promoters50/2113418
agaaaaa

SEQ ID NO: 179992 - DNA, 13 bp, Unknown
  misc_feature (1)..( 13): Result.005 file - promoters50/2113434
agagcttgacgaa

SEQ ID NO: 179993 - DNA, 13 bp, Unknown
  misc_feature (1)..( 13): Result.005 file - promoters50/2113434
agagattgaggaa

SEQ ID NO: 179994 - DNA, 13 bp, Unknown
  misc_feature (1)..( 13): Result.005 file - promoters50/2113434
tgagcttgagaag

SEQ ID NO: 179995 - DNA, 9 bp, Unknown
  misc_feature (1)..( 9): Result.005 file - promoters50/2113434
gagcttctt

SEQ ID NO: 179996 - DNA, 9 bp, Unknown
  misc_feature (1)..( 9): Result.005 file - promoters50/2113434
gagcttgag

SEQ ID NO: 179997 - DNA, 9 bp, Unknown
  misc_feature (1)..( 9): Result.005 file - promoters50/2113434
gagattgag

SEQ ID NO: 179998 - DNA, 8 bp, Unknown
  misc_feature (1)..( 8): Result.005 file - promoters50/2113434
tctaaaac

SEQ ID NO: 179999 - DNA, 8 bp, Unknown
  misc_feature (1)..( 8): Result.005 file - promoters50/2113434
tctaaaaa

SEQ ID NO: 180000 - DNA, 9 bp, Unknown
  misc_feature (1)..( 9): Result.005 file - promoters50/2113434
ggtaagaaa

SEQ ID NO: 180001 - DNA, 10 bp, Unknown
  misc_feature (1)..( 10): Result.005 file - promoters50/2113445
ttttgaatat

SEQ ID NO: 180002 - DNA, 10 bp, Unknown
  misc_feature (1)..( 10): Result.005 file - promoters50/2113445
tattgaatat

SEQ ID NO: 180003 - DNA, 11 bp, Unknown
  misc_feature (1)..( 11): Result.005 file - promoters50/2113445
ctttagaactt

SEQ ID NO: 180004 - DNA, 11 bp, Unknown
  misc_feature (1)..( 11): Result.005 file - promoters50/2113445
gagttggatag

SEQ ID NO: 180005 - DNA, 8 bp, Unknown
  misc_feature (1)..( 8): Result.005 file - promoters50/2113445
aagattta

SEQ ID NO: 180006 - DNA, 8 bp, Unknown
  misc_feature (1)..( 8): Result.005 file - promoters50/2113445
aagattta

SEQ ID NO: 180007 - DNA, 8 bp, Unknown
  misc_feature (1)..( 8): Result.005 file - promoters50/2113445
aagtttta

SEQ ID NO: 180008 - DNA, 7 bp, Unknown
  misc_feature (1)..( 7): Result.005 file - promoters50/2113445
aactttg

SEQ ID NO: 180009 - DNA, 7 bp, Unknown
  misc_feature (1)..( 7): Result.005 file - promoters50/2113445
tactttg

SEQ ID NO: 180010 - DNA, 7 bp, Unknown
  misc_feature (1)..( 7): Result.005 file - promoters50/2113445
tactttt

SEQ ID NO: 180011 - DNA, 8 bp, Unknown
  misc_feature (1)..( 8): Result.005 file - promoters50/2113445
aacataaa

SEQ ID NO: 180012 - DNA, 8 bp, Unknown
  misc_feature (1)..( 8): Result.005 file - promoters50/2113445
aacttaat

SEQ ID NO: 180013 - DNA, 8 bp, Unknown
  misc_feature (1)..( 8): Result.005 file - promoters50/2113445
atcataaa

SEQ ID NO: 180014 - DNA, 10 bp, Unknown
  misc_feature (1)..( 10): Result.005 file - promoters50/2113445
ttattaatat

SEQ ID NO: 180015 - DNA, 10 bp, Unknown
  misc_feature (1)..( 10): Result.005 file - promoters50/2113445
ttattattat

SEQ ID NO: 180016 - DNA, 10 bp, Unknown
  misc_feature (1)..( 10): Result.005 file - promoters50/2113445
gtattatcaa

SEQ ID NO: 180017 - DNA, 13 bp, Unknown
  misc_feature (1)..( 13): Result.005 file - promoters50/2113462
aaaattaagatat

SEQ ID NO: 180018 - DNA, 13 bp, Unknown
  misc_feature (1)..( 13): Result.005 file - promoters50/2113462
caaactaaaatat

SEQ ID NO: 180019 - DNA, 13 bp, Unknown
  misc_feature (1)..( 13): Result.005 file - promoters50/2113462
taaattacaatta

SEQ ID NO: 180020 - DNA, 13 bp, Unknown
  misc_feature (1)..( 13): Result.005 file - promoters50/2113462
ggatgtaatcagc

SEQ ID NO: 180021 - DNA, 13 bp, Unknown
  misc_feature (1)..( 13): Result.005 file - promoters50/2113462
aaaagttagttta

SEQ ID NO: 180022 - DNA, 13 bp, Unknown
  misc_feature (1)..( 13): Result.005 file - promoters50/2113462
aaaaataatattt

SEQ ID NO: 180023 - DNA, 13 bp, Unknown
  misc_feature (1)..( 13): Result.005 file - promoters50/2113462
taaaatcagatcc

SEQ ID NO: 180024 - DNA, 12 bp, Unknown
  misc_feature (1)..( 12): Result.005 file - promoters50/2113462
tcacttaattcc

SEQ ID NO: 180025 - DNA, 12 bp, Unknown
  misc_feature (1)..( 12): Result.005 file - promoters50/2113462
aaacttaatata

SEQ ID NO: 180026 - DNA, 12 bp, Unknown
  misc_feature (1)..( 12): Result.005 file - promoters50/2113462
tatcttcatata

SEQ ID NO: 180027 - DNA, 12 bp, Unknown
  misc_feature (1)..( 12): Result.005 file - promoters50/2113462
aaatttattcac

SEQ ID NO: 180028 - DNA, 12 bp, Unknown
  misc_feature (1)..( 12): Result.005 file - promoters50/2113462
acatttagttta

SEQ ID NO: 180029 - DNA, 12 bp, Unknown
  misc_feature (1)..( 12): Result.005 file - promoters50/2113462
ggatttattaag

SEQ ID NO: 180030 - DNA, 13 bp, Unknown
  misc_feature (1)..( 13): Result.005 file - promoters50/2113462
tataaaaagagat

SEQ ID NO: 180031 - DNA, 13 bp, Unknown
  misc_feature (1)..( 13): Result.005 file - promoters50/2113462
tttaaaaaataat

SEQ ID NO: 180032 - DNA, 13 bp, Unknown
  misc_feature (1)..( 13): Result.005 file - promoters50/2113462
tataaaatcagat

SEQ ID NO: 180033 - DNA, 13 bp, Unknown
  misc_feature (1)..( 13): Result.005 file - promoters50/2113462
tttcaaactaaaa

SEQ ID NO: 180034 - DNA, 14 bp, Unknown
  misc_feature (1)..( 14): Result.005 file - promoters50/2113462
tttagaaaagtctc

SEQ ID NO: 180035 - DNA, 14 bp, Unknown
  misc_feature (1)..( 14): Result.005 file - promoters50/2113462
gagaaaaaacagaa

SEQ ID NO: 180036 - DNA, 14 bp, Unknown
  misc_feature (1)..( 14): Result.005 file - promoters50/2113462
tttaaaatcacatc

SEQ ID NO: 180037 - DNA, 13 bp, Unknown
  misc_feature (1)..( 13): Result.005 file - promoters50/2113462
aatcaactttttt

SEQ ID NO: 180038 - DNA, 13 bp, Unknown
  misc_feature (1)..( 13): Result.005 file - promoters50/2113462
ttatatcttttta

SEQ ID NO: 180039 - DNA, 14 bp, Unknown
  misc_feature (1)..( 14): Result.005 file - promoters50/2113462
aggtggcttatttc

SEQ ID NO: 180040 - DNA, 14 bp, Unknown
  misc_feature (1)..( 14): Result.005 file - promoters50/2113462
acttcacttttaaa

SEQ ID NO: 180041 - DNA, 14 bp, Unknown
  misc_feature (1)..( 14): Result.005 file - promoters50/2113462
aactaaattagttc

SEQ ID NO: 180042 - DNA, 14 bp, Unknown
  misc_feature (1)..( 14): Result.005 file - promoters50/2113462
aaccaaattagtga

SEQ ID NO: 180043 - DNA, 11 bp, Unknown
  misc_feature (1)..( 11): Result.005 file - promoters50/2113462
aacaaaattaa

SEQ ID NO: 180044 - DNA, 11 bp, Unknown
  misc_feature (1)..( 11): Result.005 file - promoters50/2113462
cttaaatttaa

SEQ ID NO: 180045 - DNA, 11 bp, Unknown
  misc_feature (1)..( 11): Result.005 file - promoters50/2113462
ggataaattac

SEQ ID NO: 180046 - DNA, 11 bp, Unknown
  misc_feature (1)..( 11): Result.005 file - promoters50/2113462
gctgaaattat

SEQ ID NO: 180047 - DNA, 11 bp, Unknown
  misc_feature (1)..( 11): Result.005 file - promoters50/2113462
tacaagatttt

SEQ ID NO: 180048 - DNA, 11 bp, Unknown
  misc_feature (1)..( 11): Result.005 file - promoters50/2113462
aacagaattat

SEQ ID NO: 180049 - DNA, 13 bp, Unknown
  misc_feature (1)..( 13): Result.005 file - promoters50/2113462
atccatatatgaa

SEQ ID NO: 180050 - DNA, 13 bp, Unknown
  misc_feature (1)..( 13): Result.005 file - promoters50/2113462
tctcatatacaaa

SEQ ID NO: 180051 - DNA, 13 bp, Unknown
  misc_feature (1)..( 13): Result.005 file - promoters50/2113462
atccttataaaac

SEQ ID NO: 180052 - DNA, 13 bp, Unknown
  misc_feature (1)..( 13): Result.005 file - promoters50/2113462
cttcacataggag

SEQ ID NO: 180053 - DNA, 13 bp, Unknown
  misc_feature (1)..( 13): Result.005 file - promoters50/2113462
aatttgataaaca

SEQ ID NO: 180054 - DNA, 13 bp, Unknown
  misc_feature (1)..( 13): Result.005 file - promoters50/2113462
agaggcctaaaca

SEQ ID NO: 180055 - DNA, 9 bp, Unknown
  misc_feature (1)..( 9): Result.005 file - promoters50/2113466
ataatatat

SEQ ID NO: 180056 - DNA, 9 bp, Unknown
  misc_feature (1)..( 9): Result.005 file - promoters50/2113466
agaatctat

SEQ ID NO: 180057 - DNA, 9 bp, Unknown
  misc_feature (1)..( 9): Result.005 file - promoters50/2113466
ataaaatat

SEQ ID NO: 180058 - DNA, 9 bp, Unknown
  misc_feature (1)..( 9): Result.005 file - promoters50/2113466
ctaaaataa

SEQ ID NO: 180059 - DNA, 9 bp, Unknown
  misc_feature (1)..( 9): Result.005 file - promoters50/2113466
atattataa

SEQ ID NO: 180060 - DNA, 10 bp, Unknown
  misc_feature (1)..( 10): Result.005 file - promoters50/2113466
tatttatgtt

SEQ ID NO: 180061 - DNA, 10 bp, Unknown
  misc_feature (1)..( 10): Result.005 file - promoters50/2113466
tgtttatgtt

SEQ ID NO: 180062 - DNA, 10 bp, Unknown
  misc_feature (1)..( 10): Result.005 file - promoters50/2113466
gattcatgat

SEQ ID NO: 180063 - DNA, 10 bp, Unknown
  misc_feature (1)..( 10): Result.005 file - promoters50/2113466
gattcaaaaa

SEQ ID NO: 180064 - DNA, 13 bp, Unknown
  misc_feature (1)..( 13): Result.005 file - promoters50/2113466
ccttttaactaca

SEQ ID NO: 180065 - DNA, 13 bp, Unknown
  misc_feature (1)..( 13): Result.005 file - promoters50/2113466
gcttgtaaccaca

SEQ ID NO: 180066 - DNA, 13 bp, Unknown
  misc_feature (1)..( 13): Result.005 file - promoters50/2113466
cctgttattggtc

SEQ ID NO: 180067 - DNA, 13 bp, Unknown
  misc_feature (1)..( 13): Result.005 file - promoters50/2113466
atttgtaataaca

SEQ ID NO: 180068 - DNA, 11 bp, Unknown
  misc_feature (1)..( 11): Result.005 file - promoters50/2113466
ctataacaata

SEQ ID NO: 180069 - DNA, 11 bp, Unknown
  misc_feature (1)..( 11): Result.005 file - promoters50/2113466
taataaccata

SEQ ID NO: 180070 - DNA, 11 bp, Unknown
  misc_feature (1)..( 11): Result.005 file - promoters50/2113466
aaataactcac

SEQ ID NO: 180071 - DNA, 11 bp, Unknown
  misc_feature (1)..( 11): Result.005 file - promoters50/2113466
aaataagtatt

SEQ ID NO: 180072 - DNA, 8 bp, Unknown
  misc_feature (1)..( 8): Result.005 file - promoters50/2113470
tattttaa

SEQ ID NO: 180073 - DNA, 8 bp, Unknown
  misc_feature (1)..( 8): Result.005 file - promoters50/2113470
tatattac

SEQ ID NO: 180074 - DNA, 8 bp, Unknown
  misc_feature (1)..( 8): Result.005 file - promoters50/2113470
acttttaa

SEQ ID NO: 180075 - DNA, 11 bp, Unknown
  misc_feature (1)..( 11): Result.005 file - promoters50/2113470
ttatatagtaa

SEQ ID NO: 180076 - DNA, 11 bp, Unknown
  misc_feature (1)..( 11): Result.005 file - promoters50/2113470
ttagatatttt

SEQ ID NO: 180077 - DNA, 11 bp, Unknown
  misc_feature (1)..( 11): Result.005 file - promoters50/2113470
ttatatatata

SEQ ID NO: 180078 - DNA, 7 bp, Unknown
  misc_feature (1)..( 7): Result.005 file - promoters50/2113470
tttatct

SEQ ID NO: 180079 - DNA, 7 bp, Unknown
  misc_feature (1)..( 7): Result.005 file - promoters50/2113470
attatct

SEQ ID NO: 180080 - DNA, 7 bp, Unknown
  misc_feature (1)..( 7): Result.005 file - promoters50/2113470
tttatca

SEQ ID NO: 180081 - DNA, 11 bp, Unknown
  misc_feature (1)..( 11): Result.005 file - promoters50/2113470
cccaaaagaat

SEQ ID NO: 180082 - DNA, 11 bp, Unknown
  misc_feature (1)..( 11): Result.005 file - promoters50/2113470
atcaaaagaat

SEQ ID NO: 180083 - DNA, 11 bp, Unknown
  misc_feature (1)..( 11): Result.005 file - promoters50/2113470
atccaaagccc

SEQ ID NO: 180084 - DNA, 9 bp, Unknown
  misc_feature (1)..( 9): Result.005 file - promoters50/2113470
tcacgaaac

SEQ ID NO: 180085 - DNA, 9 bp, Unknown
  misc_feature (1)..( 9): Result.005 file - promoters50/2113470
gcactaaac

SEQ ID NO: 180086 - DNA, 9 bp, Unknown
  misc_feature (1)..( 9): Result.005 file - promoters50/2113470
tcactaaat

SEQ ID NO: 180087 - DNA, 8 bp, Unknown
  misc_feature (1)..( 8): Result.005 file - promoters50/2113470
aaagttac

SEQ ID NO: 180088 - DNA, 8 bp, Unknown
  misc_feature (1)..( 8): Result.005 file - promoters50/2113470
aaaattat

SEQ ID NO: 180089 - DNA, 8 bp, Unknown
  misc_feature (1)..( 8): Result.005 file - promoters50/2113470
ctaattat

SEQ ID NO: 180090 - DNA, 10 bp, Unknown
  misc_feature (1)..( 10): Result.005 file - promoters50/2113477
aaagttaaaa

SEQ ID NO: 180091 - DNA, 10 bp, Unknown
  misc_feature (1)..( 10): Result.005 file - promoters50/2113477
caagtcaaat

SEQ ID NO: 180092 - DNA, 10 bp, Unknown
  misc_feature (1)..( 10): Result.005 file - promoters50/2113477
aaagttgccg

SEQ ID NO: 180093 - DNA, 10 bp, Unknown
  misc_feature (1)..( 10): Result.005 file - promoters50/2113477
aattttaaaa

SEQ ID NO: 180094 - DNA, 8 bp, Unknown
  misc_feature (1)..( 8): Result.005 file - promoters50/2113477
tattaaaa

SEQ ID NO: 180095 - DNA, 8 bp, Unknown
  misc_feature (1)..( 8): Result.005 file - promoters50/2113477
tatttaaa

SEQ ID NO: 180096 - DNA, 8 bp, Unknown
  misc_feature (1)..( 8): Result.005 file - promoters50/2113477
gtttaaaa

SEQ ID NO: 180097 - DNA, 8 bp, Unknown
  misc_feature (1)..( 8): Result.005 file - promoters50/2113477
tatttatt

SEQ ID NO: 180098 - DNA, 8 bp, Unknown
  misc_feature (1)..( 8): Result.005 file - promoters50/2113477
tatatatg

SEQ ID NO: 180099 - DNA, 8 bp, Unknown
  misc_feature (1)..( 8): Result.005 file - promoters50/2113477
aataataa

SEQ ID NO: 180100 - DNA, 8 bp, Unknown
  misc_feature (1)..( 8): Result.005 file - promoters50/2113477
aataatga

SEQ ID NO: 180101 - DNA, 8 bp, Unknown
  misc_feature (1)..( 8): Result.005 file - promoters50/2113477
tataatgg

SEQ ID NO: 180102 - DNA, 8 bp, Unknown
  misc_feature (1)..( 8): Result.005 file - promoters50/2113477
tatagaat

SEQ ID NO: 180103 - DNA, 11 bp, Unknown
  misc_feature (1)..( 11): Result.005 file - promoters50/2113477
ataatataatg

SEQ ID NO: 180104 - DNA, 11 bp, Unknown
  misc_feature (1)..( 11): Result.005 file - promoters50/2113477
ataatgtaata

SEQ ID NO: 180105 - DNA, 11 bp, Unknown
  misc_feature (1)..( 11): Result.005 file - promoters50/2113477
tagatataatg

SEQ ID NO: 180106 - DNA, 11 bp, Unknown
  misc_feature (1)..( 11): Result.005 file - promoters50/2113477
atagtatagaa

SEQ ID NO: 180107 - DNA, 7 bp, Unknown
  misc_feature (1)..( 7): Result.005 file - promoters50/2113477
gataaac

SEQ ID NO: 180108 - DNA, 7 bp, Unknown
  misc_feature (1)..( 7): Result.005 file - promoters50/2113477
tataaac

SEQ ID NO: 180109 - DNA, 7 bp, Unknown
  misc_feature (1)..( 7): Result.005 file - promoters50/2113477
gataaat

SEQ ID NO: 180110 - DNA, 7 bp, Unknown
  misc_feature (1)..( 7): Result.005 file - promoters50/2113477
aataaat

SEQ ID NO: 180111 - DNA, 19 bp, Unknown
  misc_feature (1)..( 19): Result.005 file - promoters50/2113481
tacaaaagattcattgttg

SEQ ID NO: 180112 - DNA, 19 bp, Unknown
  misc_feature (1)..( 19): Result.005 file - promoters50/2113481
cccaaatgatacatttggt

SEQ ID NO: 180113 - DNA, 19 bp, Unknown
  misc_feature (1)..( 19): Result.005 file - promoters50/2113481
tacaaaactacatattctg

SEQ ID NO: 180114 - DNA, 19 bp, Unknown
  misc_feature (1)..( 19): Result.005 file - promoters50/2113481
ttaaaaagaagaaactacg

SEQ ID NO: 180115 - DNA, 19 bp, Unknown
  misc_feature (1)..( 19): Result.005 file - promoters50/2113481
gccgtattacacatttttt

SEQ ID NO: 180116 - DNA, 19 bp, Unknown
  misc_feature (1)..( 19): Result.005 file - promoters50/2113481
tagtaaacataaatttgtt

SEQ ID NO: 180117 - DNA, 19 bp, Unknown
  misc_feature (1)..( 19): Result.005 file - promoters50/2113481
actagtaactaaattagta

SEQ ID NO: 180118 - DNA, 19 bp, Unknown
  misc_feature (1)..( 19): Result.005 file - promoters50/2113481
accaagggtttgattggtt

SEQ ID NO: 180119 - DNA, 12 bp, Unknown
  misc_feature (1)..( 12): Result.005 file - promoters50/2113481
ttatataaagct

SEQ ID NO: 180120 - DNA, 12 bp, Unknown
  misc_feature (1)..( 12): Result.005 file - promoters50/2113481
ttaaataacaac

SEQ ID NO: 180121 - DNA, 12 bp, Unknown
  misc_feature (1)..( 12): Result.005 file - promoters50/2113481
tttaataacttt

SEQ ID NO: 180122 - DNA, 12 bp, Unknown
  misc_feature (1)..( 12): Result.005 file - promoters50/2113481
gccaatcacaca

SEQ ID NO: 180123 - DNA, 12 bp, Unknown
  misc_feature (1)..( 12): Result.005 file - promoters50/2113481
atggataacttg

SEQ ID NO: 180124 - DNA, 12 bp, Unknown
  misc_feature (1)..( 12): Result.005 file - promoters50/2113481
ctagagaacttg

SEQ ID NO: 180125 - DNA, 12 bp, Unknown
  misc_feature (1)..( 12): Result.005 file - promoters50/2113481
tgtaataaacga

SEQ ID NO: 180126 - DNA, 13 bp, Unknown
  misc_feature (1)..( 13): Result.005 file - promoters50/2113481
ttaatttcatttg

SEQ ID NO: 180127 - DNA, 13 bp, Unknown
  misc_feature (1)..( 13): Result.005 file - promoters50/2113481
tttatttcaactc

SEQ ID NO: 180128 - DNA, 13 bp, Unknown
  misc_feature (1)..( 13): Result.005 file - promoters50/2113481
ctaatttaatttg

SEQ ID NO: 180129 - DNA, 13 bp, Unknown
  misc_feature (1)..( 13): Result.005 file - promoters50/2113481
aaaatttctatca

SEQ ID NO: 180130 - DNA, 13 bp, Unknown
  misc_feature (1)..( 13): Result.005 file - promoters50/2113481
tacatttcatatg

SEQ ID NO: 180131 - DNA, 13 bp, Unknown
  misc_feature (1)..( 13): Result.005 file - promoters50/2113481
tacacttcctttt

SEQ ID NO: 180132 - DNA, 14 bp, Unknown
  misc_feature (1)..( 14): Result.005 file - promoters50/2113481
tataaatacataga

SEQ ID NO: 180133 - DNA, 14 bp, Unknown
  misc_feature (1)..( 14): Result.005 file - promoters50/2113481
tataaatagatgac

SEQ ID NO: 180134 - DNA, 14 bp, Unknown
  misc_feature (1)..( 14): Result.005 file - promoters50/2113481
tataaatatgagac

SEQ ID NO: 180135 - DNA, 14 bp, Unknown
  misc_feature (1)..( 14): Result.005 file - promoters50/2113481
tacaaatatataga

SEQ ID NO: 180136 - DNA, 14 bp, Unknown
  misc_feature (1)..( 14): Result.005 file - promoters50/2113481
tatatatagaaaca

SEQ ID NO: 180137 - DNA, 14 bp, Unknown
  misc_feature (1)..( 14): Result.005 file - promoters50/2113481
tataaacttcagat

SEQ ID NO: 180138 - DNA, 12 bp, Unknown
  misc_feature (1)..( 12): Result.005 file - promoters50/2113481
cgttgtttatac

SEQ ID NO: 180139 - DNA, 12 bp, Unknown
  misc_feature (1)..( 12): Result.005 file - promoters50/2113481
attagttaatat

SEQ ID NO: 180140 - DNA, 12 bp, Unknown
  misc_feature (1)..( 12): Result.005 file - promoters50/2113481
tttattttctac

SEQ ID NO: 180141 - DNA, 13 bp, Unknown
  misc_feature (1)..( 13): Result.005 file - promoters50/2113481
aattagtagataa

SEQ ID NO: 180142 - DNA, 13 bp, Unknown
  misc_feature (1)..( 13): Result.005 file - promoters50/2113481
atttgttaatttt

SEQ ID NO: 180143 - DNA, 13 bp, Unknown
  misc_feature (1)..( 13): Result.005 file - promoters50/2113481
aagaggtaaataa

SEQ ID NO: 180144 - DNA, 12 bp, Unknown
  misc_feature (1)..( 12): Result.005 file - promoters50/2113481
ggaagtataagt

SEQ ID NO: 180145 - DNA, 12 bp, Unknown
  misc_feature (1)..( 12): Result.005 file - promoters50/2113481
ataagtttaacg

SEQ ID NO: 180146 - DNA, 12 bp, Unknown
  misc_feature (1)..( 12): Result.005 file - promoters50/2113481
attggtttaaaa

SEQ ID NO: 180147 - DNA, 12 bp, Unknown
  misc_feature (1)..( 12): Result.005 file - promoters50/2113481
ttgagtttaggc

SEQ ID NO: 180148 - DNA, 12 bp, Unknown
  misc_feature (1)..( 12): Result.005 file - promoters50/2113481
ataaatttgtta

SEQ ID NO: 180149 - DNA, 12 bp, Unknown
  misc_feature (1)..( 12): Result.005 file - promoters50/2113481
ctttatttaaaa

SEQ ID NO: 180150 - DNA, 9 bp, Unknown
  misc_feature (1)..( 9): Result.005 file - promoters50/2113489
tacaaattt

SEQ ID NO: 180151 - DNA, 9 bp, Unknown
  misc_feature (1)..( 9): Result.005 file - promoters50/2113489
tacaatttt

SEQ ID NO: 180152 - DNA, 9 bp, Unknown
  misc_feature (1)..( 9): Result.005 file - promoters50/2113489
tataattta

SEQ ID NO: 180153 - DNA, 11 bp, Unknown
  misc_feature (1)..( 11): Result.005 file - promoters50/2113489
tttaattttac

SEQ ID NO: 180154 - DNA, 11 bp, Unknown
  misc_feature (1)..( 11): Result.005 file - promoters50/2113489
gttttttttac

SEQ ID NO: 180155 - DNA, 11 bp, Unknown
  misc_feature (1)..( 11): Result.005 file - promoters50/2113489
tttcattttaa

SEQ ID NO: 180156 - DNA, 9 bp, Unknown
  misc_feature (1)..( 9): Result.005 file - promoters50/2113489
gtgcacaaa

SEQ ID NO: 180157 - DNA, 9 bp, Unknown
  misc_feature (1)..( 9): Result.005 file - promoters50/2113489
tggcagaaa

SEQ ID NO: 180158 - DNA, 9 bp, Unknown
  misc_feature (1)..( 9): Result.005 file - promoters50/2113489
tggcagatc

SEQ ID NO: 180159 - DNA, 8 bp, Unknown
  misc_feature (1)..( 8): Result.005 file - promoters50/2113489
tattactc

SEQ ID NO: 180160 - DNA, 8 bp, Unknown
  misc_feature (1)..( 8): Result.005 file - promoters50/2113489
aattacta

SEQ ID NO: 180161 - DNA, 8 bp, Unknown
  misc_feature (1)..( 8): Result.005 file - promoters50/2113489
aattacta

SEQ ID NO: 180162 - DNA, 12 bp, Unknown
  misc_feature (1)..( 12): Result.005 file - promoters50/2113502
tctcaaaacatt

SEQ ID NO: 180163 - DNA, 12 bp, Unknown
  misc_feature (1)..( 12): Result.005 file - promoters50/2113502
gatgtaaaaatt

SEQ ID NO: 180164 - DNA, 12 bp, Unknown
  misc_feature (1)..( 12): Result.005 file - promoters50/2113502
aaaaccaacatt

SEQ ID NO: 180165 - DNA, 12 bp, Unknown
  misc_feature (1)..( 12): Result.005 file - promoters50/2113502
atttcaaaaata

SEQ ID NO: 180166 - DNA, 12 bp, Unknown
  misc_feature (1)..( 12): Result.005 file - promoters50/2113502
acgttaaaaata

SEQ ID NO: 180167 - DNA, 12 bp, Unknown
  misc_feature (1)..( 12): Result.005 file - promoters50/2113502
acaataaaagtt

SEQ ID NO: 180168 - DNA, 14 bp, Unknown
  misc_feature (1)..( 14): Result.005 file - promoters50/2113502
ccaacgaaacgatt

SEQ ID NO: 180169 - DNA, 14 bp, Unknown
  misc_feature (1)..( 14): Result.005 file - promoters50/2113502
ttaacaaaacaatt

SEQ ID NO: 180170 - DNA, 14 bp, Unknown
  misc_feature (1)..( 14): Result.005 file - promoters50/2113502
gcaaccaaaagaat

SEQ ID NO: 180171 - DNA, 14 bp, Unknown
  misc_feature (1)..( 14): Result.005 file - promoters50/2113502
acaaagaaacaaac

SEQ ID NO: 180172 - DNA, 14 bp, Unknown
  misc_feature (1)..( 14): Result.005 file - promoters50/2113502
agaacgaaatatct

SEQ ID NO: 180173 - DNA, 14 bp, Unknown
  misc_feature (1)..( 14): Result.005 file - promoters50/2113502
ttatcaaattgact

SEQ ID NO: 180174 - DNA, 14 bp, Unknown
  misc_feature (1)..( 14): Result.005 file - promoters50/2113502
gcaattctgacgcc

SEQ ID NO: 180175 - DNA, 11 bp, Unknown
  misc_feature (1)..( 11): Result.005 file - promoters50/2113502
tatataaatcc

SEQ ID NO: 180176 - DNA, 11 bp, Unknown
  misc_feature (1)..( 11): Result.005 file - promoters50/2113502
tttatgaatcc

SEQ ID NO: 180177 - DNA, 11 bp, Unknown
  misc_feature (1)..( 11): Result.005 file - promoters50/2113502
actataaatac

SEQ ID NO: 180178 - DNA, 11 bp, Unknown
  misc_feature (1)..( 11): Result.005 file - promoters50/2113502
actataaacaa

SEQ ID NO: 180179 - DNA, 11 bp, Unknown
  misc_feature (1)..( 11): Result.005 file - promoters50/2113502
actataaaact

SEQ ID NO: 180180 - DNA, 12 bp, Unknown
  misc_feature (1)..( 12): Result.005 file - promoters50/2113502
actattaaagcc

SEQ ID NO: 180181 - DNA, 11 bp, Unknown
  misc_feature (1)..( 11): Result.005 file - promoters50/2113592
tttttagatca

SEQ ID NO: 180182 - DNA, 11 bp, Unknown
  misc_feature (1)..( 11): Result.005 file - promoters50/2113592
cagttagatct

SEQ ID NO: 180183 - DNA, 11 bp, Unknown
  misc_feature (1)..( 11): Result.005 file - promoters50/2113592
tttatagattg

SEQ ID NO: 180184 - DNA, 11 bp, Unknown
  misc_feature (1)..( 11): Result.005 file - promoters50/2113592
ccaataaatta

SEQ ID NO: 180185 - DNA, 11 bp, Unknown
  misc_feature (1)..( 11): Result.005 file - promoters50/2113592
tatataattta

SEQ ID NO: 180186 - DNA, 11 bp, Unknown
  misc_feature (1)..( 11): Result.005 file - promoters50/2113592
gaaaaatcatt

SEQ ID NO: 180187 - DNA, 11 bp, Unknown
  misc_feature (1)..( 11): Result.005 file - promoters50/2113592
tataaataatt

SEQ ID NO: 180188 - DNA, 11 bp, Unknown
  misc_feature (1)..( 11): Result.005 file - promoters50/2113592
attaaataacc

SEQ ID NO: 180189 - DNA, 11 bp, Unknown
  misc_feature (1)..( 11): Result.005 file - promoters50/2113592
tctaaataaag

SEQ ID NO: 180190 - DNA, 11 bp, Unknown
  misc_feature (1)..( 11): Result.005 file - promoters50/2113592
tatacatatta

SEQ ID NO: 180191 - DNA, 11 bp, Unknown
  misc_feature (1)..( 11): Result.005 file - promoters50/2113592
attaaaaaaaa

SEQ ID NO: 180192 - DNA, 10 bp, Unknown
  misc_feature (1)..( 10): Result.005 file - promoters50/2113592
attaaataac

SEQ ID NO: 180193 - DNA, 10 bp, Unknown
  misc_feature (1)..( 10): Result.005 file - promoters50/2113592
aaaaaaaaac

SEQ ID NO: 180194 - DNA, 10 bp, Unknown
  misc_feature (1)..( 10): Result.005 file - promoters50/2113592
tataaataat

SEQ ID NO: 180195 - DNA, 10 bp, Unknown
  misc_feature (1)..( 10): Result.005 file - promoters50/2113592
tctaaataaa

SEQ ID NO: 180196 - DNA, 10 bp, Unknown
  misc_feature (1)..( 10): Result.005 file - promoters50/2113592
tatacatatt

SEQ ID NO: 180197 - DNA, 19 bp, Unknown
  misc_feature (1)..( 19): Result.005 file - promoters50/2113596
caactactctatcaattat

SEQ ID NO: 180198 - DNA, 19 bp, Unknown
  misc_feature (1)..( 19): Result.005 file - promoters50/2113596
caattactctatcaattat

SEQ ID NO: 180199 - DNA, 19 bp, Unknown
  misc_feature (1)..( 19): Result.005 file - promoters50/2113596
gtactactatacaagtaac

SEQ ID NO: 180200 - DNA, 38 bp, Unknown; identical to SEQ ID NO: 126430
  misc_feature (1)..( 38): Result.005 file - promoters50/2113596

SEQ ID NO: 180201 - DNA, 38 bp, Unknown; identical to SEQ ID NO: 126431
  misc_feature (1)..( 38): Result.005 file - promoters50/2113596

SEQ ID NO: 180202 - DNA, 38 bp, Unknown
  misc_feature (1)..( 38): Result.005 file - promoters50/2113596
tagtgactataaaaatagttaatgagtgctaaaaaaag

SEQ ID NO: 180203 - DNA, 7 bp, Unknown
  misc_feature (1)..( 7): Result.005 file - promoters50/2113596
ccaaaat

SEQ ID NO: 180204 - DNA, 7 bp, Unknown
  misc_feature (1)..( 7): Result.005 file - promoters50/2113596
tcaaaat

SEQ ID NO: 180205 - DNA, 7 bp, Unknown
  misc_feature (1)..( 7): Result.005 file - promoters50/2113596
tcaaaat

SEQ ID NO: 180206 - DNA, 8 bp, Unknown
  misc_feature (1)..( 8): Result.005 file - promoters50/2113596
aacaacga

SEQ ID NO: 180207 - DNA, 8 bp, Unknown
  misc_feature (1)..( 8): Result.005 file - promoters50/2113596
aacaacaa

SEQ ID NO: 180208 - DNA, 8 bp, Unknown
  misc_feature (1)..( 8): Result.005 file - promoters50/2113596
aacaacaa

SEQ ID NO: 180209 - DNA, 8 bp, Unknown
  misc_feature (1)..( 8): Result.005 file - promoters50/2113620
gaaggaag

SEQ ID NO: 180210 - DNA, 8 bp, Unknown
  misc_feature (1)..( 8): Result.005 file - promoters50/2113620
aaagaaag

SEQ ID NO: 180211 - DNA, 8 bp, Unknown
  misc_feature (1)..( 8): Result.005 file - promoters50/2113620
gaatgaat

SEQ ID NO: 180212 - DNA, 10 bp, Unknown
  misc_feature (1)..( 10): Result.005 file - promoters50/2113624
ttcatttttt

SEQ ID NO: 180213 - DNA, 10 bp, Unknown
  misc_feature (1)..( 10): Result.005 file - promoters50/2113624
atcaatttac

SEQ ID NO: 180214 - DNA, 10 bp, Unknown
  misc_feature (1)..( 10): Result.005 file - promoters50/2113624
ttaatttttt

SEQ ID NO: 180215 - DNA, 10 bp, Unknown
  misc_feature (1)..( 10): Result.005 file - promoters50/2113624
ttcattctct

SEQ ID NO: 180216 - DNA, 10 bp, Unknown
  misc_feature (1)..( 10): Result.005 file - promoters50/2113624
ttgatttttc

SEQ ID NO: 180217 - DNA, 10 bp, Unknown
  misc_feature (1)..( 10): Result.005 file - promoters50/2113624
tctattcttc

SEQ ID NO: 180218 - DNA, 11 bp, Unknown
  misc_feature (1)..( 11): Result.005 file - promoters50/2113640
taaaattaaga

SEQ ID NO: 180219 - DNA, 11 bp, Unknown
  misc_feature (1)..( 11): Result.005 file - promoters50/2113640
gataatgaagg

SEQ ID NO: 180220 - DNA, 11 bp, Unknown
  misc_feature (1)..( 11): Result.005 file - promoters50/2113640
aaaaaataatt

SEQ ID NO: 180221 - DNA, 11 bp, Unknown
  misc_feature (1)..( 11): Result.005 file - promoters50/2113640
gtaaaatatta

SEQ ID NO: 180222 - DNA, 11 bp, Unknown
  misc_feature (1)..( 11): Result.005 file - promoters50/2113640
tcaaaatataa

SEQ ID NO: 180223 - DNA, 11 bp, Unknown
  misc_feature (1)..( 11): Result.005 file - promoters50/2113640
ttttaatatat

SEQ ID NO: 180224 - DNA, 11 bp, Unknown
  misc_feature (1)..( 11): Result.005 file - promoters50/2113640
tttcaataact

SEQ ID NO: 180225 - DNA, 10 bp, Unknown
  misc_feature (1)..( 10): Result.005 file - promoters50/2113640
gaataaacaa

SEQ ID NO: 180226 - DNA, 10 bp, Unknown
  misc_feature (1)..( 10): Result.005 file - promoters50/2113640
ctatatacac

SEQ ID NO: 180227 - DNA, 10 bp, Unknown
  misc_feature (1)..( 10): Result.005 file - promoters50/2113640
gtgtaaacac

SEQ ID NO: 180228 - DNA, 10 bp, Unknown
  misc_feature (1)..( 10): Result.005 file - promoters50/2113640
aaataaacaa

SEQ ID NO: 180229 - DNA, 10 bp, Unknown
  misc_feature (1)..( 10): Result.005 file - promoters50/2113640
atatctacat

SEQ ID NO: 180230 - DNA, 10 bp, Unknown
  misc_feature (1)..( 10): Result.005 file - promoters50/2113640
atatataata

SEQ ID NO: 180231 - DNA, 10 bp, Unknown
  misc_feature (1)..( 10): Result.005 file - promoters50/2113640
aaataaaaga

SEQ ID NO: 180232 - DNA, 11 bp, Unknown
  misc_feature (1)..( 11): Result.005 file - promoters50/2113640
ataaaatttat

SEQ ID NO: 180233 - DNA, 11 bp, Unknown
  misc_feature (1)..( 11): Result.005 file - promoters50/2113640
ccaaaattaca

SEQ ID NO: 180234 - DNA, 11 bp, Unknown
  misc_feature (1)..( 11): Result.005 file - promoters50/2113640
gaaaaataaca

SEQ ID NO: 180235 - DNA, 11 bp, Unknown
  misc_feature (1)..( 11): Result.005 file - promoters50/2113640
ccacaataatt

SEQ ID NO: 180236 - DNA, 11 bp, Unknown
  misc_feature (1)..( 11): Result.005 file - promoters50/2113640
tttaaattaat

SEQ ID NO: 180237 - DNA, 11 bp, Unknown
  misc_feature (1)..( 11): Result.005 file - promoters50/2113640
gaaaaataaaa

SEQ ID NO: 180238 - DNA, 8 bp, Unknown
  misc_feature (1)..( 8): Result.005 file - promoters50/2113675
gaaaaaat

SEQ ID NO: 180239 - DNA, 8 bp, Unknown
  misc_feature (1)..( 8): Result.005 file - promoters50/2113675
gaagaaat

SEQ ID NO: 180240 - DNA, 8 bp, Unknown
  misc_feature (1)..( 8): Result.005 file - promoters50/2113675
aaagaaag

SEQ ID NO: 180241 - DNA, 8 bp, Unknown
  misc_feature (1)..( 8): Result.005 file - promoters50/2113675
gtgtagag

SEQ ID NO: 180242 - DNA, 8 bp, Unknown
  misc_feature (1)..( 8): Result.005 file - promoters50/2113675
gtggagaa

SEQ ID NO: 180243 - DNA, 8 bp, Unknown
  misc_feature (1)..( 8): Result.005 file - promoters50/2113675
gtagagaa

SEQ ID NO: 180244 - DNA, 9 bp, Unknown
  misc_feature (1)..( 9): Result.005 file - promoters50/2113675
gtagagaac

SEQ ID NO: 180245 - DNA, 9 bp, Unknown
  misc_feature (1)..( 9): Result.005 file - promoters50/2113675
gtggagaac

SEQ ID NO: 180246 - DNA, 9 bp, Unknown
  misc_feature (1)..( 9): Result.005 file - promoters50/2113675
gtagagaaa

SEQ ID NO: 180247 - DNA, 8 bp, Unknown
  misc_feature (1)..( 8): Result.005 file - promoters50/2113675
ttaaaatc

SEQ ID NO: 180248 - DNA, 8 bp, Unknown
  misc_feature (1)..( 8): Result.005 file - promoters50/2113675
tcaaaatc

SEQ ID NO: 180249 - DNA, 8 bp, Unknown
  misc_feature (1)..( 8): Result.005 file - promoters50/2113675
ttataatg

SEQ ID NO: 180250 - DNA, 8 bp, Unknown
  misc_feature (1)..( 8): Result.005 file - promoters50/2113695
aaaagaaa

SEQ ID NO: 180251 - DNA, 8 bp, Unknown
  misc_feature (1)..( 8): Result.005 file - promoters50/2113695
gaaaaaaa

SEQ ID NO: 180252 - DNA, 8 bp, Unknown
  misc_feature (1)..( 8): Result.005 file - promoters50/2113695
gaaaaagc

SEQ ID NO: 180253 - DNA, 8 bp, Unknown
  misc_feature (1)..( 8): Result.005 file - promoters50/2113695
attacaaa

SEQ ID NO: 180254 - DNA, 8 bp, Unknown
  misc_feature (1)..( 8): Result.005 file - promoters50/2113695
gttaaaaa

SEQ ID NO: 180255 - DNA, 8 bp, Unknown
  misc_feature (1)..( 8): Result.005 file - promoters50/2113695
gttaaagc

SEQ ID NO: 180256 - DNA, 8 bp, Unknown
  misc_feature (1)..( 8): Result.005 file - promoters50/2113695
tttcattt

SEQ ID NO: 180257 - DNA, 8 bp, Unknown
  misc_feature (1)..( 8): Result.005 file - promoters50/2113695
attcattt

SEQ ID NO: 180258 - DNA, 9 bp, Unknown
  misc_feature (1)..( 9): Result.005 file - promoters50/2113695
tttccatat

SEQ ID NO: 180259 - DNA, 8 bp, Unknown
  misc_feature (1)..( 8): Result.005 file - promoters50/2113695
cttaattc

SEQ ID NO: 180260 - DNA, 8 bp, Unknown
  misc_feature (1)..( 8): Result.005 file - promoters50/2113695
tttaattc

SEQ ID NO: 180261 - DNA, 9 bp, Unknown
  misc_feature (1)..( 9): Result.005 file - promoters50/2113695
attaaattg

SEQ ID NO: 180262 - DNA, 12 bp, Unknown
  misc_feature (1)..( 12): Result.005 file - promoters50/2113695
aacatgttttaa

SEQ ID NO: 180263 - DNA, 12 bp, Unknown
  misc_feature (1)..( 12): Result.005 file - promoters50/2113695
aacatgtttttg

SEQ ID NO: 180264 - DNA, 12 bp, Unknown
  misc_feature (1)..( 12): Result.005 file - promoters50/2113695
attttgttataa

SEQ ID NO: 180265 - DNA, 9 bp, Unknown
  misc_feature (1)..( 9): Result.005 file - promoters50/2113695
tgttttaaa

SEQ ID NO: 180266 - DNA, 9 bp, Unknown
  misc_feature (1)..( 9): Result.005 file - promoters50/2113695
tttttgaaa

SEQ ID NO: 180267 - DNA, 9 bp, Unknown
  misc_feature (1)..( 9): Result.005 file - promoters50/2113695
tgttataac

SEQ ID NO: 180268 - DNA, 7 bp, Unknown
  misc_feature (1)..( 7): Result.005 file - promoters50/2113695
cgaaaag

SEQ ID NO: 180269 - DNA, 7 bp, Unknown
  misc_feature (1)..( 7): Result.005 file - promoters50/2113695
cgaaaaa

SEQ ID NO: 180270 - DNA, 7 bp, Unknown
  misc_feature (1)..( 7): Result.005 file - promoters50/2113695
ggaaaaa

SEQ ID NO: 180271 - DNA, 7 bp, Unknown
  misc_feature (1)..( 7): Result.005 file - promoters50/2113695
ccataag

SEQ ID NO: 180272 - DNA, 7 bp, Unknown
  misc_feature (1)..( 7): Result.005 file - promoters50/2113695
acataag

SEQ ID NO: 180273 - DNA, 7 bp, Unknown
  misc_feature (1)..( 7): Result.005 file - promoters50/2113695
acataac

SEQ ID NO: 180274 - DNA, 10 bp, Unknown
  misc_feature (1)..( 10): Result.005 file - promoters50/2113695
tttttcttaa

SEQ ID NO: 180275 - DNA, 10 bp, Unknown
  misc_feature (1)..( 10): Result.005 file - promoters50/2113695
ttttttttaa

SEQ ID NO: 180276 - DNA, 10 bp, Unknown
  misc_feature (1)..( 10): Result.005 file - promoters50/2113695
gatttcttga

SEQ ID NO: 180277 - DNA, 9 bp, Unknown
  misc_feature (1)..( 9): Result.005 file - promoters50/2113734
aaagtttaa

SEQ ID NO: 180278 - DNA, 9 bp, Unknown
  misc_feature (1)..( 9): Result.005 file - promoters50/2113734
aaactttat

SEQ ID NO: 180279 - DNA, 9 bp, Unknown
  misc_feature (1)..( 9): Result.005 file - promoters50/2113734
ggtgtttaa

SEQ ID NO: 180280 - DNA, 9 bp, Unknown
  misc_feature (1)..( 9): Result.005 file - promoters50/2113734
aattaaaaa

SEQ ID NO: 180281 - DNA, 9 bp, Unknown
  misc_feature (1)..( 9): Result.005 file - promoters50/2113734
aattaaaga

SEQ ID NO: 180282 - DNA, 9 bp, Unknown
  misc_feature (1)..( 9): Result.005 file - promoters50/2113734
tgttagaga

SEQ ID NO: 180283 - DNA, 8 bp, Unknown
  misc_feature (1)..( 8): Result.005 file - promoters50/2113748
tatcttta

SEQ ID NO: 180284 - DNA, 8 bp, Unknown
  misc_feature (1)..( 8): Result.005 file - promoters50/2113748
tatttttt

SEQ ID NO: 180285 - DNA, 8 bp, Unknown
  misc_feature (1)..( 8): Result.005 file - promoters50/2113748
aatttttt

SEQ ID NO: 180286 - DNA, 10 bp, Unknown
  misc_feature (1)..( 10): Result.005 file - promoters50/2113748
cattttgctg

SEQ ID NO: 180287 - DNA, 10 bp, Unknown
  misc_feature (1)..( 10): Result.005 file - promoters50/2113748
tattttactg

SEQ ID NO: 180288 - DNA, 10 bp, Unknown
  misc_feature (1)..( 10): Result.005 file - promoters50/2113748
tattttttta

SEQ ID NO: 180289 - DNA, 8 bp, Unknown
  misc_feature (1)..( 8): Result.005 file - promoters50/2113748
acaatttc

SEQ ID NO: 180290 - DNA, 8 bp, Unknown
  misc_feature (1)..( 8): Result.005 file - promoters50/2113748
caaatttc

SEQ ID NO: 180291 - DNA, 8 bp, Unknown
  misc_feature (1)..( 8): Result.005 file - promoters50/2113748
caaatttt

SEQ ID NO: 180292 - DNA, 9 bp, Unknown
  misc_feature (1)..( 9): Result.005 file - promoters50/2113748
acttaaaaa

SEQ ID NO: 180293 - DNA, 9 bp, Unknown
  misc_feature (1)..( 9): Result.005 file - promoters50/2113748
actcaaaaa

SEQ ID NO: 180294 - DNA, 9 bp, Unknown
  misc_feature (1)..( 9): Result.005 file - promoters50/2113748
cctcaaaag

SEQ ID NO: 180295 - DNA, 9 bp, Unknown
  misc_feature (1)..( 9): Result.005 file - promoters50/2113772
cataaaact

SEQ ID NO: 180296 - DNA, 9 bp, Unknown
  misc_feature (1)..( 9): Result.005 file - promoters50/2113772
ttcaaaact

SEQ ID NO: 180297 - DNA, 9 bp, Unknown
  misc_feature (1)..( 9): Result.005 file - promoters50/2113772
ttcaaaaca

SEQ ID NO: 180298 - DNA, 9 bp, Unknown
  misc_feature (1)..( 9): Result.005 file - promoters50/2113817
gaagtaaat

SEQ ID NO: 180299 - DNA, 9 bp, Unknown
  misc_feature (1)..( 9): Result.005 file - promoters50/2113817
gaaataaca

SEQ ID NO: 180300 - DNA, 9 bp, Unknown
  misc_feature (1)..( 9): Result.005 file - promoters50/2113817
gaaataaat

SEQ ID NO: 180301 - DNA, 7 bp, Unknown
  misc_feature (1)..( 7): Result.005 file - promoters50/2113817
tcgttat

SEQ ID NO: 180302 - DNA, 7 bp, Unknown
  misc_feature (1)..( 7): Result.005 file - promoters50/2113817
acgttat

SEQ ID NO: 180303 - DNA, 7 bp, Unknown
  misc_feature (1)..( 7): Result.005 file - promoters50/2113817
acgttat

SEQ ID NO: 180304 - DNA, 7 bp, Unknown
  misc_feature (1)..( 7): Result.005 file - promoters50/2113817
aaaatag

SEQ ID NO: 180305 - DNA, 7 bp, Unknown
  misc_feature (1)..( 7): Result.005 file - promoters50/2113817
aaaataa

SEQ ID NO: 180306 - DNA, 7 bp, Unknown
  misc_feature (1)..( 7): Result.005 file - promoters50/2113817
aaattaa

SEQ ID NO: 180307 - DNA, 7 bp, Unknown
  misc_feature (1)..( 7): Result.005 file - promoters50/2113817
aaaatga

SEQ ID NO: 180308 - DNA, 7 bp, Unknown
  misc_feature (1)..( 7): Result.005 file - promoters50/2113817
aaattga

SEQ ID NO: 180309 - DNA, 7 bp, Unknown
  misc_feature (1)..( 7): Result.005 file - promoters50/2113817
taattga

SEQ ID NO: 180310 - DNA, 13 bp, Unknown
  misc_feature (1)..( 13): Result.005 file - promoters50/2113839
atttataaagaaa

SEQ ID NO: 180311 - DNA, 13 bp, Unknown
  misc_feature (1)..( 13): Result.005 file - promoters50/2113839
attaacaaataaa

SEQ ID NO: 180312 - DNA, 13 bp, Unknown
  misc_feature (1)..( 13): Result.005 file - promoters50/2113839
tattacaaaaaaa

SEQ ID NO: 180313 - DNA, 13 bp, Unknown
  misc_feature (1)..( 13): Result.005 file - promoters50/2113839
attcataaaaaaa

SEQ ID NO: 180314 - DNA, 13 bp, Unknown
  misc_feature (1)..( 13): Result.005 file - promoters50/2113839
cagaaaaaagaaa

SEQ ID NO: 180315 - DNA, 13 bp, Unknown
  misc_feature (1)..( 13): Result.005 file - promoters50/2113839
actatgaaataac

SEQ ID NO: 180316 - DNA, 13 bp, Unknown
  misc_feature (1)..( 13): Result.005 file - promoters50/2113839
ccctattaatatt

SEQ ID NO: 180317 - DNA, 13 bp, Unknown
  misc_feature (1)..( 13): Result.005 file - promoters50/2113839
gggcattaaaagg

SEQ ID NO: 180318 - DNA, 11 bp, Unknown
  misc_feature (1)..( 11): Result.005 file - promoters50/2113839
aaagaaccaat

SEQ ID NO: 180319 - DNA, 11 bp, Unknown
  misc_feature (1)..( 11): Result.005 file - promoters50/2113839
cattaacaaat

SEQ ID NO: 180320 - DNA, 11 bp, Unknown
  misc_feature (1)..( 11): Result.005 file - promoters50/2113839
aaataacaatt

SEQ ID NO: 180321 - DNA, 11 bp, Unknown
  misc_feature (1)..( 11): Result.005 file - promoters50/2113839
tcataaaaaaa

SEQ ID NO: 180322 - DNA, 11 bp, Unknown
  misc_feature (1)..( 11): Result.005 file - promoters50/2113839
agaaaacaatt

SEQ ID NO: 180323 - DNA, 11 bp, Unknown
  misc_feature (1)..( 11): Result.005 file - promoters50/2113839
cattaaaagga

SEQ ID NO: 180324 - DNA, 10 bp, Unknown
  misc_feature (1)..( 10): Result.005 file - promoters50/2113839
aaatatattt

SEQ ID NO: 180325 - DNA, 10 bp, Unknown
  misc_feature (1)..( 10): Result.005 file - promoters50/2113839
aaacatatct

SEQ ID NO: 180326 - DNA, 10 bp, Unknown
  misc_feature (1)..( 10): Result.005 file - promoters50/2113839
tcctatattt

SEQ ID NO: 180327 - DNA, 10 bp, Unknown
  misc_feature (1)..( 10): Result.005 file - promoters50/2113839
ttatatattg

SEQ ID NO: 180328 - DNA, 10 bp, Unknown
  misc_feature (1)..( 10): Result.005 file - promoters50/2113839
aaaaatagtc

SEQ ID NO: 180329 - DNA, 10 bp, Unknown
  misc_feature (1)..( 10): Result.005 file - promoters50/2113839
aaaaaagaat

SEQ ID NO: 180330 - DNA, 13 bp, Unknown
  misc_feature (1)..( 13): Result.005 file - promoters50/2113839
agataaaatccat

SEQ ID NO: 180331 - DNA, 13 bp, Unknown
  misc_feature (1)..( 13): Result.005 file - promoters50/2113839
agaaaaaagaaag

SEQ ID NO: 180332 - DNA, 13 bp, Unknown
  misc_feature (1)..( 13): Result.005 file - promoters50/2113839
atatatatagata

SEQ ID NO: 180333 - DNA, 13 bp, Unknown
  misc_feature (1)..( 13): Result.005 file - promoters50/2113839
caatacaatacat

SEQ ID NO: 180334 - DNA, 13 bp, Unknown
  misc_feature (1)..( 13): Result.005 file - promoters50/2113839
taaaacaatatct

SEQ ID NO: 180335 - DNA, 13 bp, Unknown
  misc_feature (1)..( 13): Result.005 file - promoters50/2113839
agatacaacaact

SEQ ID NO: 180336 - DNA, 7 bp, Unknown
  misc_feature (1)..( 7): Result.005 file - promoters50/2113842
ttttcac

SEQ ID NO: 180337 - DNA, 7 bp, Unknown
  misc_feature (1)..( 7): Result.005 file - promoters50/2113842
ttttcaa

SEQ ID NO: 180338 - DNA, 8 bp, Unknown
  misc_feature (1)..( 8): Result.005 file - promoters50/2113842
tttgtcaa

SEQ ID NO: 180339 - DNA, 8 bp, Unknown
  misc_feature (1)..( 8): Result.005 file - promoters50/2113842
aatgtcaa

SEQ ID NO: 180340 - DNA, 10 bp, Unknown
  misc_feature (1)..( 10): Result.005 file - promoters50/2113842
aaaataataa

SEQ ID NO: 180341 - DNA, 10 bp, Unknown
  misc_feature (1)..( 10): Result.005 file - promoters50/2113842
aaaataatat

SEQ ID NO: 180342 - DNA, 10 bp, Unknown
  misc_feature (1)..( 10): Result.005 file - promoters50/2113842
cctatattaa

SEQ ID NO: 180343 - DNA, 10 bp, Unknown
  misc_feature (1)..( 10): Result.005 file - promoters50/2113842
aacataatat

SEQ ID NO: 180344 - DNA, 12 bp, Unknown
  misc_feature (1)..( 12): Result.005 file - promoters50/2113842
tattatttaaga

SEQ ID NO: 180345 - DNA, 12 bp, Unknown
  misc_feature (1)..( 12): Result.005 file - promoters50/2113842
atatatataaag

SEQ ID NO: 180346 - DNA, 12 bp, Unknown
  misc_feature (1)..( 12): Result.005 file - promoters50/2113842
atatatataaca

SEQ ID NO: 180347 - DNA, 12 bp, Unknown
  misc_feature (1)..( 12): Result.005 file - promoters50/2113842
cactatatatat

SEQ ID NO: 180348 - DNA, 12 bp, Unknown
  misc_feature (1)..( 12): Result.005 file - promoters50/2113842
atatctataaag

SEQ ID NO: 180349 - DNA, 11 bp, Unknown
  misc_feature (1)..( 11): Result.005 file - promoters50/2113846
gttataattta

SEQ ID NO: 180350 - DNA, 11 bp, Unknown
  misc_feature (1)..( 11): Result.005 file - promoters50/2113846
actatcatttt

SEQ ID NO: 180351 - DNA, 11 bp, Unknown
  misc_feature (1)..( 11): Result.005 file - promoters50/2113846
agtatgattaa

SEQ ID NO: 180352 - DNA, 11 bp, Unknown
  misc_feature (1)..( 11): Result.005 file - promoters50/2113846
gttagaattac

SEQ ID NO: 180353 - DNA, 7 bp, Unknown
  misc_feature (1)..( 7): Result.005 file - promoters50/2113846
ccatttt

SEQ ID NO: 180354 - DNA, 9 bp, Unknown
  misc_feature (1)..( 9): Result.005 file - promoters50/2113846
aatttaacg

SEQ ID NO: 180355 - DNA, 9 bp, Unknown
  misc_feature (1)..( 9): Result.005 file - promoters50/2113846
tttttgacg

SEQ ID NO: 180356 - DNA, 9 bp, Unknown
  misc_feature (1)..( 9): Result.005 file - promoters50/2113846
aatttaatg

SEQ ID NO: 180357 - DNA, 9 bp, Unknown
  misc_feature (1)..( 9): Result.005 file - promoters50/2113846
tatttaaaa

SEQ ID NO: 180358 - DNA, 11 bp, Unknown
  misc_feature (1)..( 11): Result.005 file - promoters50/2113846
caaatttattt

SEQ ID NO: 180359 - DNA, 11 bp, Unknown
  misc_feature (1)..( 11): Result.005 file - promoters50/2113846
aaaaattagat

SEQ ID NO: 180360 - DNA, 11 bp, Unknown
  misc_feature (1)..( 11): Result.005 file - promoters50/2113846
tgtatttattt

SEQ ID NO: 180361 - DNA, 11 bp, Unknown
  misc_feature (1)..( 11): Result.005 file - promoters50/2113846
taaaagaatca

SEQ ID NO: 180362 - DNA, 8 bp, Unknown
  misc_feature (1)..( 8): Result.005 file - promoters50/2113846
attagatc

SEQ ID NO: 180363 - DNA, 8 bp, Unknown
  misc_feature (1)..( 8): Result.005 file - promoters50/2113846
cttatatc

SEQ ID NO: 180364 - DNA, 8 bp, Unknown
  misc_feature (1)..( 8): Result.005 file - promoters50/2113846
attagaaa

SEQ ID NO: 180365 - DNA, 8 bp, Unknown
  misc_feature (1)..( 8): Result.005 file - promoters50/2113846
attatatc

SEQ ID NO: 180366 - DNA, 11 bp, Unknown
  misc_feature (1)..( 11): Result.005 file - promoters50/2113889
cttgttaacat

SEQ ID NO: 180367 - DNA, 11 bp, Unknown
  misc_feature (1)..( 11): Result.005 file - promoters50/2113889
tatgtaaactg

SEQ ID NO: 180368 - DNA, 11 bp, Unknown
  misc_feature (1)..( 11): Result.005 file - promoters50/2113889
tatttaatttg

SEQ ID NO: 180369 - DNA, 11 bp, Unknown
  misc_feature (1)..( 11): Result.005 file - promoters50/2113889
aaaataatctg

SEQ ID NO: 180370 - DNA, 11 bp, Unknown
  misc_feature (1)..( 11): Result.005 file - promoters50/2113889
attttaatgat

SEQ ID NO: 180371 - DNA, 11 bp, Unknown
  misc_feature (1)..( 11): Result.005 file - promoters50/2113889
gatataatctc

SEQ ID NO: 180372 - DNA, 12 bp, Unknown
  misc_feature (1)..( 12): Result.005 file - promoters50/2113889
gttgactggttc

SEQ ID NO: 180373 - DNA, 12 bp, Unknown
  misc_feature (1)..( 12): Result.005 file - promoters50/2113889
gttaactttgta

SEQ ID NO: 180374 - DNA, 12 bp, Unknown
  misc_feature (1)..( 12): Result.005 file - promoters50/2113889
attaaccttgag

SEQ ID NO: 180375 - DNA, 12 bp, Unknown
  misc_feature (1)..( 12): Result.005 file - promoters50/2113889
attaattttctt

SEQ ID NO: 180376 - DNA, 12 bp, Unknown
  misc_feature (1)..( 12): Result.005 file - promoters50/2113889
aagaactttaat

SEQ ID NO: 180377 - DNA, 12 bp, Unknown
  misc_feature (1)..( 12): Result.005 file - promoters50/2113889
gttagtttttat

SEQ ID NO: 180378 - DNA, 15 bp, Unknown
  misc_feature (1)..( 15): Result.005 file - promoters50/2113889
agagcatttaaaaat

SEQ ID NO: 180379 - DNA, 15 bp, Unknown
  misc_feature (1)..( 15): Result.005 file - promoters50/2113889
tctatatttcaaaat

SEQ ID NO: 180380 - DNA, 15 bp, Unknown
  misc_feature (1)..( 15): Result.005 file - promoters50/2113889
gataaattttgagta

SEQ ID NO: 180381 - DNA, 15 bp, Unknown
  misc_feature (1)..( 15): Result.005 file - promoters50/2113889
gataaattacttgca

SEQ ID NO: 180382 - DNA, 15 bp, Unknown
  misc_feature (1)..( 15): Result.005 file - promoters50/2113889
tatatattctgatct

SEQ ID NO: 180383 - DNA, 15 bp, Unknown
  misc_feature (1)..( 15): Result.005 file - promoters50/2113889
cttgaattacaaaac

SEQ ID NO: 180384 - DNA, 16 bp, Unknown
  misc_feature (1)..( 16): Result.005 file - promoters50/2113889
ctaatatatataaggc

SEQ ID NO: 180385 - DNA, 10 bp, Unknown
  misc_feature (1)..( 10): Result.005 file - promoters50/2113889
tttaattaga

SEQ ID NO: 180386 - DNA, 10 bp, Unknown
  misc_feature (1)..( 10): Result.005 file - promoters50/2113889
aataattaaa

SEQ ID NO: 180387 - DNA, 10 bp, Unknown
  misc_feature (1)..( 10): Result.005 file - promoters50/2113889
tttaactagt

SEQ ID NO: 180388 - DNA, 10 bp, Unknown
  misc_feature (1)..( 10): Result.005 file - promoters50/2113889
gttacctagc

SEQ ID NO: 180389 - DNA, 10 bp, Unknown
  misc_feature (1)..( 10): Result.005 file - promoters50/2113889
tttatctaat

SEQ ID NO: 180390 - DNA, 10 bp, Unknown
  misc_feature (1)..( 10): Result.005 file - promoters50/2113889
aataaataaa

SEQ ID NO: 180391 - DNA, 14 bp, Unknown
  misc_feature (1)..( 14): Result.005 file - promoters50/2113889
aacgtgtttaaatt

SEQ ID NO: 180392 - DNA, 14 bp, Unknown
  misc_feature (1)..( 14): Result.005 file - promoters50/2113889
agagaattttaatg

SEQ ID NO: 180393 - DNA, 14 bp, Unknown
  misc_feature (1)..( 14): Result.005 file - promoters50/2113889
caatcaaattaatg

SEQ ID NO: 180394 - DNA, 14 bp, Unknown
  misc_feature (1)..( 14): Result.005 file - promoters50/2113889
atggaatattacta

SEQ ID NO: 180395 - DNA, 14 bp, Unknown
  misc_feature (1)..( 14): Result.005 file - promoters50/2113889
aatcaaaaataata

SEQ ID NO: 180396 - DNA, 14 bp, Unknown
  misc_feature (1)..( 14): Result.005 file - promoters50/2113889
aaagaataaaaaaa

SEQ ID NO: 180397 - DNA, 9 bp, Unknown
  misc_feature (1)..( 9): Result.005 file - promoters50/2113889
aaaaacaaa

SEQ ID NO: 180398 - DNA, 9 bp, Unknown
  misc_feature (1)..( 9): Result.005 file - promoters50/2113889
taaagcaaa

SEQ ID NO: 180399 - DNA, 9 bp, Unknown
  misc_feature (1)..( 9): Result.005 file - promoters50/2113889
gaaagaaaa

SEQ ID NO: 180400 - DNA, 9 bp, Unknown
  misc_feature (1)..( 9): Result.005 file - promoters50/2113889
aaaaccaaa

SEQ ID NO: 180401 - DNA, 9 bp, Unknown
  misc_feature (1)..( 9): Result.005 file - promoters50/2113889
aaaatcaac

SEQ ID NO: 180402 - DNA, 10 bp, Unknown
  misc_feature (1)..( 10): Result.005 file - promoters50/2113889
taaagtcaca

SEQ ID NO: 180403 - DNA, 14 bp, Unknown
  misc_feature (1)..( 14): Result.005 file - promoters50/2113889
agacaaattgatct

SEQ ID NO: 180404 - DNA, 14 bp, Unknown
  misc_feature (1)..( 14): Result.005 file - promoters50/2113889
ttcaaaatttatcc

SEQ ID NO: 180405 - DNA, 14 bp, Unknown
  misc_feature (1)..( 14): Result.005 file - promoters50/2113889
agataaattacttg

SEQ ID NO: 180406 - DNA, 14 bp, Unknown
  misc_feature (1)..( 14): Result.005 file - promoters50/2113889
atatattctgatct

SEQ ID NO: 180407 - DNA, 14 bp, Unknown
  misc_feature (1)..( 14): Result.005 file - promoters50/2113889
tgataaattttgag

SEQ ID NO: 180408 - DNA, 14 bp, Unknown
  misc_feature (1)..( 14): Result.005 file - promoters50/2113889
tacaaaactacata

SEQ ID NO: 180409 - DNA, 14 bp, Unknown
  misc_feature (1)..( 14): Result.005 file - promoters50/2113889
aatctaatatatat

SEQ ID NO: 180410 - DNA, 12 bp, Unknown
  misc_feature (1)..( 12): Result.005 file - promoters50/2113889
gataaattttga

SEQ ID NO: 180411 - DNA, 12 bp, Unknown
  misc_feature (1)..( 12): Result.005 file - promoters50/2113889
tacatattctga

SEQ ID NO: 180412 - DNA, 12 bp, Unknown
  misc_feature (1)..( 12): Result.005 file - promoters50/2113889
tcaaaatttatc

SEQ ID NO: 180413 - DNA, 12 bp, Unknown
  misc_feature (1)..( 12): Result.005 file - promoters50/2113889
tatatattctga

SEQ ID NO: 180414 - DNA, 12 bp, Unknown
  misc_feature (1)..( 12): Result.005 file - promoters50/2113889
aatatatataag

SEQ ID NO: 180415 - DNA, 12 bp, Unknown
  misc_feature (1)..( 12): Result.005 file - promoters50/2113889
aatagataaatt

SEQ ID NO: 180416 - DNA, 10 bp, Unknown
  misc_feature (1)..( 10): Result.005 file - promoters50/2113889
aaataataaa

SEQ ID NO: 180417 - DNA, 10 bp, Unknown
  misc_feature (1)..( 10): Result.005 file - promoters50/2113889
aaatattaac

SEQ ID NO: 180418 - DNA, 10 bp, Unknown
  misc_feature (1)..( 10): Result.005 file - promoters50/2113889
gcttaataaa

SEQ ID NO: 180419 - DNA, 10 bp, Unknown
  misc_feature (1)..( 10): Result.005 file - promoters50/2113889
ttctaataac

SEQ ID NO: 180420 - DNA, 10 bp, Unknown
  misc_feature (1)..( 10): Result.005 file - promoters50/2113889
aaagattaca

SEQ ID NO: 180421 - DNA, 10 bp, Unknown
  misc_feature (1)..( 10): Result.005 file - promoters50/2113889
gattattaac

SEQ ID NO: 180422 - DNA, 9 bp, Unknown
  misc_feature (1)..( 9): Result.005 file - promoters50/2113914
taatttaat

SEQ ID NO: 180423 - DNA, 9 bp, Unknown
  misc_feature (1)..( 9): Result.005 file - promoters50/2113914
taagttata

SEQ ID NO: 180424 - DNA, 9 bp, Unknown
  misc_feature (1)..( 9): Result.005 file - promoters50/2113914
ccatttaat

SEQ ID NO: 180425 - DNA, 8 bp, Unknown
  misc_feature (1)..( 8): Result.005 file - promoters50/2113914
aaacaaaa

SEQ ID NO: 180426 - DNA, 8 bp, Unknown
  misc_feature (1)..( 8): Result.005 file - promoters50/2113914
aaataaaa

SEQ ID NO: 180427 - DNA, 8 bp, Unknown
  misc_feature (1)..( 8): Result.005 file - promoters50/2113914
aaagaaac

SEQ ID NO: 180428 - DNA, 18 bp, Unknown
  misc_feature (1)..( 18): Result.005 file - promoters50/2113928
caaagttaaaacaagaga

SEQ ID NO: 180429 - DNA, 18 bp, Unknown
  misc_feature (1)..( 18): Result.005 file - promoters50/2113928
aaaaattattaaagtata

SEQ ID NO: 180430 - DNA, 19 bp, Unknown
  misc_feature (1)..( 19): Result.005 file - promoters50/2113928
taaagattattaaattata

SEQ ID NO: 180431 - DNA, 19 bp, Unknown
  misc_feature (1)..( 19): Result.005 file - promoters50/2113928
aaataatttatttacttat

SEQ ID NO: 180432 - DNA, 9 bp, Unknown
  misc_feature (1)..( 9): Result.005 file - promoters50/2113928
aatacaaat

SEQ ID NO: 180433 - DNA, 9 bp, Unknown
  misc_feature (1)..( 9): Result.005 file - promoters50/2113928
ctaacaaat

SEQ ID NO: 180434 - DNA, 9 bp, Unknown
  misc_feature (1)..( 9): Result.005 file - promoters50/2113928
aattcaaaa

SEQ ID NO: 180435 - DNA, 9 bp, Unknown
  misc_feature (1)..( 9): Result.005 file - promoters50/2113928
gtaagaaaa

SEQ ID NO: 180436 - DNA, 10 bp, Unknown
  misc_feature (1)..( 10): Result.005 file - promoters50/2113928
ctataaatag

SEQ ID NO: 180437 - DNA, 10 bp, Unknown
  misc_feature (1)..( 10): Result.005 file - promoters50/2113928
ctatatatat

SEQ ID NO: 180438 - DNA, 10 bp, Unknown
  misc_feature (1)..( 10): Result.005 file - promoters50/2113928
ctataagaac

SEQ ID NO: 180439 - DNA, 10 bp, Unknown
  misc_feature (1)..( 10): Result.005 file - promoters50/2113928
ttatttatat

SEQ ID NO: 180440 - DNA, 19 bp, Unknown
  misc_feature (1)..( 19): Result.005 file - promoters50/2113928
gatcaaagttaaaacaaga

SEQ ID NO: 180441 - DNA, 19 bp, Unknown
  misc_feature (1)..( 19): Result.005 file - promoters50/2113928
ttattaaattataacacac

SEQ ID NO: 180442 - DNA, 19 bp, Unknown
  misc_feature (1)..( 19): Result.005 file - promoters50/2113928
aaaaattattaaagtatat

SEQ ID NO: 180443 - DNA, 8 bp, Unknown
  misc_feature (1)..( 8): Result.005 file - promoters50/2113928
aaataatt

SEQ ID NO: 180444 - DNA, 13 bp, Unknown
  misc_feature (1)..( 13): Result.005 file - promoters50/2113928
tactcacaacttt

SEQ ID NO: 180445 - DNA, 13 bp, Unknown
  misc_feature (1)..( 13): Result.005 file - promoters50/2113928
accacttaacttt

SEQ ID NO: 180446 - DNA, 13 bp, Unknown
  misc_feature (1)..( 13): Result.005 file - promoters50/2113928
cctaatcaagttt

SEQ ID NO: 180447 - DNA, 13 bp, Unknown
  misc_feature (1)..( 13): Result.005 file - promoters50/2113928
taattttaatttt

SEQ ID NO: 180448 - DNA, 13 bp, Unknown
  misc_feature (1)..( 13): Result.005 file - promoters50/2113928
taattttaatttt

SEQ ID NO: 180449 - DNA, 8 bp, Unknown
  misc_feature (1)..( 8): Result.005 file - promoters50/2113928
taatttta

SEQ ID NO: 180450 - DNA, 8 bp, Unknown
  misc_feature (1)..( 8): Result.005 file - promoters50/2113928
taatttta

SEQ ID NO: 180451 - DNA, 8 bp, Unknown
  misc_feature (1)..( 8): Result.005 file - promoters50/2113928
taagtttc

SEQ ID NO: 180452 - DNA, 8 bp, Unknown
  misc_feature (1)..( 8): Result.005 file - promoters50/2113928
caagtttc

SEQ ID NO: 180453 - DNA, 12 bp, Unknown
  misc_feature (1)..( 12): Result.005 file - promoters50/2113928
atggtaaacata

SEQ ID NO: 180454 - DNA, 12 bp, Unknown
  misc_feature (1)..( 12): Result.005 file - promoters50/2113928
aaaaaaaacatt

SEQ ID NO: 180455 - DNA, 12 bp, Unknown
  misc_feature (1)..( 12): Result.005 file - promoters50/2113928
tactgtaacatt

SEQ ID NO: 180456 - DNA, 12 bp, Unknown
  misc_feature (1)..( 12): Result.005 file - promoters50/2113928
aaaaagaacaat

SEQ ID NO: 180457 - DNA, 10 bp, Unknown
  misc_feature (1)..( 10): Result.005 file - promoters50/2113967
ttattttata

SEQ ID NO: 180458 - DNA, 10 bp, Unknown
  misc_feature (1)..( 10): Result.005 file - promoters50/2113967
ctatattata

SEQ ID NO: 180459 - DNA, 10 bp, Unknown
  misc_feature (1)..( 10): Result.005 file - promoters50/2113967
agattttata

SEQ ID NO: 180460 - DNA, 10 bp, Unknown
  misc_feature (1)..( 10): Result.005 file - promoters50/2113967
ttattatatt

SEQ ID NO: 180461 - DNA, 10 bp, Unknown
  misc_feature (1)..( 10): Result.005 file - promoters50/2113967
ggatattaca

SEQ ID NO: 180462 - DNA, 10 bp, Unknown
  misc_feature (1)..( 10): Result.005 file - promoters50/2113967
ttattttact

SEQ ID NO: 180463 - DNA, 15 bp, Unknown
  misc_feature (1)..( 15): Result.005 file - promoters50/2113967
aaaaattattttaat

SEQ ID NO: 180464 - DNA, 15 bp, Unknown
  misc_feature (1)..( 15): Result.005 file - promoters50/2113967
acaacttattttatg

SEQ ID NO: 180465 - DNA, 15 bp, Unknown
  misc_feature (1)..( 15): Result.005 file - promoters50/2113967
tttcaatattgggcc

SEQ ID NO: 180466 - DNA, 15 bp, Unknown
  misc_feature (1)..( 15): Result.005 file - promoters50/2113967
attatctattttgtc

SEQ ID NO: 180467 - DNA, 15 bp, Unknown
  misc_feature (1)..( 15): Result.005 file - promoters50/2113967
gcatgttatattaaa

SEQ ID NO: 180468 - DNA, 15 bp, Unknown
  misc_feature (1)..( 15): Result.005 file - promoters50/2113967
gttcaatgttcatca

SEQ ID NO: 180469 - DNA, 15 bp, Unknown
  misc_feature (1)..( 15): Result.005 file - promoters50/2113967
tgcccagttttgaat

SEQ ID NO: 180470 - DNA, 12 bp, Unknown
  misc_feature (1)..( 12): Result.005 file - promoters50/2114005
aaaatttatata

SEQ ID NO: 180471 - DNA, 12 bp, Unknown
  misc_feature (1)..( 12): Result.005 file - promoters50/2114005
aaagttttgtgg

SEQ ID NO: 180472 - DNA, 13 bp, Unknown
  misc_feature (1)..( 13): Result.005 file - promoters50/2114005
aaatattgtatgc

SEQ ID NO: 180473 - DNA, 13 bp, Unknown
  misc_feature (1)..( 13): Result.005 file - promoters50/2114005
ttcaatttttata

SEQ ID NO: 180474 - DNA, 13 bp, Unknown
  misc_feature (1)..( 13): Result.005 file - promoters50/2114005
tcggatttttagt

SEQ ID NO: 180475 - DNA, 11 bp, Unknown
  misc_feature (1)..( 11): Result.005 file - promoters50/2114005
aatttatatat

SEQ ID NO: 180476 - DNA, 11 bp, Unknown
  misc_feature (1)..( 11): Result.005 file - promoters50/2114005
aggttatgtat

SEQ ID NO: 180477 - DNA, 11 bp, Unknown
  misc_feature (1)..( 11): Result.005 file - promoters50/2114005
tatttaaatat

SEQ ID NO: 180478 - DNA, 11 bp, Unknown
  misc_feature (1)..( 11): Result.005 file - promoters50/2114005
aatttttatag

SEQ ID NO: 180479 - DNA, 11 bp, Unknown
  misc_feature (1)..( 11): Result.005 file - promoters50/2114005
taattatgtta

SEQ ID NO: 180480 - DNA, 11 bp, Unknown
  misc_feature (1)..( 11): Result.005 file - promoters50/2114005
gatttttagta

SEQ ID NO: 180481 - DNA, 11 bp, Unknown
  misc_feature (1)..( 11): Result.005 file - promoters50/2114005
attttcctttg

SEQ ID NO: 180482 - DNA, 11 bp, Unknown
  misc_feature (1)..( 11): Result.005 file - promoters50/2114005
acttttcttag

SEQ ID NO: 180483 - DNA, 11 bp, Unknown
  misc_feature (1)..( 11): Result.005 file - promoters50/2114005
ggttttgttat

SEQ ID NO: 180484 - DNA, 11 bp, Unknown
  misc_feature (1)..( 11): Result.005 file - promoters50/2114005
aattatgttat

SEQ ID NO: 180485 - DNA, 11 bp, Unknown
  misc_feature (1)..( 11): Result.005 file - promoters50/2114005
tattttaggtg

SEQ ID NO: 180486 - DNA, 11 bp, Unknown
  misc_feature (1)..( 11): Result.005 file - promoters50/2114005
aataattttcc

SEQ ID NO: 180487 - DNA, 11 bp, Unknown
  misc_feature (1)..( 11): Result.005 file - promoters50/2114005
ataaattttaa

SEQ ID NO: 180488 - DNA, 11 bp, Unknown
  misc_feature (1)..( 11): Result.005 file - promoters50/2114005
ttcaattttta

SEQ ID NO: 180489 - DNA, 11 bp, Unknown
  misc_feature (1)..( 11): Result.005 file - promoters50/2114005
tcggattttta

SEQ ID NO: 180490 - DNA, 11 bp, Unknown
  misc_feature (1)..( 11): Result.005 file - promoters50/2114005
atacatttcga

SEQ ID NO: 180491 - DNA, 12 bp, Unknown
  misc_feature (1)..( 12): Result.005 file - promoters50/2114026
gaagttttcgaa

SEQ ID NO: 180492 - DNA, 12 bp, Unknown
  misc_feature (1)..( 12): Result.005 file - promoters50/2114026
caagttttgatc

SEQ ID NO: 180493 - DNA, 12 bp, Unknown
  misc_feature (1)..( 12): Result.005 file - promoters50/2114026
gaatttttttaa

SEQ ID NO: 180494 - DNA, 12 bp, Unknown
  misc_feature (1)..( 12): Result.005 file - promoters50/2114026
taagtttttcgt

SEQ ID NO: 180495 - DNA, 12 bp, Unknown
  misc_feature (1)..( 12): Result.005 file - promoters50/2114026
tgagtattgatc

SEQ ID NO: 180496 - DNA, 12 bp, Unknown
  misc_feature (1)..( 12): Result.005 file - promoters50/2114026
tcggaattgatt

SEQ ID NO: 180497 - DNA, 12 bp, Unknown
  misc_feature (1)..( 12): Result.005 file - promoters50/2114026
ctattctttatt

SEQ ID NO: 180498 - DNA, 12 bp, Unknown
  misc_feature (1)..( 12): Result.005 file - promoters50/2114026
taatttttataa

SEQ ID NO: 180499 - DNA, 18 bp, Unknown
  misc_feature (1)..( 18): Result.005 file - promoters50/2114026
accaagttttattgtagt

SEQ ID NO: 180500 - DNA, 18 bp, Unknown
  misc_feature (1)..( 18): Result.005 file - promoters50/2114026
tagcattttcatttcttg

SEQ ID NO: 180501 - DNA, 18 bp, Unknown
  misc_feature (1)..( 18): Result.005 file - promoters50/2114026
tgtttttttcattgtagt

SEQ ID NO: 180502 - DNA, 18 bp, Unknown
  misc_feature (1)..( 18): Result.005 file - promoters50/2114026
taagagttttacgttttg

SEQ ID NO: 180503 - DNA, 18 bp, Unknown
  misc_feature (1)..( 18): Result.005 file - promoters50/2114026
taatagtttctttttgca

SEQ ID NO: 180504 - DNA, 19 bp, Unknown
  misc_feature (1)..( 19): Result.005 file - promoters50/2114026
tttggtttctcattaattg

SEQ ID NO: 180505 - DNA, 12 bp, Unknown
  misc_feature (1)..( 12): Result.005 file - promoters50/2114026
gtataagtaaac

SEQ ID NO: 180506 - DNA, 12 bp, Unknown
  misc_feature (1)..( 12): Result.005 file - promoters50/2114026
ttttaattaatt

SEQ ID NO: 180507 - DNA, 12 bp, Unknown
  misc_feature (1)..( 12): Result.005 file - promoters50/2114026
aataaagaaaac

SEQ ID NO: 180508 - DNA, 12 bp, Unknown
  misc_feature (1)..( 12): Result.005 file - promoters50/2114026
ttatgagttatg

SEQ ID NO: 180509 - DNA, 12 bp, Unknown
  misc_feature (1)..( 12): Result.005 file - promoters50/2114026
tatcaaataaaa

SEQ ID NO: 180510 - DNA, 12 bp, Unknown
  misc_feature (1)..( 12): Result.005 file - promoters50/2114026
tattaacatgac

SEQ ID NO: 180511 - DNA, 12 bp, Unknown
  misc_feature (1)..( 12): Result.005 file - promoters50/2114026
ttatgactccta

SEQ ID NO: 180512 - DNA, 10 bp, Unknown
  misc_feature (1)..( 10): Result.005 file - promoters50/2114026
gtatatatac

SEQ ID NO: 180513 - DNA, 10 bp, Unknown
  misc_feature (1)..( 10): Result.005 file - promoters50/2114026
ctatataatg

SEQ ID NO: 180514 - DNA, 10 bp, Unknown
  misc_feature (1)..( 10): Result.005 file - promoters50/2114026
ctatataata

SEQ ID NO: 180515 - DNA, 10 bp, Unknown
  misc_feature (1)..( 10): Result.005 file - promoters50/2114026
ctatatatac

SEQ ID NO: 180516 - DNA, 10 bp, Unknown
  misc_feature (1)..( 10): Result.005 file - promoters50/2114026
atatatatcc

SEQ ID NO: 180517 - DNA, 10 bp, Unknown
  misc_feature (1)..( 10): Result.005 file - promoters50/2114026
ctatataaag

SEQ ID NO: 180518 - DNA, 10 bp, Unknown
  misc_feature (1)..( 10): Result.005 file - promoters50/2114026
taatataaaa

SEQ ID NO: 180519 - DNA, 18 bp, Unknown
  misc_feature (1)..( 18): Result.005 file - promoters50/2114030
ttttacatctataaataa

SEQ ID NO: 180520 - DNA, 18 bp, Unknown
  misc_feature (1)..( 18): Result.005 file - promoters50/2114030
ccatacctttataaactc

SEQ ID NO: 180521 - DNA, 18 bp, Unknown
  misc_feature (1)..( 18): Result.005 file - promoters50/2114030
atcgtccaatataaatag

SEQ ID NO: 180522 - DNA, 18 bp, Unknown
  misc_feature (1)..( 18): Result.005 file - promoters50/2114030
ctcttcctttatatataa

SEQ ID NO: 180523 - DNA, 18 bp, Unknown
  misc_feature (1)..( 18): Result.005 file - promoters50/2114030
ttttacatgtatatatac

SEQ ID NO: 180524 - DNA, 18 bp, Unknown
  misc_feature (1)..( 18): Result.005 file - promoters50/2114030
attctcttgtatatatac

SEQ ID NO: 180525 - DNA, 16 bp, Unknown
  misc_feature (1)..( 16): Result.005 file - promoters50/2114030
aattgaaaatacaaat

SEQ ID NO: 180526 - DNA, 16 bp, Unknown
  misc_feature (1)..( 16): Result.005 file - promoters50/2114030
cattcaaagaatgttg

SEQ ID NO: 180527 - DNA, 16 bp, Unknown
  misc_feature (1)..( 16): Result.005 file - promoters50/2114030
catacaatgtaatgaa

SEQ ID NO: 180528 - DNA, 16 bp, Unknown
  misc_feature (1)..( 16): Result.005 file - promoters50/2114030
atatcaaacaataaaa

SEQ ID NO: 180529 - DNA, 16 bp, Unknown
  misc_feature (1)..( 16): Result.005 file - promoters50/2114030
attataaaaaatttac

SEQ ID NO: 180530 - DNA, 16 bp, Unknown
  misc_feature (1)..( 16): Result.005 file - promoters50/2114030
accttaaaaaatcaaa

SEQ ID NO: 180531 - DNA, 9 bp, Unknown
  misc_feature (1)..( 9): Result.005 file - promoters50/2114030
tataaaatt

SEQ ID NO: 180532 - DNA, 9 bp, Unknown
  misc_feature (1)..( 9): Result.005 file - promoters50/2114030
catacaatg

SEQ ID NO: 180533 - DNA, 9 bp, Unknown
  misc_feature (1)..( 9): Result.005 file - promoters50/2114030
ttaaaaatt

SEQ ID NO: 180534 - DNA, 9 bp, Unknown
  misc_feature (1)..( 9): Result.005 file - promoters50/2114030
accaaaatt

SEQ ID NO: 180535 - DNA, 9 bp, Unknown
  misc_feature (1)..( 9): Result.005 file - promoters50/2114030
cattcaaag

SEQ ID NO: 180536 - DNA, 9 bp, Unknown
  misc_feature (1)..( 9): Result.005 file - promoters50/2114030
actaaaaat

SEQ ID NO: 180537 - DNA, 14 bp, Unknown
  misc_feature (1)..( 14): Result.005 file - promoters50/2114095
ctaaaaaaatcttt

SEQ ID NO: 180538 - DNA, 14 bp, Unknown
  misc_feature (1)..( 14): Result.005 file - promoters50/2114095
agaagaaactctct

SEQ ID NO: 180539 - DNA, 14 bp, Unknown
  misc_feature (1)..( 14): Result.005 file - promoters50/2114095
catcatcaatcttt

SEQ ID NO: 180540 - DNA, 14 bp, Unknown
  misc_feature (1)..( 14): Result.005 file - promoters50/2114095
attctaaaatcttc

SEQ ID NO: 180541 - DNA, 14 bp, Unknown
  misc_feature (1)..( 14): Result.005 file - promoters50/2114095
ctataaaaatgcac

SEQ ID NO: 180542 - DNA, 14 bp, Unknown
  misc_feature (1)..( 14): Result.005 file - promoters50/2114095
tcttaaaaacctta

SEQ ID NO: 180543 - DNA, 14 bp, Unknown
  misc_feature (1)..( 14): Result.005 file - promoters50/2114095
acttgtgaaccttc

SEQ ID NO: 180544 - DNA, 12 bp, Unknown
  misc_feature (1)..( 12): Result.005 file - promoters50/2114111
atcaatcatttt

SEQ ID NO: 180545 - DNA, 12 bp, Unknown
  misc_feature (1)..( 12): Result.005 file - promoters50/2114111
tgaaataatttc

SEQ ID NO: 180546 - DNA, 12 bp, Unknown
  misc_feature (1)..( 12): Result.005 file - promoters50/2114111
atcaatgatttg

SEQ ID NO: 180547 - DNA, 12 bp, Unknown
  misc_feature (1)..( 12): Result.005 file - promoters50/2114111
gaacttgaattg

SEQ ID NO: 180548 - DNA, 9 bp, Unknown
  misc_feature (1)..( 9): Result.005 file - promoters50/2114111
aattttggt

SEQ ID NO: 180549 - DNA, 9 bp, Unknown
  misc_feature (1)..( 9): Result.005 file - promoters50/2114111
aattttcga

SEQ ID NO: 180550 - DNA, 9 bp, Unknown
  misc_feature (1)..( 9): Result.005 file - promoters50/2114111
aatttgcga

SEQ ID NO: 180551 - DNA, 7 bp, Unknown
  misc_feature (1)..( 7): Result.005 file - promoters50/2114111
taatatt

SEQ ID NO: 180552 - DNA, 7 bp, Unknown
  misc_feature (1)..( 7): Result.005 file - promoters50/2114111
taaaatt

SEQ ID NO: 180553 - DNA, 7 bp, Unknown
  misc_feature (1)..( 7): Result.005 file - promoters50/2114111
taatatt

SEQ ID NO: 180554 - DNA, 7 bp, Unknown
  misc_feature (1)..( 7): Result.005 file - promoters50/2114111
gaatatt

SEQ ID NO: 180555 - DNA, 8 bp, Unknown
  misc_feature (1)..( 8): Result.005 file - promoters50/2114111
taaagccc

SEQ ID NO: 180556 - DNA, 8 bp, Unknown
  misc_feature (1)..( 8): Result.005 file - promoters50/2114111
aaaagcct

SEQ ID NO: 180557 - DNA, 8 bp, Unknown
  misc_feature (1)..( 8): Result.005 file - promoters50/2114111
aaaaacct

SEQ ID NO: 180558 - DNA, 8 bp, Unknown
  misc_feature (1)..( 8): Result.005 file - promoters50/2114111
aaaaaccg

SEQ ID NO: 180559 - DNA, 8 bp, Unknown
  misc_feature (1)..( 8): Result.005 file - promoters50/2114111
aaaaacct

SEQ ID NO: 180560 - DNA, 8 bp, Unknown
  misc_feature (1)..( 8): Result.005 file - promoters50/2114111
aaaagcct

SEQ ID NO: 180561 - DNA, 10 bp, Unknown
  misc_feature (1)..( 10): Result.005 file - promoters50/2114111
taactgagaa

SEQ ID NO: 180562 - DNA, 10 bp, Unknown
  misc_feature (1)..( 10): Result.005 file - promoters50/2114111
caacttagaa

SEQ ID NO: 180563 - DNA, 10 bp, Unknown
  misc_feature (1)..( 10): Result.005 file - promoters50/2114111
caactttccc

SEQ ID NO: 180564 - DNA, 8 bp, Unknown
  misc_feature (1)..( 8): Result.005 file - promoters50/2114111
caaattat

SEQ ID NO: 180565 - DNA, 8 bp, Unknown
  misc_feature (1)..( 8): Result.005 file - promoters50/2114111
caatttat

SEQ ID NO: 180566 - DNA, 8 bp, Unknown
  misc_feature (1)..( 8): Result.005 file - promoters50/2114111
gaaattag

SEQ ID NO: 180567 - DNA, 12 bp, Unknown
  misc_feature (1)..( 12): Result.005 file - promoters50/2114111
tgaaatatttaa

SEQ ID NO: 180568 - DNA, 12 bp, Unknown
  misc_feature (1)..( 12): Result.005 file - promoters50/2114111
tgaaatagttaa

SEQ ID NO: 180569 - DNA, 12 bp, Unknown
  misc_feature (1)..( 12): Result.005 file - promoters50/2114111
gaaaatagaaga

SEQ ID NO: 180570 - DNA, 9 bp, Unknown
  misc_feature (1)..( 9): Result.005 file - promoters50/2114115
aaatctttt

SEQ ID NO: 180571 - DNA, 9 bp, Unknown
  misc_feature (1)..( 9): Result.005 file - promoters50/2114115
agatcattt

SEQ ID NO: 180572 - DNA, 9 bp, Unknown
  misc_feature (1)..( 9): Result.005 file - promoters50/2114115
aaatgttta

SEQ ID NO: 180573 - DNA, 9 bp, Unknown
  misc_feature (1)..( 9): Result.005 file - promoters50/2114115
tgatcatgc

SEQ ID NO: 180574 - DNA, 9 bp, Unknown
  misc_feature (1)..( 9): Result.005 file - promoters50/2114115
tgatcactc

SEQ ID NO: 180575 - DNA, 12 bp, Unknown
  misc_feature (1)..( 12): Result.005 file - promoters50/2114115
ggtcgatctatc

SEQ ID NO: 180576 - DNA, 12 bp, Unknown
  misc_feature (1)..( 12): Result.005 file - promoters50/2114115
ttatgatttatt

SEQ ID NO: 180577 - DNA, 12 bp, Unknown
  misc_feature (1)..( 12): Result.005 file - promoters50/2114115
aatggatatata

SEQ ID NO: 180578 - DNA, 12 bp, Unknown
  misc_feature (1)..( 12): Result.005 file - promoters50/2114115
ttatgatttctt

SEQ ID NO: 180579 - DNA, 12 bp, Unknown
  misc_feature (1)..( 12): Result.005 file - promoters50/2114115
ttcggattgctt

SEQ ID NO: 180580 - DNA, 7 bp, Unknown
  misc_feature (1)..( 7): Result.005 file - promoters50/2114119
ttttcta

SEQ ID NO: 180581 - DNA, 7 bp, Unknown
  misc_feature (1)..( 7): Result.005 file - promoters50/2114119
ttttctt

SEQ ID NO: 180582 - DNA, 8 bp, Unknown
  misc_feature (1)..( 8): Result.005 file - promoters50/2114119
tttgtctt

SEQ ID NO: 180583 - DNA, 14 bp, Unknown
  misc_feature (1)..( 14): Result.005 file - promoters50/2114138
taatagatttacgt

SEQ ID NO: 180584 - DNA, 14 bp, Unknown
  misc_feature (1)..( 14): Result.005 file - promoters50/2114138
taatggatctacac

SEQ ID NO: 180585 - DNA, 14 bp, Unknown
  misc_feature (1)..( 14): Result.005 file - promoters50/2114138
ttgatttttttcgt

SEQ ID NO: 180586 - DNA, 14 bp, Unknown
  misc_feature (1)..( 14): Result.005 file - promoters50/2114138
atcttgatgtacat

SEQ ID NO: 180587 - DNA, 14 bp, Unknown
  misc_feature (1)..( 14): Result.005 file - promoters50/2114138
aagtagattctagg

SEQ ID NO: 180588 - DNA, 14 bp, Unknown
  misc_feature (1)..( 14): Result.005 file - promoters50/2114138
caatggattcatat

SEQ ID NO: 180589 - DNA, 9 bp, Unknown
  misc_feature (1)..( 9): Result.005 file - promoters50/2114138
aatgttgga

SEQ ID NO: 180590 - DNA, 9 bp, Unknown
  misc_feature (1)..( 9): Result.005 file - promoters50/2114138
tctgttgga

SEQ ID NO: 180591 - DNA, 9 bp, Unknown
  misc_feature (1)..( 9): Result.005 file - promoters50/2114138
aattttgaa

SEQ ID NO: 180592 - DNA, 9 bp, Unknown
  misc_feature (1)..( 9): Result.005 file - promoters50/2114138
gtttttgaa

SEQ ID NO: 180593 - DNA, 9 bp, Unknown
  misc_feature (1)..( 9): Result.005 file - promoters50/2114138
gtttttgat

SEQ ID NO: 180594 - DNA, 9 bp, Unknown
  misc_feature (1)..( 9): Result.005 file - promoters50/2114138
cattttata

SEQ ID NO: 180595 - DNA, 9 bp, Unknown
  misc_feature (1)..( 9): Result.005 file - promoters50/2114138
tttttggga

SEQ ID NO: 180596 - DNA, 9 bp, Unknown
  misc_feature (1)..( 9): Result.005 file - promoters50/2114138
cttttggtt

SEQ ID NO: 180597 - DNA, 9 bp, Unknown
  misc_feature (1)..( 9): Result.005 file - promoters50/2114138
tttttgggg

SEQ ID NO: 180598 - DNA, 9 bp, Unknown
  misc_feature (1)..( 9): Result.005 file - promoters50/2114138
aatttggtt

SEQ ID NO: 180599 - DNA, 9 bp, Unknown
  misc_feature (1)..( 9): Result.005 file - promoters50/2114138
tttttgata

SEQ ID NO: 180600 - DNA, 9 bp, Unknown
  misc_feature (1)..( 9): Result.005 file - promoters50/2114138
gttttgaag

SEQ ID NO: 180601 - DNA, 7 bp, Unknown
  misc_feature (1)..( 7): Result.005 file - promoters50/2114141
atttata

SEQ ID NO: 180602 - DNA, 7 bp, Unknown
  misc_feature (1)..( 7): Result.005 file - promoters50/2114141
ttttata

SEQ ID NO: 180603 - DNA, 7 bp, Unknown
  misc_feature (1)..( 7): Result.005 file - promoters50/2114141
ttttatt

SEQ ID NO: 180604 - DNA, 9 bp, Unknown
  misc_feature (1)..( 9): Result.005 file - promoters50/2114141
aactttaat

SEQ ID NO: 180605 - DNA, 9 bp, Unknown
  misc_feature (1)..( 9): Result.005 file - promoters50/2114141
tactttatt

SEQ ID NO: 180606 - DNA, 9 bp, Unknown
  misc_feature (1)..( 9): Result.005 file - promoters50/2114141
aaccttaat

SEQ ID NO: 180607 - DNA, 9 bp, Unknown
  misc_feature (1)..( 9): Result.005 file - promoters50/2114141
aaaaagttt

SEQ ID NO: 180608 - DNA, 9 bp, Unknown
  misc_feature (1)..( 9): Result.005 file - promoters50/2114141
aaatagttt

SEQ ID NO: 180609 - DNA, 9 bp, Unknown
  misc_feature (1)..( 9): Result.005 file - promoters50/2114141
ttatagttc

SEQ ID NO: 180610 - DNA, 8 bp, Unknown
  misc_feature (1)..( 8): Result.005 file - promoters50/2114141
ttaagttt

SEQ ID NO: 180611 - DNA, 8 bp, Unknown
  misc_feature (1)..( 8): Result.005 file - promoters50/2114141
ttaatttt

SEQ ID NO: 180612 - DNA, 8 bp, Unknown
  misc_feature (1)..( 8): Result.005 file - promoters50/2114141
ttaattaa

SEQ ID NO: 180613 - DNA, 8 bp, Unknown
  misc_feature (1)..( 8): Result.005 file - promoters50/2114145
tatacaat

SEQ ID NO: 180614 - DNA, 8 bp, Unknown
  misc_feature (1)..( 8): Result.005 file - promoters50/2114145
aatacaaa

SEQ ID NO: 180615 - DNA, 8 bp, Unknown
  misc_feature (1)..( 8): Result.005 file - promoters50/2114145
aatacaaa

SEQ ID NO: 180616 - DNA, 8 bp, Unknown
  misc_feature (1)..( 8): Result.005 file - promoters50/2114145
tatacaaa

SEQ ID NO: 180617 - DNA, 8 bp, Unknown
  misc_feature (1)..( 8): Result.005 file - promoters50/2114145
tataaaat

SEQ ID NO: 180618 - DNA, 9 bp, Unknown
  misc_feature (1)..( 9): Result.005 file - promoters50/2114145
atgattcta

SEQ ID NO: 180619 - DNA, 9 bp, Unknown
  misc_feature (1)..( 9): Result.005 file - promoters50/2114145
tctattcta

SEQ ID NO: 180620 - DNA, 9 bp, Unknown
  misc_feature (1)..( 9): Result.005 file - promoters50/2114145
atgattctt

SEQ ID NO: 180621 - DNA, 9 bp, Unknown
  misc_feature (1)..( 9): Result.005 file - promoters50/2114145
gtgactctc

SEQ ID NO: 180622 - DNA, 9 bp, Unknown
  misc_feature (1)..( 9): Result.005 file - promoters50/2114145
atgattact

SEQ ID NO: 180623 - DNA, 8 bp, Unknown
  misc_feature (1)..( 8): Result.005 file - promoters50/2114145
aaaagaaa

SEQ ID NO: 180624 - DNA, 8 bp, Unknown
  misc_feature (1)..( 8): Result.005 file - promoters50/2114145
aaaataaa

SEQ ID NO: 180625 - DNA, 8 bp, Unknown
  misc_feature (1)..( 8): Result.005 file - promoters50/2114145
taattaac

SEQ ID NO: 180626 - DNA, 8 bp, Unknown
  misc_feature (1)..( 8): Result.005 file - promoters50/2114145
aaattaaa

SEQ ID NO: 180627 - DNA, 8 bp, Unknown
  misc_feature (1)..( 8): Result.005 file - promoters50/2114145
tcaataaa

SEQ ID NO: 180628 - DNA, 13 bp, Unknown
  misc_feature (1)..( 13): Result.005 file - promoters50/2114175
ttttattggtttt

SEQ ID NO: 180629 - DNA, 13 bp, Unknown
  misc_feature (1)..( 13): Result.005 file - promoters50/2114175
cattattgttttt

SEQ ID NO: 180630 - DNA, 13 bp, Unknown
  misc_feature (1)..( 13): Result.005 file - promoters50/2114175
gtttatgttggtc

SEQ ID NO: 180631 - DNA, 9 bp, Unknown
  misc_feature (1)..( 9): Result.005 file - promoters50/2114175
aaaaaaaaa

SEQ ID NO: 180632 - DNA, 9 bp, Unknown
  misc_feature (1)..( 9): Result.005 file - promoters50/2114175
aaataaaaa

SEQ ID NO: 180633 - DNA, 9 bp, Unknown
  misc_feature (1)..( 9): Result.005 file - promoters50/2114175
aaagatggg

SEQ ID NO: 180634 - DNA, 13 bp, Unknown
  misc_feature (1)..( 13): Result.005 file - promoters50/2114175
cattatgggacca

SEQ ID NO: 180635 - DNA, 13 bp, Unknown
  misc_feature (1)..( 13): Result.005 file - promoters50/2114175
cataatgggacca

SEQ ID NO: 180636 - DNA, 13 bp, Unknown
  misc_feature (1)..( 13): Result.005 file - promoters50/2114175
ttccatgggaaag

SEQ ID NO: 180637 - DNA, 10 bp, Unknown
  misc_feature (1)..( 10): Result.005 file - promoters50/2114178
taaaatatga

SEQ ID NO: 180638 - DNA, 10 bp, Unknown
  misc_feature (1)..( 10): Result.005 file - promoters50/2114178
aaaaatagat

SEQ ID NO: 180639 - DNA, 10 bp, Unknown
  misc_feature (1)..( 10): Result.005 file - promoters50/2114178
taaaagatga

SEQ ID NO: 180640 - DNA, 9 bp, Unknown
  misc_feature (1)..( 9): Result.005 file - promoters50/2114178
caatcaaaa

SEQ ID NO: 180641 - DNA, 9 bp, Unknown
  misc_feature (1)..( 9): Result.005 file - promoters50/2114178
gtttcaaaa

SEQ ID NO: 180642 - DNA, 9 bp, Unknown
  misc_feature (1)..( 9): Result.005 file - promoters50/2114178
gtttcaaac

SEQ ID NO: 180643 - DNA, 9 bp, Unknown
  misc_feature (1)..( 9): Result.005 file - promoters50/2114178
ttttcaaac

SEQ ID NO: 180644 - DNA, 9 bp, Unknown
  misc_feature (1)..( 9): Result.005 file - promoters50/2114178
tgatcaaaa

SEQ ID NO: 180645 - DNA, 9 bp, Unknown
  misc_feature (1)..( 9): Result.005 file - promoters50/2114178
gattcaaaa

SEQ ID NO: 180646 - DNA, 9 bp, Unknown
  misc_feature (1)..( 9): Result.005 file - promoters50/2114178
tgatcaaat

SEQ ID NO: 180647 - DNA, 9 bp, Unknown
  misc_feature (1)..( 9): Result.005 file - promoters50/2114178
ttttcaaat

SEQ ID NO: 180648 - DNA, 9 bp, Unknown
  misc_feature (1)..( 9): Result.005 file - promoters50/2114178
tgttttata

SEQ ID NO: 180649 - DNA, 9 bp, Unknown
  misc_feature (1)..( 9): Result.005 file - promoters50/2114178
tgtattatt

SEQ ID NO: 180650 - DNA, 9 bp, Unknown
  misc_feature (1)..( 9): Result.005 file - promoters50/2114178
ttttttttt

SEQ ID NO: 180651 - DNA, 9 bp, Unknown
  misc_feature (1)..( 9): Result.005 file - promoters50/2114178
caaattatt

SEQ ID NO: 180652 - DNA, 14 bp, Unknown
  misc_feature (1)..( 14): Result.005 file - promoters50/2114178
tatagtaaaacagc

SEQ ID NO: 180653 - DNA, 14 bp, Unknown
  misc_feature (1)..( 14): Result.005 file - promoters50/2114178
tatagcaaaactcc

SEQ ID NO: 180654 - DNA, 14 bp, Unknown
  misc_feature (1)..( 14): Result.005 file - promoters50/2114178
ttgagaaaaacatg

SEQ ID NO: 180655 - DNA, 14 bp, Unknown
  misc_feature (1)..( 14): Result.005 file - promoters50/2114178
aagtggaaaaatcc

SEQ ID NO: 180656 - DNA, 8 bp, Unknown
  misc_feature (1)..( 8): Result.005 file - promoters50/2114178
aaaataat

SEQ ID NO: 180657 - DNA, 8 bp, Unknown
  misc_feature (1)..( 8): Result.005 file - promoters50/2114178
aaattaag

SEQ ID NO: 180658 - DNA, 8 bp, Unknown
  misc_feature (1)..( 8): Result.005 file - promoters50/2114178
tcaataat

SEQ ID NO: 180659 - DNA, 10 bp, Unknown
  misc_feature (1)..( 10): Result.005 file - promoters50/2114178
agcaaagtca

SEQ ID NO: 180660 - DNA, 10 bp, Unknown
  misc_feature (1)..( 10): Result.005 file - promoters50/2114178
agcaaaggaa

SEQ ID NO: 180661 - DNA, 10 bp, Unknown
  misc_feature (1)..( 10): Result.005 file - promoters50/2114178
atcaaaggaa

SEQ ID NO: 180662 - DNA, 9 bp, Unknown
  misc_feature (1)..( 9): Result.005 file - promoters50/2114200
ttcatcttc

SEQ ID NO: 180663 - DNA, 9 bp, Unknown
  misc_feature (1)..( 9): Result.005 file - promoters50/2114200
ttcttcttc

SEQ ID NO: 180664 - DNA, 9 bp, Unknown
  misc_feature (1)..( 9): Result.005 file - promoters50/2114200
cgcatcttt

SEQ ID NO: 180665 - DNA, 9 bp, Unknown
  misc_feature (1)..( 9): Result.005 file - promoters50/2114200
gtcttcttt

SEQ ID NO: 180666 - DNA, 9 bp, Unknown
  misc_feature (1)..( 9): Result.005 file - promoters50/2114200
gccttattt

SEQ ID NO: 180667 - DNA, 10 bp, Unknown
  misc_feature (1)..( 10): Result.005 file - promoters50/2114200
aaaatccttg

SEQ ID NO: 180668 - DNA, 14 bp, Unknown
  misc_feature (1)..( 14): Result.005 file - promoters50/2169576
agagctaaaaacgg

SEQ ID NO: 180669 - DNA, 14 bp, Unknown
  misc_feature (1)..( 14): Result.005 file - promoters50/2169576
ttttctataaatta

SEQ ID NO: 180670 - DNA, 14 bp, Unknown
  misc_feature (1)..( 14): Result.005 file - promoters50/2169576
tcagatatacattg

SEQ ID NO: 180671 - DNA, 14 bp, Unknown
  misc_feature (1)..( 14): Result.005 file - promoters50/2169576
acggatttacttga

SEQ ID NO: 180672 - DNA, 14 bp, Unknown
  misc_feature (1)..( 14): Result.005 file - promoters50/2169576
ttttttatagatta

SEQ ID NO: 180673 - DNA, 14 bp, Unknown
  misc_feature (1)..( 14): Result.005 file - promoters50/2169576
acttttttttctga

SEQ ID NO: 180674 - DNA, 14 bp, Unknown
  misc_feature (1)..( 14): Result.005 file - promoters50/2169576
tgacttttctttct

SEQ ID NO: 180675 - DNA, 14 bp, Unknown
  misc_feature (1)..( 14): Result.005 file - promoters50/2169576
caaattttttttct

SEQ ID NO: 180676 - DNA, 14 bp, Unknown
  misc_feature (1)..( 14): Result.005 file - promoters50/2169576
aaactttttttaca

SEQ ID NO: 180677 - DNA, 14 bp, Unknown
  misc_feature (1)..( 14): Result.005 file - promoters50/2169576
tagtttttcttatc

SEQ ID NO: 180678 - DNA, 14 bp, Unknown
  misc_feature (1)..( 14): Result.005 file - promoters50/2169576
ccaatttttagtca

SEQ ID NO: 180679 - DNA, 14 bp, Unknown
  misc_feature (1)..( 14): Result.005 file - promoters50/2169576
aaagttttgagcta

SEQ ID NO: 180680 - DNA, 13 bp, Unknown
  misc_feature (1)..( 13): Result.005 file - promoters50/2169576
tacaatataaaca

SEQ ID NO: 180681 - DNA, 13 bp, Unknown
  misc_feature (1)..( 13): Result.005 file - promoters50/2169576
tcatatatataca

SEQ ID NO: 180682 - DNA, 13 bp, Unknown
  misc_feature (1)..( 13): Result.005 file - promoters50/2169576
tcacatattaaca

SEQ ID NO: 180683 - DNA, 13 bp, Unknown
  misc_feature (1)..( 13): Result.005 file - promoters50/2169576
gtatatataaaga

SEQ ID NO: 180684 - DNA, 13 bp, Unknown
  misc_feature (1)..( 13): Result.005 file - promoters50/2169576
tctcatataaata

SEQ ID NO: 180685 - DNA, 13 bp, Unknown
  misc_feature (1)..( 13): Result.005 file - promoters50/2169576
actcatatatatc

SEQ ID NO: 180686 - DNA, 10 bp, Unknown
  misc_feature (1)..( 10): Result.005 file - promoters50/2184050
aaattattaa

SEQ ID NO: 180687 - DNA, 10 bp, Unknown
  misc_feature (1)..( 10): Result.005 file - promoters50/2184050
aaattactat

SEQ ID NO: 180688 - DNA, 10 bp, Unknown
  misc_feature (1)..( 10): Result.005 file - promoters50/2184050
taattactaa

SEQ ID NO: 180689 - DNA, 9 bp, Unknown
  misc_feature (1)..( 9): Result.005 file - promoters50/2184050
aatataaat

SEQ ID NO: 180690 - DNA, 9 bp, Unknown
  misc_feature (1)..( 9): Result.005 file - promoters50/2184050
gttattaat

SEQ ID NO: 180691 - DNA, 9 bp, Unknown
  misc_feature (1)..( 9): Result.005 file - promoters50/2184050
aatataatt

SEQ ID NO: 180692 - DNA, 13 bp, Unknown
  misc_feature (1)..( 13): Result.005 file - promoters50/2185389
caaaagaaaaaat

SEQ ID NO: 180693 - DNA, 13 bp, Unknown
  misc_feature (1)..( 13): Result.005 file - promoters50/2185389
actaagaaatatg

SEQ ID NO: 180694 - DNA, 13 bp, Unknown
  misc_feature (1)..( 13): Result.005 file - promoters50/2185389
ctgaagaacaaat

SEQ ID NO: 180695 - DNA, 13 bp, Unknown
  misc_feature (1)..( 13): Result.005 file - promoters50/2185389
ttgaagaaaattt

SEQ ID NO: 180696 - DNA, 13 bp, Unknown
  misc_feature (1)..( 13): Result.005 file - promoters50/2185389
aaaaagaagaagg

SEQ ID NO: 180697 - DNA, 13 bp, Unknown
  misc_feature (1)..( 13): Result.005 file - promoters50/2185389
ctgatgaaacaga

SEQ ID NO: 180698 - DNA, 10 bp, Unknown
  misc_feature (1)..( 10): Result.005 file - promoters50/2185389
acaaaaacat

SEQ ID NO: 180699 - DNA, 10 bp, Unknown
  misc_feature (1)..( 10): Result.005 file - promoters50/2185389
acaaaagagc

SEQ ID NO: 180700 - DNA, 10 bp, Unknown
  misc_feature (1)..( 10): Result.005 file - promoters50/2185389
acaaaaaata

SEQ ID NO: 180701 - DNA, 10 bp, Unknown
  misc_feature (1)..( 10): Result.005 file - promoters50/2185389
acaagagaga

SEQ ID NO: 180702 - DNA, 10 bp, Unknown
  misc_feature (1)..( 10): Result.005 file - promoters50/2185389
tcaaaagtga

SEQ ID NO: 180703 - DNA, 10 bp, Unknown
  misc_feature (1)..( 10): Result.005 file - promoters50/2185389
ccaatagaaa

SEQ ID NO: 180704 - DNA, 10 bp, Unknown
  misc_feature (1)..( 10): Result.005 file - promoters50/2185389
gtcaaagaaa

SEQ ID NO: 180705 - DNA, 11 bp, Unknown
  misc_feature (1)..( 11): Result.005 file - promoters50/2187156
ccataattagt

SEQ ID NO: 180706 - DNA, 11 bp, Unknown
  misc_feature (1)..( 11): Result.005 file - promoters50/2187156
ccagaattaag

SEQ ID NO: 180707 - DNA, 11 bp, Unknown
  misc_feature (1)..( 11): Result.005 file - promoters50/2187156
tcataattttg

SEQ ID NO: 180708 - DNA, 11 bp, Unknown
  misc_feature (1)..( 11): Result.005 file - promoters50/2187156
aaatacttaag

SEQ ID NO: 180709 - DNA, 11 bp, Unknown
  misc_feature (1)..( 11): Result.005 file - promoters50/2187156
atgtaattaag

SEQ ID NO: 180710 - DNA, 11 bp, Unknown
  misc_feature (1)..( 11): Result.005 file - promoters50/2187156
tcagaattctg

SEQ ID NO: 180711 - DNA, 11 bp, Unknown
  misc_feature (1)..( 11): Result.005 file - promoters50/2187156
tcagatttacg

SEQ ID NO: 180712 - DNA, 11 bp, Unknown
  misc_feature (1)..( 11): Result.005 file - promoters50/2187156
tcacatttgtt

SEQ ID NO: 180713 - DNA, 12 bp, Unknown
  misc_feature (1)..( 12): Result.005 file - promoters50/2187156
tggtacataatt

SEQ ID NO: 180714 - DNA, 12 bp, Unknown
  misc_feature (1)..( 12): Result.005 file - promoters50/2187156
atgtaaataaaa

SEQ ID NO: 180715 - DNA, 12 bp, Unknown
  misc_feature (1)..( 12): Result.005 file - promoters50/2187156
gtgtaaaaatag

SEQ ID NO: 180716 - DNA, 12 bp, Unknown
  misc_feature (1)..( 12): Result.005 file - promoters50/2187156
agtaaaattaaa

SEQ ID NO: 180717 - DNA, 12 bp, Unknown
  misc_feature (1)..( 12): Result.005 file - promoters50/2187156
atgcaaaatctc

SEQ ID NO: 180718 - DNA, 12 bp, Unknown
  misc_feature (1)..( 12): Result.005 file - promoters50/2187156
atggaaacgacg

SEQ ID NO: 180719 - DNA, 9 bp, Unknown
  misc_feature (1)..( 9): Result.005 file - promoters50/2187156
tcacaattg

SEQ ID NO: 180720 - DNA, 9 bp, Unknown
  misc_feature (1)..( 9): Result.005 file - promoters50/2187156
tcagaattc

SEQ ID NO: 180721 - DNA, 9 bp, Unknown
  misc_feature (1)..( 9): Result.005 file - promoters50/2187156
tcacatttg

SEQ ID NO: 180722 - DNA, 9 bp, Unknown
  misc_feature (1)..( 9): Result.005 file - promoters50/2187156
ccagaatta

SEQ ID NO: 180723 - DNA, 9 bp, Unknown
  misc_feature (1)..( 9): Result.005 file - promoters50/2187156
tcagattta

SEQ ID NO: 180724 - DNA, 9 bp, Unknown
  misc_feature (1)..( 9): Result.005 file - promoters50/2187156
gtagatttg

SEQ ID NO: 180725 - DNA, 8 bp, Unknown
  misc_feature (1)..( 8): Result.005 file - promoters50/2217752
tgatcgaa

SEQ ID NO: 180726 - DNA, 8 bp, Unknown
  misc_feature (1)..( 8): Result.005 file - promoters50/2217752
agatggaa

SEQ ID NO: 180727 - DNA, 8 bp, Unknown
  misc_feature (1)..( 8): Result.005 file - promoters50/2217752
agatcgat

SEQ ID NO: 180728 - DNA, 8 bp, Unknown
  misc_feature (1)..( 8): Result.005 file - promoters50/2217752
agacggag

SEQ ID NO: 180729 - DNA, 8 bp, Unknown
  misc_feature (1)..( 8): Result.005 file - promoters50/2217752
tgatggat

SEQ ID NO: 180730 - DNA, 11 bp, Unknown
  misc_feature (1)..( 11): Result.005 file - promoters50/2217794
agaaacagagg

SEQ ID NO: 180731 - DNA, 11 bp, Unknown
  misc_feature (1)..( 11): Result.005 file - promoters50/2217794
agaaaaagaaa

SEQ ID NO: 180732 - DNA, 11 bp, Unknown
  misc_feature (1)..( 11): Result.005 file - promoters50/2217794
aaaaacagagt

SEQ ID NO: 180733 - DNA, 11 bp, Unknown
  misc_feature (1)..( 11): Result.005 file - promoters50/2217794
ccaaaatgaaa

SEQ ID NO: 180734 - DNA, 11 bp, Unknown
  misc_feature (1)..( 11): Result.005 file - promoters50/2217794
caaaaaataaa

SEQ ID NO: 180735 - DNA, 11 bp, Unknown
  misc_feature (1)..( 11): Result.005 file - promoters50/2217794
ttatccagagt

SEQ ID NO: 180736 - DNA, 12 bp, Unknown
  misc_feature (1)..( 12): Result.005 file - promoters50/2217996
ccagtttatgaa

SEQ ID NO: 180737 - DNA, 12 bp, Unknown
  misc_feature (1)..( 12): Result.005 file - promoters50/2217996
tcagtttctcga

SEQ ID NO: 180738 - DNA, 12 bp, Unknown
  misc_feature (1)..( 12): Result.005 file - promoters50/2217996
tcaattttgcta

SEQ ID NO: 180739 - DNA, 12 bp, Unknown
  misc_feature (1)..( 12): Result.005 file - promoters50/2217996
tcatttttggtt

SEQ ID NO: 180740 - DNA, 12 bp, Unknown
  misc_feature (1)..( 12): Result.005 file - promoters50/2217996
attgttttggtt

SEQ ID NO: 180741 - DNA, 12 bp, Unknown
  misc_feature (1)..( 12): Result.005 file - promoters50/2217996
tcggttttgcag

SEQ ID NO: 180742 - DNA, 8 bp, Unknown
  misc_feature (1)..( 8): Result.005 file - promoters50/2218016
taagaatt

SEQ ID NO: 180743 - DNA, 8 bp, Unknown
  misc_feature (1)..( 8): Result.005 file - promoters50/2218016
taagaaac

SEQ ID NO: 180744 - DNA, 8 bp, Unknown
  misc_feature (1)..( 8): Result.005 file - promoters50/2218016
aaagaaac

SEQ ID NO: 180745 - DNA, 8 bp, Unknown
  misc_feature (1)..( 8): Result.005 file - promoters50/2218184
tcaaaatc

SEQ ID NO: 180746 - DNA, 8 bp, Unknown
  misc_feature (1)..( 8): Result.005 file - promoters50/2218184
ttaaaatc

SEQ ID NO: 180747 - DNA, 8 bp, Unknown
  misc_feature (1)..( 8): Result.005 file - promoters50/2218184
ttataatg

SEQ ID NO: 180748 - DNA, 10 bp, Unknown
  misc_feature (1)..( 10): Result.005 file - promoters50/2218184
acttcataga

SEQ ID NO: 180749 - DNA, 10 bp, Unknown
  misc_feature (1)..( 10): Result.005 file - promoters50/2218184
actttataat

SEQ ID NO: 180750 - DNA, 10 bp, Unknown
  misc_feature (1)..( 10): Result.005 file - promoters50/2218184
acattaaaat

SEQ ID NO: 180751 - DNA, 9 bp, Unknown
  misc_feature (1)..( 9): Result.005 file - promoters50/2218259
agatatttt

SEQ ID NO: 180752 - DNA, 9 bp, Unknown
  misc_feature (1)..( 9): Result.005 file - promoters50/2218259
agatattct

SEQ ID NO: 180753 - DNA, 9 bp, Unknown
  misc_feature (1)..( 9): Result.005 file - promoters50/2218259
tcatatttt

SEQ ID NO: 180754 - DNA, 10 bp, Unknown
  misc_feature (1)..( 10): Result.005 file - promoters50/2218260
ctataaatac

SEQ ID NO: 180755 - DNA, 10 bp, Unknown
  misc_feature (1)..( 10): Result.005 file - promoters50/2218260
gtatatatat

SEQ ID NO: 180756 - DNA, 10 bp, Unknown
  misc_feature (1)..( 10): Result.005 file - promoters50/2218260
atataaatcc

SEQ ID NO: 180757 - DNA, 10 bp, Unknown
  misc_feature (1)..( 10): Result.005 file - promoters50/2218260
gtatttatat

SEQ ID NO: 180758 - DNA, 10 bp, Unknown
  misc_feature (1)..( 10): Result.005 file - promoters50/2218260
caataaaaag

SEQ ID NO: 180759 - DNA, 10 bp, Unknown
  misc_feature (1)..( 10): Result.005 file - promoters50/2218260
cgatttataa

SEQ ID NO: 180760 - DNA, 12 bp, Unknown
  misc_feature (1)..( 12): Result.005 file - promoters50/2218271
ccaaacccaaga

SEQ ID NO: 180761 - DNA, 12 bp, Unknown
  misc_feature (1)..( 12): Result.005 file - promoters50/2218271
tcaaacctgaat

SEQ ID NO: 180762 - DNA, 12 bp, Unknown
  misc_feature (1)..( 12): Result.005 file - promoters50/2218271
gccaaccccaat

SEQ ID NO: 180763 - DNA, 12 bp, Unknown
  misc_feature (1)..( 12): Result.005 file - promoters50/2218271
aaaaactggaga

SEQ ID NO: 180764 - DNA, 12 bp, Unknown
  misc_feature (1)..( 12): Result.005 file - promoters50/2218271
taaaaattggta

SEQ ID NO: 180765 - DNA, 12 bp, Unknown
  misc_feature (1)..( 12): Result.005 file - promoters50/2218271
tcaaaaaaaaaa

SEQ ID NO: 180766 - DNA, 12 bp, Unknown
  misc_feature (1)..( 12): Result.005 file - promoters50/2218271
gaaaaaaaagtt

SEQ ID NO: 180767 - DNA, 11 bp, Unknown
  misc_feature (1)..( 11): Result.005 file - promoters50/2685671
gtattattcaa

SEQ ID NO: 180768 - DNA, 11 bp, Unknown
  misc_feature (1)..( 11): Result.005 file - promoters50/2685671
atatttttcat

SEQ ID NO: 180769 - DNA, 11 bp, Unknown
  misc_feature (1)..( 11): Result.005 file - promoters50/2685671
gaattgaaaca

SEQ ID NO: 180770 - DNA, 11 bp, Unknown
  misc_feature (1)..( 11): Result.005 file - promoters50/2685671
gtataattctt

SEQ ID NO: 180771 - DNA, 11 bp, Unknown
  misc_feature (1)..( 11): Result.005 file - promoters50/2685671
catatatacaa

SEQ ID NO: 180772 - DNA, 11 bp, Unknown
  misc_feature (1)..( 11): Result.005 file - promoters50/2685671
gtttgatttga

SEQ ID NO: 180773 - DNA, 13 bp, Unknown
  misc_feature (1)..( 13): Result.005 file - promoters50/2685671
gaagcccataagg

SEQ ID NO: 180774 - DNA, 13 bp, Unknown
  misc_feature (1)..( 13): Result.005 file - promoters50/2685671
tcggcccatcaaa

SEQ ID NO: 180775 - DNA, 13 bp, Unknown
  misc_feature (1)..( 13): Result.005 file - promoters50/2685671
tgggcctataagg

SEQ ID NO: 180776 - DNA, 13 bp, Unknown
  misc_feature (1)..( 13): Result.005 file - promoters50/2685671
aaagcccaatata

SEQ ID NO: 180777 - DNA, 13 bp, Unknown
  misc_feature (1)..( 13): Result.005 file - promoters50/2685671
aaagccctaatat

SEQ ID NO: 180778 - DNA, 13 bp, Unknown
  misc_feature (1)..( 13): Result.005 file - promoters50/2685671
aaggcccaataac

SEQ ID NO: 180779 - DNA, 9 bp, Unknown
  misc_feature (1)..( 9): Result.005 file - promoters50/2685671
agaaaaatc

SEQ ID NO: 180780 - DNA, 9 bp, Unknown
  misc_feature (1)..( 9): Result.005 file - promoters50/2685671
ataaaaata

SEQ ID NO: 180781 - DNA, 9 bp, Unknown
  misc_feature (1)..( 9): Result.005 file - promoters50/2685671
tgaaaaata

SEQ ID NO: 180782 - DNA, 9 bp, Unknown
  misc_feature (1)..( 9): Result.005 file - promoters50/2685671
tgaaaagaa

SEQ ID NO: 180783 - DNA, 9 bp, Unknown
  misc_feature (1)..( 9): Result.005 file - promoters50/2685671
agaaaaaaa

SEQ ID NO: 180784 - DNA, 9 bp, Unknown
  misc_feature (1)..( 9): Result.005 file - promoters50/2685671
tcaaatata

SEQ ID NO: 180785 - DNA, 8 bp, Unknown
  misc_feature (1)..( 8): Result.005 file - promoters50/2685671
gttacaaa

SEQ ID NO: 180786 - DNA, 8 bp, Unknown
  misc_feature (1)..( 8): Result.005 file - promoters50/2685671
tttaaaaa

SEQ ID NO: 180787 - DNA, 8 bp, Unknown
  misc_feature (1)..( 8): Result.005 file - promoters50/2685671
attaaaaa

SEQ ID NO: 180788 - DNA, 8 bp, Unknown
  misc_feature (1)..( 8): Result.005 file - promoters50/2685671
tttagaaa

SEQ ID NO: 180789 - DNA, 8 bp, Unknown
  misc_feature (1)..( 8): Result.005 file - promoters50/2685671
tttaaaat

SEQ ID NO: 180790 - DNA, 8 bp, Unknown
  misc_feature (1)..( 8): Result.005 file - promoters50/2685671
cttagaaa

SEQ ID NO: 180791 - DNA, 10 bp, Unknown
  misc_feature (1)..( 10): Result.005 file - promoters50/2685712
ggtttaggtg

SEQ ID NO: 180792 - DNA, 10 bp, Unknown
  misc_feature (1)..( 10): Result.005 file - promoters50/2685712
ggtttaggtg

SEQ ID NO: 180793 - DNA, 10 bp, Unknown
  misc_feature (1)..( 10): Result.005 file - promoters50/2685712
tgttttggtt

SEQ ID NO: 180794 - DNA, 10 bp, Unknown
  misc_feature (1)..( 10): Result.005 file - promoters50/2685712
ggtttagttg

SEQ ID NO: 180795 - DNA, 10 bp, Unknown
  misc_feature (1)..( 10): Result.005 file - promoters50/2685712
ggttttgaaa

SEQ ID NO: 180796 - DNA, 8 bp, Unknown
  misc_feature (1)..( 8): Result.005 file - promoters50/2685712
tctcattg

SEQ ID NO: 180797 - DNA, 8 bp, Unknown
  misc_feature (1)..( 8): Result.005 file - promoters50/2685712
tcttatta

SEQ ID NO: 180798 - DNA, 8 bp, Unknown
  misc_feature (1)..( 8): Result.005 file - promoters50/2685712
tcttttaa

SEQ ID NO: 180799 - DNA, 8 bp, Unknown
  misc_feature (1)..( 8): Result.005 file - promoters50/2685712
tattttaa

SEQ ID NO: 180800 - DNA, 8 bp, Unknown
  misc_feature (1)..( 8): Result.005 file - promoters50/2685725
ttataatg

SEQ ID NO: 180801 - DNA, 8 bp, Unknown
  misc_feature (1)..( 8): Result.005 file - promoters50/2685725
ctatcatg

SEQ ID NO: 180802 - DNA, 8 bp, Unknown
  misc_feature (1)..( 8): Result.005 file - promoters50/2685725
ttataaac

SEQ ID NO: 180803 - DNA, 9 bp, Unknown
  misc_feature (1)..( 9): Result.005 file - promoters50/2685725
gtaaggttc

SEQ ID NO: 180804 - DNA, 9 bp, Unknown
  misc_feature (1)..( 9): Result.005 file - promoters50/2685725
agaaggttc

SEQ ID NO: 180805 - DNA, 9 bp, Unknown
  misc_feature (1)..( 9): Result.005 file - promoters50/2685725
agatggttc

SEQ ID NO: 180806 - DNA, 11 bp, Unknown
  misc_feature (1)..( 11): Result.005 file - promoters50/2685725
gaagagttatt

SEQ ID NO: 180807 - DNA, 11 bp, Unknown
  misc_feature (1)..( 11): Result.005 file - promoters50/2685725
gaaaagttaaa

SEQ ID NO: 180808 - DNA, 11 bp, Unknown
  misc_feature (1)..( 11): Result.005 file - promoters50/2685725
tgaaagtcaaa

SEQ ID NO: 180809 - DNA, 21 bp, Unknown
  misc_feature (1)..( 21): Result.005 file - promoters50/2685873
aaataacaattgaagaacttc

SEQ ID NO: 180810 - DNA, 21 bp, Unknown
  misc_feature (1)..( 21): Result.005 file - promoters50/2685873
agaaaacaattttctatcaac

SEQ ID NO: 180811 - DNA, 21 bp, Unknown
  misc_feature (1)..( 21): Result.005 file - promoters50/2685873
aaattacaaaaaaattcacgg

SEQ ID NO: 180812 - DNA, 21 bp, Unknown
  misc_feature (1)..( 21): Result.005 file - promoters50/2685873
tttattcaattttttaaatta

SEQ ID NO: 180813 - DNA, 21 bp, Unknown
  misc_feature (1)..( 21): Result.005 file - promoters50/2685873
aatgagaaatttataaagaaa

SEQ ID NO: 180814 - DNA, 21 bp, Unknown
  misc_feature (1)..( 21): Result.005 file - promoters50/2685873
tccaatcaatctttaagcttg

SEQ ID NO: 180815 - DNA, 13 bp, Unknown
  misc_feature (1)..( 13): Result.005 file - promoters50/2685873
aagaacttctaag

SEQ ID NO: 180816 - DNA, 13 bp, Unknown
  misc_feature (1)..( 13): Result.005 file - promoters50/2685873
aagaaccaatggt

SEQ ID NO: 180817 - DNA, 13 bp, Unknown
  misc_feature (1)..( 13): Result.005 file - promoters50/2685873
aagatcttttagt

SEQ ID NO: 180818 - DNA, 13 bp, Unknown
  misc_feature (1)..( 13): Result.005 file - promoters50/2685873
ttgatcttaccag

SEQ ID NO: 180819 - DNA, 13 bp, Unknown
  misc_feature (1)..( 13): Result.005 file - promoters50/2685873
tcaatctttaagc

SEQ ID NO: 180820 - DNA, 13 bp, Unknown
  misc_feature (1)..( 13): Result.005 file - promoters50/2685873
ttattcaattttt

SEQ ID NO: 180821 - DNA, 10 bp, Unknown
  misc_feature (1)..( 10): Result.005 file - promoters50/2685873
ctataagaac

SEQ ID NO: 180822 - DNA, 10 bp, Unknown
  misc_feature (1)..( 10): Result.005 file - promoters50/2685873
ctataaatat

SEQ ID NO: 180823 - DNA, 10 bp, Unknown
  misc_feature (1)..( 10): Result.005 file - promoters50/2685873
ctataaaaaa

SEQ ID NO: 180824 - DNA, 10 bp, Unknown
  misc_feature (1)..( 10): Result.005 file - promoters50/2685873
atataaatag

SEQ ID NO: 180825 - DNA, 10 bp, Unknown
  misc_feature (1)..( 10): Result.005 file - promoters50/2685873
atataaataa

SEQ ID NO: 180826 - DNA, 10 bp, Unknown
  misc_feature (1)..( 10): Result.005 file - promoters50/2685873
atataaacac

SEQ ID NO: 180827 - DNA, 10 bp, Unknown
  misc_feature (1)..( 10): Result.005 file - promoters50/2685873
aaataaaaaa

SEQ ID NO: 180828 - DNA, 8 bp, Unknown
  misc_feature (1)..( 8): Result.005 file - promoters50/2685877
cttgttta

SEQ ID NO: 180829 - DNA, 8 bp, Unknown
  misc_feature (1)..( 8): Result.005 file - promoters50/2685877
cttgttct

SEQ ID NO: 180830 - DNA, 9 bp, Unknown
  misc_feature (1)..( 9): Result.005 file - promoters50/2685877
tttgattat

SEQ ID NO: 180831 - DNA, 9 bp, Unknown
  misc_feature (1)..( 9): Result.005 file - promoters50/2685877
tttgatatt

SEQ ID NO: 180832 - DNA, 8 bp, Unknown
  misc_feature (1)..( 8): Result.005 file - promoters50/2685877
ccatatta

SEQ ID NO: 180833 - DNA, 8 bp, Unknown
  misc_feature (1)..( 8): Result.005 file - promoters50/2685877
tgatatta

SEQ ID NO: 180834 - DNA, 8 bp, Unknown
  misc_feature (1)..( 8): Result.005 file - promoters50/2685877
ccaaattc

SEQ ID NO: 180835 - DNA, 8 bp, Unknown
  misc_feature (1)..( 8): Result.005 file - promoters50/2685877
tgatattt

SEQ ID NO: 180836 - DNA, 11 bp, Unknown
  misc_feature (1)..( 11): Result.005 file - promoters50/2685877
ttggactattg

SEQ ID NO: 180837 - DNA, 11 bp, Unknown
  misc_feature (1)..( 11): Result.005 file - promoters50/2685877
gtggaatatat

SEQ ID NO: 180838 - DNA, 11 bp, Unknown
  misc_feature (1)..( 11): Result.005 file - promoters50/2685877
ttgcactaaaa

SEQ ID NO: 180839 - DNA, 11 bp, Unknown
  misc_feature (1)..( 11): Result.005 file - promoters50/2685877
caccaccaaaa

SEQ ID NO: 180840 - DNA, 17 bp, Unknown
  misc_feature (1)..( 17): Result.005 file - promoters50/2685931
cagttctctttgatggg

SEQ ID NO: 180841 - DNA, 17 bp, Unknown
  misc_feature (1)..( 17): Result.005 file - promoters50/2685931
atttattctttgaactt

SEQ ID NO: 180842 - DNA, 18 bp, Unknown
  misc_feature (1)..( 18): Result.005 file - promoters50/2685931
gacgattctgtttcgacc

SEQ ID NO: 180843 - DNA, 18 bp, Unknown
  misc_feature (1)..( 18): Result.005 file - promoters50/2685931
ttgagatcttggaagcaa

SEQ ID NO: 180844 - DNA, 18 bp, Unknown
  misc_feature (1)..( 18): Result.005 file - promoters50/2685931
attaattatttcttacag

SEQ ID NO: 180845 - DNA, 18 bp, Unknown
  misc_feature (1)..( 18): Result.005 file - promoters50/2685931
tataattattttaactta

SEQ ID NO: 180846 - DNA, 9 bp, Unknown
  misc_feature (1)..( 9): Result.005 file - promoters50/2685931
cacatcaaa

SEQ ID NO: 180847 - DNA, 9 bp, Unknown
  misc_feature (1)..( 9): Result.005 file - promoters50/2685931
aacattaaa

SEQ ID NO: 180848 - DNA, 9 bp, Unknown
  misc_feature (1)..( 9): Result.005 file - promoters50/2685931
cacattatc

SEQ ID NO: 180849 - DNA, 9 bp, Unknown
  misc_feature (1)..( 9): Result.005 file - promoters50/2685931
aacatttaa

SEQ ID NO: 180850 - DNA, 9 bp, Unknown
  misc_feature (1)..( 9): Result.005 file - promoters50/2685931
tttattaaa

SEQ ID NO: 180851 - DNA, 9 bp, Unknown
  misc_feature (1)..( 9): Result.005 file - promoters50/2685931
aaccttttt

SEQ ID NO: 180852 - DNA, 9 bp, Unknown
  misc_feature (1)..( 9): Result.005 file - promoters50/2685931
gttattaat

SEQ ID NO: 180853 - DNA, 8 bp, Unknown
  misc_feature (1)..( 8): Result.005 file - promoters50/2685931
atttgttt

SEQ ID NO: 180854 - DNA, 8 bp, Unknown
  misc_feature (1)..( 8): Result.005 file - promoters50/2685931
atttattt

SEQ ID NO: 180855 - DNA, 8 bp, Unknown
  misc_feature (1)..( 8): Result.005 file - promoters50/2685931
attcgttt

SEQ ID NO: 180856 - DNA, 8 bp, Unknown
  misc_feature (1)..( 8): Result.005 file - promoters50/2685931
ctttatta

SEQ ID NO: 180857 - DNA, 8 bp, Unknown
  misc_feature (1)..( 8): Result.005 file - promoters50/2685931
atttattt

SEQ ID NO: 180858 - DNA, 8 bp, Unknown
  misc_feature (1)..( 8): Result.005 file - promoters50/2685931
atttattg

SEQ ID NO: 180859 - DNA, 11 bp, Unknown
  misc_feature (1)..( 11): Result.005 file - promoters50/2685951
atctaaaatca

SEQ ID NO: 180860 - DNA, 11 bp, Unknown
  misc_feature (1)..( 11): Result.005 file - promoters50/2685951
atctgaaatat

SEQ ID NO: 180861 - DNA, 11 bp, Unknown
  misc_feature (1)..( 11): Result.005 file - promoters50/2685951
ttataaaatac

SEQ ID NO: 180862 - DNA, 11 bp, Unknown
  misc_feature (1)..( 11): Result.005 file - promoters50/2685951
ttctaaaatct

SEQ ID NO: 180863 - DNA, 11 bp, Unknown
  misc_feature (1)..( 11): Result.005 file - promoters50/2685951
atcagaagaag

SEQ ID NO: 180864 - DNA, 11 bp, Unknown
  misc_feature (1)..( 11): Result.005 file - promoters50/2685951
gtttgatatat

SEQ ID NO: 180865 - DNA, 11 bp, Unknown
  misc_feature (1)..( 11): Result.005 file - promoters50/2685951
caatgatattc

SEQ ID NO: 180866 - DNA, 14 bp, Unknown
  misc_feature (1)..( 14): Result.005 file - promoters50/2685951
aaaaattaacaaac

SEQ ID NO: 180867 - DNA, 14 bp, Unknown
  misc_feature (1)..( 14): Result.005 file - promoters50/2685951
aaaaagtaaacata

SEQ ID NO: 180868 - DNA, 14 bp, Unknown
  misc_feature (1)..( 14): Result.005 file - promoters50/2685951
aaaaatctcgtgtg

SEQ ID NO: 180869 - DNA, 14 bp, Unknown
  misc_feature (1)..( 14): Result.005 file - promoters50/2685951
aaagatcataaaat

SEQ ID NO: 180870 - DNA, 14 bp, Unknown
  misc_feature (1)..( 14): Result.005 file - promoters50/2685951
ctagatcatgaaat

SEQ ID NO: 180871 - DNA, 14 bp, Unknown
  misc_feature (1)..( 14): Result.005 file - promoters50/2685951
ggagatcaaatagg

SEQ ID NO: 180872 - DNA, 8 bp, Unknown
  misc_feature (1)..( 8): Result.005 file - promoters50/2685968
agaagata

SEQ ID NO: 180873 - DNA, 8 bp, Unknown
  misc_feature (1)..( 8): Result.005 file - promoters50/2685968
tgaaaata

SEQ ID NO: 180874 - DNA, 8 bp, Unknown
  misc_feature (1)..( 8): Result.005 file - promoters50/2685968
tgacaatt

SEQ ID NO: 180875 - DNA, 8 bp, Unknown
  misc_feature (1)..( 8): Result.005 file - promoters50/2685968
tcaaaata

SEQ ID NO: 180876 - DNA, 8 bp, Unknown
  misc_feature (1)..( 8): Result.005 file - promoters50/2685968
tgaaaagg

SEQ ID NO: 180877 - DNA, 8 bp, Unknown
  misc_feature (1)..( 8): Result.005 file - promoters50/2685968
gaacaaat

SEQ ID NO: 180878 - DNA, 8 bp, Unknown
  misc_feature (1)..( 8): Result.005 file - promoters50/2685968
gaacaata

SEQ ID NO: 180879 - DNA, 8 bp, Unknown
  misc_feature (1)..( 8): Result.005 file - promoters50/2685968
aaacaaaa

SEQ ID NO: 180880 - DNA, 8 bp, Unknown
  misc_feature (1)..( 8): Result.005 file - promoters50/2685968
aaagaaaa

SEQ ID NO: 180881 - DNA, 10 bp, Unknown
  misc_feature (1)..( 10): Result.005 file - promoters50/2685968
tattatttgt

SEQ ID NO: 180882 - DNA, 10 bp, Unknown
  misc_feature (1)..( 10): Result.005 file - promoters50/2685968
aattatgtgt

SEQ ID NO: 180883 - DNA, 10 bp, Unknown
  misc_feature (1)..( 10): Result.005 file - promoters50/2685968
tattttttta

SEQ ID NO: 180884 - DNA, 10 bp, Unknown
  misc_feature (1)..( 10): Result.005 file - promoters50/2685968
ttttattttg

SEQ ID NO: 180885 - DNA, 10 bp, Unknown
  misc_feature (1)..( 10): Result.005 file - promoters50/2685968
aattatttta

SEQ ID NO: 180886 - DNA, 10 bp, Unknown
  misc_feature (1)..( 10): Result.005 file - promoters50/2685968
tgtcaaacat

SEQ ID NO: 180887 - DNA, 10 bp, Unknown
  misc_feature (1)..( 10): Result.005 file - promoters50/2685968
tgttaaaagc

SEQ ID NO: 180888 - DNA, 10 bp, Unknown
  misc_feature (1)..( 10): Result.005 file - promoters50/2685968
ttttaaaaaa

SEQ ID NO: 180889 - DNA, 11 bp, Unknown
  misc_feature (1)..( 11): Result.005 file - promoters50/2685968
cattaacaaat

SEQ ID NO: 180890 - DNA, 13 bp, Unknown
  misc_feature (1)..( 13): Result.005 file - promoters50/2685968
aaaaacttgtttt

SEQ ID NO: 180891 - DNA, 13 bp, Unknown
  misc_feature (1)..( 13): Result.005 file - promoters50/2685968
aaaaactactaca

SEQ ID NO: 180892 - DNA, 13 bp, Unknown
  misc_feature (1)..( 13): Result.005 file - promoters50/2685968
acaaatttgtttt

SEQ ID NO: 180893 - DNA, 13 bp, Unknown
  misc_feature (1)..( 13): Result.005 file - promoters50/2685968
gcaaatttttaaa

SEQ ID NO: 180894 - DNA, 11 bp, Unknown
  misc_feature (1)..( 11): Result.005 file - promoters50/2685968
tttgattttaa

SEQ ID NO: 180895 - DNA, 11 bp, Unknown
  misc_feature (1)..( 11): Result.005 file - promoters50/2685968
tttgattaaca

SEQ ID NO: 180896 - DNA, 11 bp, Unknown
  misc_feature (1)..( 11): Result.005 file - promoters50/2685968
ttttattttgt

SEQ ID NO: 180897 - DNA, 11 bp, Unknown
  misc_feature (1)..( 11): Result.005 file - promoters50/2685968
ttaaattatgt

SEQ ID NO: 180898 - DNA, 11 bp, Unknown
  misc_feature (1)..( 11): Result.005 file - promoters50/2685968
ttgcattttaa

SEQ ID NO: 180899 - DNA, 8 bp, Unknown
  misc_feature (1)..( 8): Result.005 file - promoters50/2685968
tttttaaa

SEQ ID NO: 180900 - DNA, 8 bp, Unknown
  misc_feature (1)..( 8): Result.005 file - promoters50/2685968
tttttaaa

SEQ ID NO: 180901 - DNA, 8 bp, Unknown
  misc_feature (1)..( 8): Result.005 file - promoters50/2685968
attttaat

SEQ ID NO: 180902 - DNA, 8 bp, Unknown
  misc_feature (1)..( 8): Result.005 file - promoters50/2685968
attttatt

SEQ ID NO: 180903 - DNA, 10 bp, Unknown
  misc_feature (1)..( 10): Result.005 file - promoters50/2685968
taaaatttgc

SEQ ID NO: 180904 - DNA, 10 bp, Unknown
  misc_feature (1)..( 10): Result.005 file - promoters50/2685968
taatattata

SEQ ID NO: 180905 - DNA, 10 bp, Unknown
  misc_feature (1)..( 10): Result.005 file - promoters50/2685968
caaaacaaaa

SEQ ID NO: 180906 - DNA, 10 bp, Unknown
  misc_feature (1)..( 10): Result.005 file - promoters50/2685968
caaaaccttt

SEQ ID NO: 180907 - DNA, 10 bp, Unknown
  misc_feature (1)..( 10): Result.005 file - promoters50/2686138
ggtcaaatat

SEQ ID NO: 180908 - DNA, 10 bp, Unknown
  misc_feature (1)..( 10): Result.005 file - promoters50/2686138
aaacaattat

SEQ ID NO: 180909 - DNA, 10 bp, Unknown
  misc_feature (1)..( 10): Result.005 file - promoters50/2686138
aaacgattcc

SEQ ID NO: 180910 - DNA, 7 bp, Unknown
  misc_feature (1)..( 7): Result.005 file - promoters50/2686138
attttgt

SEQ ID NO: 180911 - DNA, 7 bp, Unknown
  misc_feature (1)..( 7): Result.005 file - promoters50/2686138
tttttgt

SEQ ID NO: 180912 - DNA, 7 bp, Unknown
  misc_feature (1)..( 7): Result.005 file - promoters50/2686138
attttgt

SEQ ID NO: 180913 - DNA, 9 bp, Unknown
  misc_feature (1)..( 9): Result.005 file - promoters50/2686138
tataattaa

SEQ ID NO: 180914 - DNA, 9 bp, Unknown
  misc_feature (1)..( 9): Result.005 file - promoters50/2686138
tatgatttc

SEQ ID NO: 180915 - DNA, 9 bp, Unknown
  misc_feature (1)..( 9): Result.005 file - promoters50/2686138
cttaactaa

SEQ ID NO: 180916 - DNA, 7 bp, Unknown
  misc_feature (1)..( 7): Result.005 file - promoters50/2686138
aaataaa

SEQ ID NO: 180917 - DNA, 7 bp, Unknown
  misc_feature (1)..( 7): Result.005 file - promoters50/2686138
aaataat

SEQ ID NO: 180918 - DNA, 7 bp, Unknown
  misc_feature (1)..( 7): Result.005 file - promoters50/2686138
taataat

SEQ ID NO: 180919 - DNA, 9 bp, Unknown
  misc_feature (1)..( 9): Result.005 file - promoters50/2686438
tgcatttta

SEQ ID NO: 180920 - DNA, 9 bp, Unknown
  misc_feature (1)..( 9): Result.005 file - promoters50/2686438
tgcatttat

SEQ ID NO: 180921 - DNA, 9 bp, Unknown
  misc_feature (1)..( 9): Result.005 file - promoters50/2686438
atcatttta

SEQ ID NO: 180922 - DNA, 9 bp, Unknown
  misc_feature (1)..( 9): Result.005 file - promoters50/2686438
aaatagaat

SEQ ID NO: 180923 - DNA, 9 bp, Unknown
  misc_feature (1)..( 9): Result.005 file - promoters50/2686438
aaatagtct

SEQ ID NO: 180924 - DNA, 9 bp, Unknown
  misc_feature (1)..( 9): Result.005 file - promoters50/2686438
taatactct

SEQ ID NO: 180925 - DNA, 9 bp, Unknown
  misc_feature (1)..( 9): Result.005 file - promoters50/2686438
ataaagatt

SEQ ID NO: 180926 - DNA, 9 bp, Unknown
  misc_feature (1)..( 9): Result.005 file - promoters50/2686438
ataaagagt

SEQ ID NO: 180927 - DNA, 9 bp, Unknown
  misc_feature (1)..( 9): Result.005 file - promoters50/2686438
acaaagatt

SEQ ID NO: 180928 - DNA, 12 bp, Unknown
  misc_feature (1)..( 12): Result.005 file - promoters50/2686438
accaaaatagat

SEQ ID NO: 180929 - DNA, 12 bp, Unknown
  misc_feature (1)..( 12): Result.005 file - promoters50/2686438
cacaatataaat

SEQ ID NO: 180930 - DNA, 12 bp, Unknown
  misc_feature (1)..( 12): Result.005 file - promoters50/2686438
tacaaaaattag

SEQ ID NO: 180931 - DNA, 12 bp, Unknown
  misc_feature (1)..( 12): Result.005 file - promoters50/2686438
ttcagaatttaa

SEQ ID NO: 180932 - DNA, 7 bp, Unknown
  misc_feature (1)..( 7): Result.005 file - promoters50/2686438
acacaag

SEQ ID NO: 180933 - DNA, 7 bp, Unknown
  misc_feature (1)..( 7): Result.005 file - promoters50/2686438
gcacaag

SEQ ID NO: 180934 - DNA, 7 bp, Unknown
  misc_feature (1)..( 7): Result.005 file - promoters50/2686438
acacaaa

SEQ ID NO: 180935 - DNA, 10 bp, Unknown
  misc_feature (1)..( 10): Result.005 file - promoters50/2704717
aaagattcca

SEQ ID NO: 180936 - DNA, 10 bp, Unknown
  misc_feature (1)..( 10): Result.005 file - promoters50/2704717
aaagatccag

SEQ ID NO: 180937 - DNA, 10 bp, Unknown
  misc_feature (1)..( 10): Result.005 file - promoters50/2704717
aaacatttaa

SEQ ID NO: 180938 - DNA, 10 bp, Unknown
  misc_feature (1)..( 10): Result.005 file - promoters50/2704717
aaaaatcagg

SEQ ID NO: 180939 - DNA, 10 bp, Unknown
  misc_feature (1)..( 10): Result.005 file - promoters50/2704717
atacatttaa

SEQ ID NO: 180940 - DNA, 15 bp, Unknown
  misc_feature (1)..( 15): Result.005 file - promoters50/2704717
caccaagaactggtt

SEQ ID NO: 180941 - DNA, 15 bp, Unknown
  misc_feature (1)..( 15): Result.005 file - promoters50/2704717
aaccatgaaaaccgc

SEQ ID NO: 180942 - DNA, 15 bp, Unknown
  misc_feature (1)..( 15): Result.005 file - promoters50/2704717
cacgaagaaacaaaa

SEQ ID NO: 180943 - DNA, 15 bp, Unknown
  misc_feature (1)..( 15): Result.005 file - promoters50/2704717
aatgaagaaataaaa

SEQ ID NO: 180944 - DNA, 15 bp, Unknown
  misc_feature (1)..( 15): Result.005 file - promoters50/2704717
cataacaaaataaaa

SEQ ID NO: 180945 - DNA, 8 bp, Unknown
  misc_feature (1)..( 8): Result.005 file - promoters50/2724399
acaggtat

SEQ ID NO: 180946 - DNA, 8 bp, Unknown
  misc_feature (1)..( 8): Result.005 file - promoters50/2724399
tcagatat

SEQ ID NO: 180947 - DNA, 8 bp, Unknown
  misc_feature (1)..( 8): Result.005 file - promoters50/2724399
tcagattc

SEQ ID NO: 180948 - DNA, 12 bp, Unknown
  misc_feature (1)..( 12): Result.005 file - promoters50/2724473
tatcattaatgt

SEQ ID NO: 180949 - DNA, 12 bp, Unknown
  misc_feature (1)..( 12): Result.005 file - promoters50/2724473
caacatgaatgt

SEQ ID NO: 180950 - DNA, 12 bp, Unknown
  misc_feature (1)..( 12): Result.005 file - promoters50/2724473
tatcagtaaacc

SEQ ID NO: 180951 - DNA, 16 bp, Unknown
  misc_feature (1)..( 16): Result.005 file - promoters50/2724473
tttttctttctcctca

SEQ ID NO: 180952 - DNA, 16 bp, Unknown
  misc_feature (1)..( 16): Result.005 file - promoters50/2724473
taattctgtctcatca

SEQ ID NO: 180953 - DNA, 16 bp, Unknown
  misc_feature (1)..( 16): Result.005 file - promoters50/2724473
taattcggtccaagta

SEQ ID NO: 180954 - DNA, 8 bp, Unknown
  misc_feature (1)..( 8): Result.005 file - promoters50/2724473
cataataa

SEQ ID NO: 180955 - DNA, 8 bp, Unknown
  misc_feature (1)..( 8): Result.005 file - promoters50/2724473
gatagtaa

SEQ ID NO: 180956 - DNA, 8 bp, Unknown
  misc_feature (1)..( 8): Result.005 file - promoters50/2724473
gattgtaa

SEQ ID NO: 180957 - DNA, 8 bp, Unknown
  misc_feature (1)..( 8): Result.005 file - promoters50/2724473
aattaatt

SEQ ID NO: 180958 - DNA, 8 bp, Unknown
  misc_feature (1)..( 8): Result.005 file - promoters50/2724473
aatttatt

SEQ ID NO: 180959 - DNA, 8 bp, Unknown
  misc_feature (1)..( 8): Result.005 file - promoters50/2724473
aatttacg

SEQ ID NO: 180960 - DNA, 18 bp, Unknown
  misc_feature (1)..( 18): Result.005 file - promoters50/2724699
caatattttactaatctc

SEQ ID NO: 180961 - DNA, 18 bp, Unknown
  misc_feature (1)..( 18): Result.005 file - promoters50/2724699
aaatgtttttaccataat

SEQ ID NO: 180962 - DNA, 18 bp, Unknown
  misc_feature (1)..( 18): Result.005 file - promoters50/2724699
aaaagtttagggaaaatg

SEQ ID NO: 180963 - DNA, 15 bp, Unknown
  misc_feature (1)..( 15): Result.005 file - promoters50/2724699
agtttagggaaaatg

SEQ ID NO: 180964 - DNA, 7 bp, Unknown
  misc_feature (1)..( 7): Result.005 file - promoters50/2724699
cattatc

SEQ ID NO: 180965 - DNA, 7 bp, Unknown
  misc_feature (1)..( 7): Result.005 file - promoters50/2724699
cattata

SEQ ID NO: 180966 - DNA, 7 bp, Unknown
  misc_feature (1)..( 7): Result.005 file - promoters50/2724699
aattatc

SEQ ID NO: 180967 - DNA, 7 bp, Unknown
  misc_feature (1)..( 7): Result.005 file - promoters50/2724699
aattatc

SEQ ID NO: 180968 - DNA, 7 bp, Unknown
  misc_feature (1)..( 7): Result.005 file - promoters50/2724699
gaaaatg

SEQ ID NO: 180969 - DNA, 7 bp, Unknown
  misc_feature (1)..( 7): Result.005 file - promoters50/2724699
gaaaatg

SEQ ID NO: 180970 - DNA, 7 bp, Unknown
  misc_feature (1)..( 7): Result.005 file - promoters50/2724699
gaaaatg

SEQ ID NO: 180971 - DNA, 8 bp, Unknown
  misc_feature (1)..( 8): Result.005 file - promoters50/2724699
aatatttt

SEQ ID NO: 180972 - DNA, 8 bp, Unknown
  misc_feature (1)..( 8): Result.005 file - promoters50/2724699
aatgtttt

SEQ ID NO: 180973 - DNA, 8 bp, Unknown
  misc_feature (1)..( 8): Result.005 file - promoters50/2724699
aatgtttt

SEQ ID NO: 180974 - DNA, 6 bp, Unknown
  misc_feature (1)..( 6): Result.005 file - promoters50/2724699
ttttac

SEQ ID NO: 180975 - DNA, 6 bp, Unknown
  misc_feature (1)..( 6): Result.005 file - promoters50/2724699
ttttac

SEQ ID NO: 180976 - DNA, 6 bp, Unknown
  misc_feature (1)..( 6): Result.005 file - promoters50/2724699
ttttac

SEQ ID NO: 180977 - DNA, 9 bp, Unknown
  misc_feature (1)..( 9): Result.005 file - promoters50/2724699
acatttaat

SEQ ID NO: 180978 - DNA, 9 bp, Unknown
  misc_feature (1)..( 9): Result.005 file - promoters50/2724699
acattcaat

SEQ ID NO: 180979 - DNA, 9 bp, Unknown
  misc_feature (1)..( 9): Result.005 file - promoters50/2724699
acattcaat

SEQ ID NO: 180980 - DNA, 6 bp, Unknown
  misc_feature (1)..( 6): Result.005 file - promoters50/2724699
cattat

SEQ ID NO: 180981 - DNA, 6 bp, Unknown
  misc_feature (1)..( 6): Result.005 file - promoters50/2724699
cattat

SEQ ID NO: 180982 - DNA, 6 bp, Unknown
  misc_feature (1)..( 6): Result.005 file - promoters50/2724699
cattat

SEQ ID NO: 180983 - DNA, 7 bp, Unknown
  misc_feature (1)..( 7): Result.005 file - promoters50/2724699
acggaaa

SEQ ID NO: 180984 - DNA, 7 bp, Unknown
  misc_feature (1)..( 7): Result.005 file - promoters50/2724699
acgcaaa

SEQ ID NO: 180985 - DNA, 7 bp, Unknown
  misc_feature (1)..( 7): Result.005 file - promoters50/2724699
acgcaaa

SEQ ID NO: 180986 - DNA, 8 bp, Unknown
  misc_feature (1)..( 8): Result.005 file - promoters50/2724703
tctcagag

SEQ ID NO: 180987 - DNA, 8 bp, Unknown
  misc_feature (1)..( 8): Result.005 file - promoters50/2724703
tctaagat

SEQ ID NO: 180988 - DNA, 8 bp, Unknown
  misc_feature (1)..( 8): Result.005 file - promoters50/2724703
tatcagag

SEQ ID NO: 180989 - DNA, 12 bp, Unknown
  misc_feature (1)..( 12): Result.005 file - promoters50/2724703
tgtatcaaaacg

SEQ ID NO: 180990 - DNA, 12 bp, Unknown
  misc_feature (1)..( 12): Result.005 file - promoters50/2724703
aaaaacaaaaca

SEQ ID NO: 180991 - DNA, 12 bp, Unknown
  misc_feature (1)..( 12): Result.005 file - promoters50/2724703
aaacacaataca

SEQ ID NO: 180992 - DNA, 9 bp, Unknown
  misc_feature (1)..( 9): Result.005 file - promoters50/2724703
tatttaaaa

SEQ ID NO: 180993 - DNA, 9 bp, Unknown
  misc_feature (1)..( 9): Result.005 file - promoters50/2724703
tatttatcc

SEQ ID NO: 180994 - DNA, 9 bp, Unknown
  misc_feature (1)..( 9): Result.005 file - promoters50/2724703
aattaaaaa

SEQ ID NO: 180995 - DNA, 8 bp, Unknown
  misc_feature (1)..( 8): Result.005 file - promoters50/2724703
aaagactg

SEQ ID NO: 180996 - DNA, 8 bp, Unknown
  misc_feature (1)..( 8): Result.005 file - promoters50/2724703
aaaaacta

SEQ ID NO: 180997 - DNA, 8 bp, Unknown
  misc_feature (1)..( 8): Result.005 file - promoters50/2724703
aaaataag

SEQ ID NO: 180998 - DNA, 7 bp, Unknown
  misc_feature (1)..( 7): Result.005 file - promoters50/2724703
ttttggt

SEQ ID NO: 180999 - DNA, 7 bp, Unknown
  misc_feature (1)..( 7): Result.005 file - promoters50/2724703
ctttggt

SEQ ID NO: 181000 - DNA, 7 bp, Unknown
  misc_feature (1)..( 7): Result.005 file - promoters50/2724703
ttttgga

SEQ ID NO: 181001 - DNA, 8 bp, Unknown
  misc_feature (1)..( 8): Result.005 file - promoters50/2724703
ttaaccca

SEQ ID NO: 181002 - DNA, 8 bp, Unknown
  misc_feature (1)..( 8): Result.005 file - promoters50/2724703
ttatccca

SEQ ID NO: 181003 - DNA, 8 bp, Unknown
  misc_feature (1)..( 8): Result.005 file - promoters50/2724703
ataaccct

SEQ ID NO: 181004 - DNA, 7 bp, Unknown
  misc_feature (1)..( 7): Result.005 file - promoters50/2724703
agatata

SEQ ID NO: 181005 - DNA, 7 bp, Unknown
  misc_feature (1)..( 7): Result.005 file - promoters50/2724703
agagata

SEQ ID NO: 181006 - DNA, 7 bp, Unknown
  misc_feature (1)..( 7): Result.005 file - promoters50/2724703
agagatt

SEQ ID NO: 181007 - DNA, 10 bp, Unknown
  misc_feature (1)..( 10): Result.005 file - promoters50/2724724
tatgacttga

SEQ ID NO: 181008 - DNA, 10 bp, Unknown
  misc_feature (1)..( 10): Result.005 file - promoters50/2724724
tatcacttgt

SEQ ID NO: 181009 - DNA, 10 bp, Unknown
  misc_feature (1)..( 10): Result.005 file - promoters50/2724724
gataacttga

SEQ ID NO: 181010 - DNA, 8 bp, Unknown
  misc_feature (1)..( 8): Result.005 file - promoters50/2724724
aaataaaa

SEQ ID NO: 181011 - DNA, 8 bp, Unknown
  misc_feature (1)..( 8): Result.005 file - promoters50/2724724
caataaaa

SEQ ID NO: 181012 - DNA, 8 bp, Unknown
  misc_feature (1)..( 8): Result.005 file - promoters50/2724724
aaacaaaa

SEQ ID NO: 181013 - DNA, 10 bp, Unknown
  misc_feature (1)..( 10): Result.005 file - promoters50/2724724
agcaaaaata

SEQ ID NO: 181014 - DNA, 10 bp, Unknown
  misc_feature (1)..( 10): Result.005 file - promoters50/2724724
aaagaaaata

SEQ ID NO: 181015 - DNA, 10 bp, Unknown
  misc_feature (1)..( 10): Result.005 file - promoters50/2724724
aaatgaaata

SEQ ID NO: 181016 - DNA, 8 bp, Unknown
  misc_feature (1)..( 8): Result.005 file - promoters50/2724724
accattaa

SEQ ID NO: 181017 - DNA, 8 bp, Unknown
  misc_feature (1)..( 8): Result.005 file - promoters50/2724724
cccactaa

SEQ ID NO: 181018 - DNA, 8 bp, Unknown
  misc_feature (1)..( 8): Result.005 file - promoters50/2724724
cccactag

SEQ ID NO: 181019 - DNA, 9 bp, Unknown
  misc_feature (1)..( 9): Result.005 file - promoters50/2724736
caatacaag

SEQ ID NO: 181020 - DNA, 9 bp, Unknown
  misc_feature (1)..( 9): Result.005 file - promoters50/2724736
aaatccaaa

SEQ ID NO: 181021 - DNA, 9 bp, Unknown
  misc_feature (1)..( 9): Result.005 file - promoters50/2724736
caatacaat

SEQ ID NO: 181022 - DNA, 9 bp, Unknown
  misc_feature (1)..( 9): Result.005 file - promoters50/2724736
gtatcaaaa

SEQ ID NO: 181023 - DNA, 9 bp, Unknown
  misc_feature (1)..( 9): Result.005 file - promoters50/2724736
agttacaat

SEQ ID NO: 181024 - DNA, 12 bp, Unknown
  misc_feature (1)..( 12): Result.005 file - promoters50/2724736
atccaattaaaa

SEQ ID NO: 181025 - DNA, 12 bp, Unknown
  misc_feature (1)..( 12): Result.005 file - promoters50/2724736
tttcaattaact

SEQ ID NO: 181026 - DNA, 12 bp, Unknown
  misc_feature (1)..( 12): Result.005 file - promoters50/2724736
taccatttatag

SEQ ID NO: 181027 - DNA, 12 bp, Unknown
  misc_feature (1)..( 12): Result.005 file - promoters50/2724736
gtctatttaaaa

SEQ ID NO: 181028 - DNA, 12 bp, Unknown
  misc_feature (1)..( 12): Result.005 file - promoters50/2724736
tacctttttctg

SEQ ID NO: 181029 - DNA, 7 bp, Unknown
  misc_feature (1)..( 7): Result.005 file - promoters50/2724756
tataaag

SEQ ID NO: 181030 - DNA, 7 bp, Unknown
  misc_feature (1)..( 7): Result.005 file - promoters50/2724756
tataaag

SEQ ID NO: 181031 - DNA, 7 bp, Unknown
  misc_feature (1)..( 7): Result.005 file - promoters50/2724756
tataaat

SEQ ID NO: 181032 - DNA, 7 bp, Unknown
  misc_feature (1)..( 7): Result.005 file - promoters50/2724756
aataaat

SEQ ID NO: 181033 - DNA, 7 bp, Unknown
  misc_feature (1)..( 7): Result.005 file - promoters50/2724756
aataaaa

SEQ ID NO: 181034 - DNA, 15 bp, Unknown
  misc_feature (1)..( 15): Result.005 file - promoters50/2724771
aatctaaaccataat

SEQ ID NO: 181035 - DNA, 15 bp, Unknown
  misc_feature (1)..( 15): Result.005 file - promoters50/2724771
aatataacccaaaat

SEQ ID NO: 181036 - DNA, 15 bp, Unknown
  misc_feature (1)..( 15): Result.005 file - promoters50/2724771
ttaaacatccaaaaa

SEQ ID NO: 181037 - DNA, 15 bp, Unknown
  misc_feature (1)..( 15): Result.005 file - promoters50/2724771
ctcacaaaccaatca

SEQ ID NO: 181038 - DNA, 8 bp, Unknown
  misc_feature (1)..( 8): Result.005 file - promoters50/2724771
agaaaatt

SEQ ID NO: 181039 - DNA, 8 bp, Unknown
  misc_feature (1)..( 8): Result.005 file - promoters50/2724771
ggaaaatc

SEQ ID NO: 181040 - DNA, 8 bp, Unknown
  misc_feature (1)..( 8): Result.005 file - promoters50/2724771
gtaaaatt

SEQ ID NO: 181041 - DNA, 8 bp, Unknown
  misc_feature (1)..( 8): Result.005 file - promoters50/2724771
agaaaact

SEQ ID NO: 181042 - DNA, 8 bp, Unknown
  misc_feature (1)..( 8): Result.005 file - promoters50/2781302
tttaagaa

SEQ ID NO: 181043 - DNA, 8 bp, Unknown
  misc_feature (1)..( 8): Result.005 file - promoters50/2781302
tttaagtt

SEQ ID NO: 181044 - DNA, 8 bp, Unknown
  misc_feature (1)..( 8): Result.005 file - promoters50/2781302
gttaggaa

SEQ ID NO: 181045 - DNA, 7 bp, Unknown
  misc_feature (1)..( 7): Result.005 file - promoters50/2781320
atattaa

SEQ ID NO: 181046 - DNA, 7 bp, Unknown
  misc_feature (1)..( 7): Result.005 file - promoters50/2781320
atactaa

SEQ ID NO: 181047 - DNA, 7 bp, Unknown
  misc_feature (1)..( 7): Result.005 file - promoters50/2781320
ttattaa

SEQ ID NO: 181048 - DNA, 11 bp, Unknown
  misc_feature (1)..( 11): Result.005 file - promoters50/2781320
tagcaatagtg

SEQ ID NO: 181049 - DNA, 11 bp, Unknown
  misc_feature (1)..( 11): Result.005 file - promoters50/2781320
ttacaagagtg

SEQ ID NO: 181050 - DNA, 11 bp, Unknown
  misc_feature (1)..( 11): Result.005 file - promoters50/2781320
tagcactagac

SEQ ID NO: 181051 - DNA, 7 bp, Unknown
  misc_feature (1)..( 7): Result.005 file - promoters50/2781320
aatctaa

SEQ ID NO: 181052 - DNA, 7 bp, Unknown
  misc_feature (1)..( 7): Result.005 file - promoters50/2781320
aatataa

SEQ ID NO: 181053 - DNA, 7 bp, Unknown
  misc_feature (1)..( 7): Result.005 file - promoters50/2781320
aatttaa

SEQ ID NO: 181054 - DNA, 10 bp, Unknown
  misc_feature (1)..( 10): Result.005 file - promoters50/2781320
attgaataaa

SEQ ID NO: 181055 - DNA, 10 bp, Unknown
  misc_feature (1)..( 10): Result.005 file - promoters50/2781320
taagaagaaa

SEQ ID NO: 181056 - DNA, 10 bp, Unknown
  misc_feature (1)..( 10): Result.005 file - promoters50/2781320
atttaatatc

SEQ ID NO: 181057 - DNA, 7 bp, Unknown
  misc_feature (1)..( 7): Result.005 file - promoters50/2781320
tatttca

SEQ ID NO: 181058 - DNA, 7 bp, Unknown
  misc_feature (1)..( 7): Result.005 file - promoters50/2781320
catttca

SEQ ID NO: 181059 - DNA, 7 bp, Unknown
  misc_feature (1)..( 7): Result.005 file - promoters50/2781320
catttct

SEQ ID NO: 181060 - DNA, 12 bp, Unknown
  misc_feature (1)..( 12): Result.005 file - promoters50/2781320
taatacatttat

SEQ ID NO: 181061 - DNA, 12 bp, Unknown
  misc_feature (1)..( 12): Result.005 file - promoters50/2781320
taataaattttg

SEQ ID NO: 181062 - DNA, 12 bp, Unknown
  misc_feature (1)..( 12): Result.005 file - promoters50/2781320
tgttaagttttg

SEQ ID NO: 181063 - DNA, 7 bp, Unknown
  misc_feature (1)..( 7): Result.005 file - promoters50/2781320
tttaccg

SEQ ID NO: 181064 - DNA, 7 bp, Unknown
  misc_feature (1)..( 7): Result.005 file - promoters50/2781320
tttacca

SEQ ID NO: 181065 - DNA, 7 bp, Unknown
  misc_feature (1)..( 7): Result.005 file - promoters50/2781320
ttaacat

SEQ ID NO: 181066 - DNA, 8 bp, Unknown
  misc_feature (1)..( 8): Result.005 file - promoters50/2781320
attttgaa

SEQ ID NO: 181067 - DNA, 8 bp, Unknown
  misc_feature (1)..( 8): Result.005 file - promoters50/2781320
ggtttgaa

SEQ ID NO: 181068 - DNA, 8 bp, Unknown
  misc_feature (1)..( 8): Result.005 file - promoters50/2781320
ggttagaa

SEQ ID NO: 181069 - DNA, 8 bp, Unknown
  misc_feature (1)..( 8): Result.005 file - promoters50/2781320
agttggaa

SEQ ID NO: 181070 - DNA, 8 bp, Unknown
  misc_feature (1)..( 8): Result.005 file - promoters50/2781320
ggttagaa

SEQ ID NO: 181071 - DNA, 8 bp, Unknown
  misc_feature (1)..( 8): Result.005 file - promoters50/2781320
ggtttgaa

SEQ ID NO: 181072 - DNA, 11 bp, Unknown
  misc_feature (1)..( 11): Result.005 file - promoters50/2781341
gcagttttttt

SEQ ID NO: 181073 - DNA, 11 bp, Unknown
  misc_feature (1)..( 11): Result.005 file - promoters50/2781341
gacgtttttgt

SEQ ID NO: 181074 - DNA, 11 bp, Unknown
  misc_feature (1)..( 11): Result.005 file - promoters50/2781341
aaagttttact

SEQ ID NO: 181075 - DNA, 11 bp, Unknown
  misc_feature (1)..( 11): Result.005 file - promoters50/2781341
acattttatgt

SEQ ID NO: 181076 - DNA, 11 bp, Unknown
  misc_feature (1)..( 11): Result.005 file - promoters50/2781341
atattttatga

SEQ ID NO: 181077 - DNA, 11 bp, Unknown
  misc_feature (1)..( 11): Result.005 file - promoters50/2781341
tatgtttctta

SEQ ID NO: 181078 - DNA, 11 bp, Unknown
  misc_feature (1)..( 11): Result.005 file - promoters50/2781341
aaaaattacgg

SEQ ID NO: 181079 - DNA, 11 bp, Unknown
  misc_feature (1)..( 11): Result.005 file - promoters50/2781341
aaatatttttt

SEQ ID NO: 181080 - DNA, 11 bp, Unknown
  misc_feature (1)..( 11): Result.005 file - promoters50/2781341
aaaaaaaaaaa

SEQ ID NO: 181081 - DNA, 11 bp, Unknown
  misc_feature (1)..( 11): Result.005 file - promoters50/2781341
ccatatttggg

SEQ ID NO: 181082 - DNA, 11 bp, Unknown
  misc_feature (1)..( 11): Result.005 file - promoters50/2781341
tttcatttttt

SEQ ID NO: 181083 - DNA, 11 bp, Unknown
  misc_feature (1)..( 11): Result.005 file - promoters50/2781341
aaaaatttatg

SEQ ID NO: 181084 - DNA, 11 bp, Unknown
  misc_feature (1)..( 11): Result.005 file - promoters50/2781341
accggtttttt

SEQ ID NO: 181085 - DNA, 11 bp, Unknown
  misc_feature (1)..( 11): Result.005 file - promoters50/2781341
tatttaagatt

SEQ ID NO: 181086 - DNA, 11 bp, Unknown
  misc_feature (1)..( 11): Result.005 file - promoters50/2781341
attttatgatt

SEQ ID NO: 181087 - DNA, 11 bp, Unknown
  misc_feature (1)..( 11): Result.005 file - promoters50/2781341
gatttctgacg

SEQ ID NO: 181088 - DNA, 11 bp, Unknown
  misc_feature (1)..( 11): Result.005 file - promoters50/2781341
tgtttcttacg

SEQ ID NO: 181089 - DNA, 11 bp, Unknown
  misc_feature (1)..( 11): Result.005 file - promoters50/2781341
gttttatcaaa

SEQ ID NO: 181090 - DNA, 11 bp, Unknown
  misc_feature (1)..( 11): Result.005 file - promoters50/2781341
attttatgttt

SEQ ID NO: 181091 - DNA, 15 bp, Unknown
  misc_feature (1)..( 15): Result.005 file - promoters50/2781341
tataaaaatttttct

SEQ ID NO: 181092 - DNA, 15 bp, Unknown
  misc_feature (1)..( 15): Result.005 file - promoters50/2781341
gacaatgattttttg

SEQ ID NO: 181093 - DNA, 15 bp, Unknown
  misc_feature (1)..( 15): Result.005 file - promoters50/2781341
gaacttaattttttt

SEQ ID NO: 181094 - DNA, 15 bp, Unknown
  misc_feature (1)..( 15): Result.005 file - promoters50/2781341
ctttgaaagttttcc

SEQ ID NO: 181095 - DNA, 15 bp, Unknown
  misc_feature (1)..( 15): Result.005 file - promoters50/2781341
aacttaaatttacgc

SEQ ID NO: 181096 - DNA, 16 bp, Unknown
  misc_feature (1)..( 16): Result.005 file - promoters50/2781341
aacttaattcttttta

SEQ ID NO: 181097 - DNA, 16 bp, Unknown
  misc_feature (1)..( 16): Result.005 file - promoters50/2781341
gtggcttgttttctac

SEQ ID NO: 181098 - DNA, 13 bp, Unknown
  misc_feature (1)..( 13): Result.005 file - promoters50/2781341
acttttaacaaaa

SEQ ID NO: 181099 - DNA, 13 bp, Unknown
  misc_feature (1)..( 13): Result.005 file - promoters50/2781341
cactctaaaaaaa

SEQ ID NO: 181100 - DNA, 12 bp, Unknown
  misc_feature (1)..( 12): Result.005 file - promoters50/2781341
ggttttacatga

SEQ ID NO: 181101 - DNA, 12 bp, Unknown
  misc_feature (1)..( 12): Result.005 file - promoters50/2781341
ctttttacagtt

SEQ ID NO: 181102 - DNA, 13 bp, Unknown
  misc_feature (1)..( 13): Result.005 file - promoters50/2781341
aattttaaaaaat

SEQ ID NO: 181103 - DNA, 12 bp, Unknown
  misc_feature (1)..( 12): Result.005 file - promoters50/2781341
ctcctaaaaacg

SEQ ID NO: 181104 - DNA, 13 bp, Unknown
  misc_feature (1)..( 13): Result.005 file - promoters50/2781341
gttttctacccat

SEQ ID NO: 181105 - DNA, 10 bp, Unknown
  misc_feature (1)..( 10): Result.005 file - promoters50/2781341
taaagtttgg

SEQ ID NO: 181106 - DNA, 10 bp, Unknown
  misc_feature (1)..( 10): Result.005 file - promoters50/2781341
acaagttttg

SEQ ID NO: 181107 - DNA, 10 bp, Unknown
  misc_feature (1)..( 10): Result.005 file - promoters50/2781341
aaaaatttat

SEQ ID NO: 181108 - DNA, 10 bp, Unknown
  misc_feature (1)..( 10): Result.005 file - promoters50/2781341
tgaaattttt

SEQ ID NO: 181109 - DNA, 10 bp, Unknown
  misc_feature (1)..( 10): Result.005 file - promoters50/2781341
acaggttttt

SEQ ID NO: 181110 - DNA, 10 bp, Unknown
  misc_feature (1)..( 10): Result.005 file - promoters50/2781341
tctcattttt

SEQ ID NO: 181111 - DNA, 14 bp, Unknown
  misc_feature (1)..( 14): Result.005 file - promoters50/2781341
taaaaatttttctg

SEQ ID NO: 181112 - DNA, 14 bp, Unknown
  misc_feature (1)..( 14): Result.005 file - promoters50/2781341
cttaaatttacgct

SEQ ID NO: 181113 - DNA, 15 bp, Unknown
  misc_feature (1)..( 15): Result.005 file - promoters50/2781341
ttgaaagttttccct

SEQ ID NO: 181114 - DNA, 15 bp, Unknown
  misc_feature (1)..( 15): Result.005 file - promoters50/2781341
aacttaatttttttt

SEQ ID NO: 181115 - DNA, 16 bp, Unknown
  misc_feature (1)..( 16): Result.005 file - promoters50/2781341
aacttaattcttttta

SEQ ID NO: 181116 - DNA, 16 bp, Unknown
  misc_feature (1)..( 16): Result.005 file - promoters50/2781341
gtggcttgttttctac

SEQ ID NO: 181117 - DNA, 13 bp, Unknown
  misc_feature (1)..( 13): Result.005 file - promoters50/2781786
atctgaaaattta

SEQ ID NO: 181118 - DNA, 13 bp, Unknown
  misc_feature (1)..( 13): Result.005 file - promoters50/2781786
aagtgaagattct

SEQ ID NO: 181119 - DNA, 13 bp, Unknown
  misc_feature (1)..( 13): Result.005 file - promoters50/2781786
gactgaaacttta

SEQ ID NO: 181120 - DNA, 13 bp, Unknown
  misc_feature (1)..( 13): Result.005 file - promoters50/2781786
aagtgaagacaaa

SEQ ID NO: 181121 - DNA, 13 bp, Unknown
  misc_feature (1)..( 13): Result.005 file - promoters50/2781786
aacgtaagcttca

SEQ ID NO: 181122 - DNA, 13 bp, Unknown
  misc_feature (1)..( 13): Result.005 file - promoters50/2781786
gacttaaaaaagc

SEQ ID NO: 181123 - DNA, 10 bp, Unknown
  misc_feature (1)..( 10): Result.005 file - promoters50/2781800
taagttaaga

SEQ ID NO: 181124 - DNA, 10 bp, Unknown
  misc_feature (1)..( 10): Result.005 file - promoters50/2781800
taaattaata

SEQ ID NO: 181125 - DNA, 10 bp, Unknown
  misc_feature (1)..( 10): Result.005 file - promoters50/2781800
taaatcaata

SEQ ID NO: 181126 - DNA, 10 bp, Unknown
  misc_feature (1)..( 10): Result.005 file - promoters50/2781800
ttaagttaag

SEQ ID NO: 181127 - DNA, 10 bp, Unknown
  misc_feature (1)..( 10): Result.005 file - promoters50/2781800
ttaatttata

SEQ ID NO: 181128 - DNA, 10 bp, Unknown
  misc_feature (1)..( 10): Result.005 file - promoters50/2781800
tcaatatata

SEQ ID NO: 181129 - DNA, 8 bp, Unknown
  misc_feature (1)..( 8): Result.005 file - promoters50/2781800
tgtttata

SEQ ID NO: 181130 - DNA, 8 bp, Unknown
  misc_feature (1)..( 8): Result.005 file - promoters50/2781800
aatttata

SEQ ID NO: 181131 - DNA, 8 bp, Unknown
  misc_feature (1)..( 8): Result.005 file - promoters50/2781800
aatatata

SEQ ID NO: 181132 - DNA, 8 bp, Unknown
  misc_feature (1)..( 8): Result.005 file - promoters50/2781800
atttgatg

SEQ ID NO: 181133 - DNA, 8 bp, Unknown
  misc_feature (1)..( 8): Result.005 file - promoters50/2781800
ttttcatg

SEQ ID NO: 181134 - DNA, 8 bp, Unknown
  misc_feature (1)..( 8): Result.005 file - promoters50/2781800
ttttcact

SEQ ID NO: 181135 - DNA, 8 bp, Unknown
  misc_feature (1)..( 8): Result.005 file - promoters50/2781800
agtataaa

SEQ ID NO: 181136 - DNA, 8 bp, Unknown
  misc_feature (1)..( 8): Result.005 file - promoters50/2781800
tatataaa

SEQ ID NO: 181137 - DNA, 8 bp, Unknown
  misc_feature (1)..( 8): Result.005 file - promoters50/2781800
tatataat

SEQ ID NO: 181138 - DNA, 38 bp, Unknown
  misc_feature (1)..( 38): Result.005 file - promoters50/2781800
gttggtaaaaccattatatgcattttgtcaaacctatc

SEQ ID NO: 181139 - DNA, 38 bp, Unknown
  misc_feature (1)..( 38): Result.005 file - promoters50/2781800
atgataatttaaaatttaggcattttttaaggtttagg

SEQ ID NO: 181140 - DNA, 38 bp, Unknown
  misc_feature (1)..( 38): Result.005 file - promoters50/2781800
ttaataacgtggtccggaattattttatcaaataaaga

SEQ ID NO: 181141 - DNA, 39 bp, Unknown; identical to SEQ ID NO: 90981
  misc_feature (1)..( 39): Result.005 file - promoters50/2781800

SEQ ID NO: 181142 - DNA, 39 bp, Unknown
  misc_feature (1)..( 39): Result.005 file - promoters50/2781800
aataacaaacaaaatacattgtatgataagaacttggac

SEQ ID NO: 181143 - DNA, 39 bp, Unknown
  misc_feature (1)..( 39): Result.005 file - promoters50/2781800
taaagaaaataaatttctatgacccaataatgtaatgct

SEQ ID NO: 181144 - DNA, 39 bp, Unknown; identical to SEQ ID NO: 90981
  misc_feature (1)..( 39): Result.005 file - promoters50/2781800

SEQ ID NO: 181145 - DNA, 8 bp, Unknown
  misc_feature (1)..( 8): Result.005 file - promoters50/2781800
ttatcaat

SEQ ID NO: 181146 - DNA, 8 bp, Unknown
  misc_feature (1)..( 8): Result.005 file - promoters50/2781800
taatcaat

SEQ ID NO: 181147 - DNA, 8 bp, Unknown
  misc_feature (1)..( 8): Result.005 file - promoters50/2781800
ttaccaat

SEQ ID NO: 181148 - DNA, 10 bp, Unknown
  misc_feature (1)..( 10): Result.005 file - promoters50/2781818
gagaggcttg

SEQ ID NO: 181149 - DNA, 10 bp, Unknown
  misc_feature (1)..( 10): Result.005 file - promoters50/2781818
aagaggattg

SEQ ID NO: 181150 - DNA, 10 bp, Unknown
  misc_feature (1)..( 10): Result.005 file - promoters50/2781818
aagatgatgt

SEQ ID NO: 181151 - DNA, 9 bp, Unknown
  misc_feature (1)..( 9): Result.005 file - promoters50/2781818
aaaaagagt

SEQ ID NO: 181152 - DNA, 9 bp, Unknown
  misc_feature (1)..( 9): Result.005 file - promoters50/2781818
aaaaaggcc

SEQ ID NO: 181153 - DNA, 9 bp, Unknown
  misc_feature (1)..( 9): Result.005 file - promoters50/2781818
ttaaaggag

SEQ ID NO: 181154 - DNA, 16 bp, Unknown
  misc_feature (1)..( 16): Result.005 file - promoters50/2781998
agtaggaaaagataca

SEQ ID NO: 181155 - DNA, 16 bp, Unknown
  misc_feature (1)..( 16): Result.005 file - promoters50/2781998
acgtggaaaaacaaaa

SEQ ID NO: 181156 - DNA, 16 bp, Unknown
  misc_feature (1)..( 16): Result.005 file - promoters50/2781998
agttggagaagttttg

SEQ ID NO: 181157 - DNA, 16 bp, Unknown
  misc_feature (1)..( 16): Result.005 file - promoters50/2781998
aagaaatgaagggttg

SEQ ID NO: 181158 - DNA, 12 bp, Unknown
  misc_feature (1)..( 12): Result.005 file - promoters50/2785775
tgggaaactttt

SEQ ID NO: 181159 - DNA, 12 bp, Unknown
  misc_feature (1)..( 12): Result.005 file - promoters50/2785775
tgggaaaaaatc

SEQ ID NO: 181160 - DNA, 12 bp, Unknown
  misc_feature (1)..( 12): Result.005 file - promoters50/2785775
cgggaagcttgt

SEQ ID NO: 181161 - DNA, 12 bp, Unknown
  misc_feature (1)..( 12): Result.005 file - promoters50/2785775
tttgaagtttgt

SEQ ID NO: 181162 - DNA, 11 bp, Unknown
  misc_feature (1)..( 11): Result.005 file - promoters50/2785798
actgactatta

SEQ ID NO: 181163 - DNA, 11 bp, Unknown
  misc_feature (1)..( 11): Result.005 file - promoters50/2785798
gttgacaattt

SEQ ID NO: 181164 - DNA, 11 bp, Unknown
  misc_feature (1)..( 11): Result.005 file - promoters50/2785798
agctactctta

SEQ ID NO: 181165 - DNA, 11 bp, Unknown
  misc_feature (1)..( 11): Result.005 file - promoters50/2785798
aatgaaaatta

SEQ ID NO: 181166 - DNA, 11 bp, Unknown
  misc_feature (1)..( 11): Result.005 file - promoters50/2785798
gttgacataaa

SEQ ID NO: 181167 - DNA, 11 bp, Unknown
  misc_feature (1)..( 11): Result.005 file - promoters50/2785798
tatgcaaatct

SEQ ID NO: 181168 - DNA, 9 bp, Unknown
  misc_feature (1)..( 9): Result.005 file - promoters50/2785798
aatatcttg

SEQ ID NO: 181169 - DNA, 9 bp, Unknown
  misc_feature (1)..( 9): Result.005 file - promoters50/2785798
aatattttg

SEQ ID NO: 181170 - DNA, 9 bp, Unknown
  misc_feature (1)..( 9): Result.005 file - promoters50/2785798
aatatttta

SEQ ID NO: 181171 - DNA, 9 bp, Unknown
  misc_feature (1)..( 9): Result.005 file - promoters50/2785798
tatatttac

SEQ ID NO: 181172 - DNA, 9 bp, Unknown
  misc_feature (1)..( 9): Result.005 file - promoters50/2785798
gttattttt

SEQ ID NO: 181173 - DNA, 9 bp, Unknown
  misc_feature (1)..( 9): Result.005 file - promoters50/2785798
tttattttt

SEQ ID NO: 181174 - DNA, 12 bp, Unknown
  misc_feature (1)..( 12): Result.005 file - promoters50/2785798
aatattttagtt

SEQ ID NO: 181175 - DNA, 12 bp, Unknown
  misc_feature (1)..( 12): Result.005 file - promoters50/2785798
tttatttttgtt

SEQ ID NO: 181176 - DNA, 12 bp, Unknown
  misc_feature (1)..( 12): Result.005 file - promoters50/2785798
aatattttgcca

SEQ ID NO: 181177 - DNA, 12 bp, Unknown
  misc_feature (1)..( 12): Result.005 file - promoters50/2785798
tatatttacaca

SEQ ID NO: 181178 - DNA, 12 bp, Unknown
  misc_feature (1)..( 12): Result.005 file - promoters50/2785798
gttattttttac

SEQ ID NO: 181179 - DNA, 12 bp, Unknown
  misc_feature (1)..( 12): Result.005 file - promoters50/2785798
cttaatttaagg

SEQ ID NO: 181180 - DNA, 7 bp, Unknown
  misc_feature (1)..( 7): Result.005 file - promoters50/2918398
tataaaa

SEQ ID NO: 181181 - DNA, 7 bp, Unknown
  misc_feature (1)..( 7): Result.005 file - promoters50/2918398
tataaaa

SEQ ID NO: 181182 - DNA, 7 bp, Unknown
  misc_feature (1)..( 7): Result.005 file - promoters50/2918398
gataaaa

SEQ ID NO: 181183 - DNA, 7 bp, Unknown
  misc_feature (1)..( 7): Result.005 file - promoters50/2918607
tttgttt

SEQ ID NO: 181184 - DNA, 7 bp, Unknown
  misc_feature (1)..( 7): Result.005 file - promoters50/2918607
tttattt

SEQ ID NO: 181185 - DNA, 7 bp, Unknown
  misc_feature (1)..( 7): Result.005 file - promoters50/2918607
tttattt

SEQ ID NO: 181186 - DNA, 8 bp, Unknown
  misc_feature (1)..( 8): Result.005 file - promoters50/2918607
ttttagtt

SEQ ID NO: 181187 - DNA, 8 bp, Unknown
  misc_feature (1)..( 8): Result.005 file - promoters50/2918607
tttttgtt

SEQ ID NO: 181188 - DNA, 8 bp, Unknown
  misc_feature (1)..( 8): Result.005 file - promoters50/2918607
ggtttgtt

SEQ ID NO: 181189 - DNA, 7 bp, Unknown
  misc_feature (1)..( 7): Result.005 file - promoters50/2918607
taaaaaa

SEQ ID NO: 181190 - DNA, 7 bp, Unknown
  misc_feature (1)..( 7): Result.005 file - promoters50/2918607
caaaaaa

SEQ ID NO: 181191 - DNA, 7 bp, Unknown
  misc_feature (1)..( 7): Result.005 file - promoters50/2918607
caataaa

SEQ ID NO: 181192 - DNA, 8 bp, Unknown
  misc_feature (1)..( 8): Result.005 file - promoters50/2918607
caattact

SEQ ID NO: 181193 - DNA, 8 bp, Unknown
  misc_feature (1)..( 8): Result.005 file - promoters50/2918607
caataact

SEQ ID NO: 181194 - DNA, 8 bp, Unknown
  misc_feature (1)..( 8): Result.005 file - promoters50/2918607
ttataact

SEQ ID NO: 181195 - DNA, 8 bp, Unknown
  misc_feature (1)..( 8): Result.005 file - promoters50/2918611
actaataa

SEQ ID NO: 181196 - DNA, 7 bp, Unknown
  misc_feature (1)..( 7): Result.005 file - promoters50/2918611
ataataa

SEQ ID NO: 181197 - DNA, 8 bp, Unknown
  misc_feature (1)..( 8): Result.005 file - promoters50/2918611
aattatac

SEQ ID NO: 181198 - DNA, 7 bp, Unknown
  misc_feature (1)..( 7): Result.005 file - promoters50/2918611
aatgata

SEQ ID NO: 181199 - DNA, 7 bp, Unknown
  misc_feature (1)..( 7): Result.005 file - promoters50/2918611
aataata

SEQ ID NO: 181200 - DNA, 7 bp, Unknown
  misc_feature (1)..( 7): Result.005 file - promoters50/2918611
aattata

SEQ ID NO: 181201 - DNA, 8 bp, Unknown
  misc_feature (1)..( 8): Result.005 file - promoters50/2918611
tatagtgg

SEQ ID NO: 181202 - DNA, 8 bp, Unknown
  misc_feature (1)..( 8): Result.005 file - promoters50/2918611
gataatgg

SEQ ID NO: 181203 - DNA, 8 bp, Unknown
  misc_feature (1)..( 8): Result.005 file - promoters50/2918611
aatagtaa

SEQ ID NO: 181204 - DNA, 11 bp, Unknown
  misc_feature (1)..( 11): Result.005 file - promoters50/2918619
cgttaaataga

SEQ ID NO: 181205 - DNA, 11 bp, Unknown
  misc_feature (1)..( 11): Result.005 file - promoters50/2918619
tagtaaaaaga

SEQ ID NO: 181206 - DNA, 11 bp, Unknown
  misc_feature (1)..( 11): Result.005 file - promoters50/2918619
cgttatatact

SEQ ID NO: 181207 - DNA, 7 bp, Unknown
  misc_feature (1)..( 7): Result.005 file - promoters50/2918626
gttgaga

SEQ ID NO: 181208 - DNA, 7 bp, Unknown
  misc_feature (1)..( 7): Result.005 file - promoters50/2918626
gtttaga

SEQ ID NO: 181209 - DNA, 7 bp, Unknown
  misc_feature (1)..( 7): Result.005 file - promoters50/2918626
ttttaga

SEQ ID NO: 181210 - DNA, 8 bp, Unknown
  misc_feature (1)..( 8): Result.005 file - promoters50/2918636
taatattg

SEQ ID NO: 181211 - DNA, 8 bp, Unknown
  misc_feature (1)..( 8): Result.005 file - promoters50/2918636
aaattttg

SEQ ID NO: 181212 - DNA, 8 bp, Unknown
  misc_feature (1)..( 8): Result.005 file - promoters50/2918636
taagtttg

SEQ ID NO: 181213 - DNA, 8 bp, Unknown
  misc_feature (1)..( 8): Result.005 file - promoters50/2918636
gattattc

SEQ ID NO: 181214 - DNA, 8 bp, Unknown
  misc_feature (1)..( 8): Result.005 file - promoters50/2918636
gatttttc

SEQ ID NO: 181215 - DNA, 8 bp, Unknown
  misc_feature (1)..( 8): Result.005 file - promoters50/2918636
tattatta

SEQ ID NO: 181216 - DNA, 9 bp, Unknown
  misc_feature (1)..( 9): Result.005 file - promoters50/2918640
ctaaacaac

SEQ ID NO: 181217 - DNA, 9 bp, Unknown
  misc_feature (1)..( 9): Result.005 file - promoters50/2918640
ccaaacaat

SEQ ID NO: 181218 - DNA, 9 bp, Unknown
  misc_feature (1)..( 9): Result.005 file - promoters50/2918640
taaaaaaac

SEQ ID NO: 181219 - DNA, 9 bp, Unknown
  misc_feature (1)..( 9): Result.005 file - promoters50/2918640
tttaaaaac

SEQ ID NO: 181220 - DNA, 9 bp, Unknown
  misc_feature (1)..( 9): Result.005 file - promoters50/2918640
ctaagaaat

SEQ ID NO: 181221 - DNA, 9 bp, Unknown
  misc_feature (1)..( 9): Result.005 file - promoters50/2918640
ataataaat

SEQ ID NO: 181222 - DNA, 11 bp, Unknown
  misc_feature (1)..( 11): Result.005 file - promoters50/2918658
aaggtatcaaa

SEQ ID NO: 181223 - DNA, 11 bp, Unknown
  misc_feature (1)..( 11): Result.005 file - promoters50/2918658
acattataaaa

SEQ ID NO: 181224 - DNA, 11 bp, Unknown
  misc_feature (1)..( 11): Result.005 file - promoters50/2918658
cagggatcaca

SEQ ID NO: 181225 - DNA, 11 bp, Unknown
  misc_feature (1)..( 11): Result.005 file - promoters50/2918658
cctttattaaa

SEQ ID NO: 181226 - DNA, 11 bp, Unknown
  misc_feature (1)..( 11): Result.005 file - promoters50/2918658
tttttataatc

SEQ ID NO: 181227 - DNA, 11 bp, Unknown
  misc_feature (1)..( 11): Result.005 file - promoters50/2918658
attttagaaaa

SEQ ID NO: 181228 - DNA, 11 bp, Unknown
  misc_feature (1)..( 11): Result.005 file - promoters50/2918658
acattaaaaaa

SEQ ID NO: 181229 - DNA, 7 bp, Unknown
  misc_feature (1)..( 7): Result.005 file - promoters50/2918666
gtaagaa

SEQ ID NO: 181230 - DNA, 7 bp, Unknown
  misc_feature (1)..( 7): Result.005 file - promoters50/2918666
gtaagaa

SEQ ID NO: 181231 - DNA, 7 bp, Unknown
  misc_feature (1)..( 7): Result.005 file - promoters50/2918666
gtaagat

SEQ ID NO: 181232 - DNA, 13 bp, Unknown
  misc_feature (1)..( 13): Result.005 file - promoters50/2918666
agacataataaat

SEQ ID NO: 181233 - DNA, 13 bp, Unknown
  misc_feature (1)..( 13): Result.005 file - promoters50/2918666
atttataataaaa

SEQ ID NO: 181234 - DNA, 13 bp, Unknown
  misc_feature (1)..( 13): Result.005 file - promoters50/2918666
gagtggaatcaat

SEQ ID NO: 181235 - DNA, 13 bp, Unknown
  misc_feature (1)..( 13): Result.005 file - promoters50/2918666
agacaaaataaaa

SEQ ID NO: 181236 - DNA, 8 bp, Unknown
  misc_feature (1)..( 8): Result.005 file - promoters50/2918666
tatataat

SEQ ID NO: 181237 - DNA, 8 bp, Unknown
  misc_feature (1)..( 8): Result.005 file - promoters50/2918666
catataat

SEQ ID NO: 181238 - DNA, 8 bp, Unknown
  misc_feature (1)..( 8): Result.005 file - promoters50/2918666
catataac

SEQ ID NO: 181239 - DNA, 9 bp, Unknown
  misc_feature (1)..( 9): Result.005 file - promoters50/2918666
tatcacaat

SEQ ID NO: 181240 - DNA, 13 bp, Unknown
  misc_feature (1)..( 13): Result.005 file - promoters50/2918666
gtagaaattaata

SEQ ID NO: 181241 - DNA, 13 bp, Unknown
  misc_feature (1)..( 13): Result.005 file - promoters50/2918666
tataaaatcaata

SEQ ID NO: 181242 - DNA, 13 bp, Unknown
  misc_feature (1)..( 13): Result.005 file - promoters50/2918666
gtataaatttact

SEQ ID NO: 181243 - DNA, 8 bp, Unknown
  misc_feature (1)..( 8): Result.005 file - promoters50/2918666
tagacacg

SEQ ID NO: 181244 - DNA, 8 bp, Unknown
  misc_feature (1)..( 8): Result.005 file - promoters50/2918666
aagagacg

SEQ ID NO: 181245 - DNA, 8 bp, Unknown
  misc_feature (1)..( 8): Result.005 file - promoters50/2918666
aagagaag

SEQ ID NO: 181246 - DNA, 8 bp, Unknown
  misc_feature (1)..( 8): Result.005 file - promoters50/2918666
gctaatga

SEQ ID NO: 181247 - DNA, 8 bp, Unknown
  misc_feature (1)..( 8): Result.005 file - promoters50/2918666
gctgatgt

SEQ ID NO: 181248 - DNA, 8 bp, Unknown
  misc_feature (1)..( 8): Result.005 file - promoters50/2918666
aataatga

SEQ ID NO: 181249 - DNA, 8 bp, Unknown
  misc_feature (1)..( 8): Result.005 file - promoters50/2918666
tgggaagt

SEQ ID NO: 181250 - DNA, 8 bp, Unknown
  misc_feature (1)..( 8): Result.005 file - promoters50/2918666
tggtaaga

SEQ ID NO: 181251 - DNA, 8 bp, Unknown
  misc_feature (1)..( 8): Result.005 file - promoters50/2918666
aagtaaga

SEQ ID NO: 181252 - DNA, 8 bp, Unknown
  misc_feature (1)..( 8): Result.005 file - promoters50/2918666
tattaatt

SEQ ID NO: 181253 - DNA, 8 bp, Unknown
  misc_feature (1)..( 8): Result.005 file - promoters50/2918666
gattgatt

SEQ ID NO: 181254 - DNA, 8 bp, Unknown
  misc_feature (1)..( 8): Result.005 file - promoters50/2918666
tataaatt

SEQ ID NO: 181255 - DNA, 8 bp, Unknown
  misc_feature (1)..( 8): Result.005 file - promoters50/2918666
tattgatc

SEQ ID NO: 181256 - DNA, 7 bp, Unknown
  misc_feature (1)..( 7): Result.005 file - promoters50/2918666
aataaat

SEQ ID NO: 181257 - DNA, 7 bp, Unknown
  misc_feature (1)..( 7): Result.005 file - promoters50/2918666
tataaat

SEQ ID NO: 181258 - DNA, 7 bp, Unknown
  misc_feature (1)..( 7): Result.005 file - promoters50/2918666
tataaaa

SEQ ID NO: 181259 - DNA, 9 bp, Unknown
  misc_feature (1)..( 9): Result.005 file - promoters50/2918666
tctttttcc

SEQ ID NO: 181260 - DNA, 9 bp, Unknown
  misc_feature (1)..( 9): Result.005 file - promoters50/2918666
acttttttc

SEQ ID NO: 181261 - DNA, 9 bp, Unknown
  misc_feature (1)..( 9): Result.005 file - promoters50/2918666
tcttcttcc

SEQ ID NO: 181262 - DNA, 8 bp, Unknown
  misc_feature (1)..( 8): Result.005 file - promoters50/2918666
agtgaaac

SEQ ID NO: 181263 - DNA, 8 bp, Unknown
  misc_feature (1)..( 8): Result.005 file - promoters50/2918666
agtgaaaa

SEQ ID NO: 181264 - DNA, 8 bp, Unknown
  misc_feature (1)..( 8): Result.005 file - promoters50/2918666
tctgaaaa

SEQ ID NO: 181265 - DNA, 8 bp, Unknown
  misc_feature (1)..( 8): Result.005 file - promoters50/2918666
caatcttg

SEQ ID NO: 181266 - DNA, 8 bp, Unknown
  misc_feature (1)..( 8): Result.005 file - promoters50/2918666
aaatcttg

SEQ ID NO: 181267 - DNA, 8 bp, Unknown
  misc_feature (1)..( 8): Result.005 file - promoters50/2918666
aaagcttc

SEQ ID NO: 181268 - DNA, 9 bp, Unknown
  misc_feature (1)..( 9): Result.005 file - promoters50/2918666
tatctcaaa

SEQ ID NO: 181269 - DNA, 9 bp, Unknown
  misc_feature (1)..( 9): Result.005 file - promoters50/2918666
tatcacaat

SEQ ID NO: 181270 - DNA, 9 bp, Unknown
  misc_feature (1)..( 9): Result.005 file - promoters50/2918666
tataacaat

SEQ ID NO: 181271 - DNA, 11 bp, Unknown
  misc_feature (1)..( 11): Result.005 file - promoters50/2918674
tgatcacttca

SEQ ID NO: 181272 - DNA, 11 bp, Unknown
  misc_feature (1)..( 11): Result.005 file - promoters50/2918674
gcttcatttca

SEQ ID NO: 181273 - DNA, 11 bp, Unknown
  misc_feature (1)..( 11): Result.005 file - promoters50/2918674
gtttcaattcc

SEQ ID NO: 181274 - DNA, 11 bp, Unknown
  misc_feature (1)..( 11): Result.005 file - promoters50/2918674
tgctcattttc

SEQ ID NO: 181275 - DNA, 11 bp, Unknown
  misc_feature (1)..( 11): Result.005 file - promoters50/2918674
gcttcatttct

SEQ ID NO: 181276 - DNA, 11 bp, Unknown
  misc_feature (1)..( 11): Result.005 file - promoters50/2918674
tcttgattaca

SEQ ID NO: 181277 - DNA, 10 bp, Unknown
  misc_feature (1)..( 10): Result.005 file - promoters50/2918674
gattgtgttc

SEQ ID NO: 181278 - DNA, 10 bp, Unknown
  misc_feature (1)..( 10): Result.005 file - promoters50/2918674
tattttgtat

SEQ ID NO: 181279 - DNA, 10 bp, Unknown
  misc_feature (1)..( 10): Result.005 file - promoters50/2918674
atatttctat

SEQ ID NO: 181280 - DNA, 10 bp, Unknown
  misc_feature (1)..( 10): Result.005 file - promoters50/2918674
acgtttgtat

SEQ ID NO: 181281 - DNA, 10 bp, Unknown
  misc_feature (1)..( 10): Result.005 file - promoters50/2918674
cggtttgtag

SEQ ID NO: 181282 - DNA, 10 bp, Unknown
  misc_feature (1)..( 10): Result.005 file - promoters50/2918674
tattttggtt

SEQ ID NO: 181283 - DNA, 9 bp, Unknown
  misc_feature (1)..( 9): Result.005 file - promoters50/2918676
gaaaaaaga

SEQ ID NO: 181284 - DNA, 9 bp, Unknown
  misc_feature (1)..( 9): Result.005 file - promoters50/2918676
gaacaaacg

SEQ ID NO: 181285 - DNA, 9 bp, Unknown
  misc_feature (1)..( 9): Result.005 file - promoters50/2918676
gaaagaaga

SEQ ID NO: 181286 - DNA, 11 bp, Unknown
  misc_feature (1)..( 11): Result.005 file - promoters50/2918676
taaaagtctac

SEQ ID NO: 181287 - DNA, 11 bp, Unknown
  misc_feature (1)..( 11): Result.005 file - promoters50/2918676
taaaagtctgt

SEQ ID NO: 181288 - DNA, 11 bp, Unknown
  misc_feature (1)..( 11): Result.005 file - promoters50/2918676
ctgcagtatgt

SEQ ID NO: 181289 - DNA, 7 bp, Unknown
  misc_feature (1)..( 7): Result.005 file - promoters50/2918676
aaaagaa

SEQ ID NO: 181290 - DNA, 7 bp, Unknown
  misc_feature (1)..( 7): Result.005 file - promoters50/2918676
gaaagaa

SEQ ID NO: 181291 - DNA, 7 bp, Unknown
  misc_feature (1)..( 7): Result.005 file - promoters50/2918676
gaaggaa

SEQ ID NO: 181292 - DNA, 8 bp, Unknown
  misc_feature (1)..( 8): Result.005 file - promoters50/2918688
aatggaat

SEQ ID NO: 181293 - DNA, 8 bp, Unknown
  misc_feature (1)..( 8): Result.005 file - promoters50/2918688
attggaat

SEQ ID NO: 181294 - DNA, 8 bp, Unknown
  misc_feature (1)..( 8): Result.005 file - promoters50/2918688
attggaaa

SEQ ID NO: 181295 - DNA, 10 bp, Unknown
  misc_feature (1)..( 10): Result.005 file - promoters50/2918688
caaacagctt

SEQ ID NO: 181296 - DNA, 10 bp, Unknown
  misc_feature (1)..( 10): Result.005 file - promoters50/2918688
caaacaacta

SEQ ID NO: 181297 - DNA, 10 bp, Unknown
  misc_feature (1)..( 10): Result.005 file - promoters50/2918688
taaacatcta

SEQ ID NO: 181298 - DNA, 8 bp, Unknown
  misc_feature (1)..( 8): Result.005 file - promoters50/2989987
gatccttt

SEQ ID NO: 181299 - DNA, 8 bp, Unknown
  misc_feature (1)..( 8): Result.005 file - promoters50/2989987
tatcattt

SEQ ID NO: 181300 - DNA, 8 bp, Unknown
  misc_feature (1)..( 8): Result.005 file - promoters50/2989987
tatcatat

SEQ ID NO: 181301 - DNA, 17 bp, Unknown
  misc_feature (1)..( 17): Result.005 file - promoters50/2989991
aaatcatctcaatgcca

SEQ ID NO: 181302 - DNA, 17 bp, Unknown
  misc_feature (1)..( 17): Result.005 file - promoters50/2989991
aaatcatctcaatgcca

SEQ ID NO: 181303 - DNA, 17 bp, Unknown
  misc_feature (1)..( 17): Result.005 file - promoters50/2989991
gaatgtaatcagtgcca

SEQ ID NO: 181304 - DNA, 9 bp, Unknown
  misc_feature (1)..( 9): Result.005 file - promoters50/2989991
attgatgaa

SEQ ID NO: 181305 - DNA, 9 bp, Unknown
  misc_feature (1)..( 9): Result.005 file - promoters50/2989991
gatgaagaa

SEQ ID NO: 181306 - DNA, 9 bp, Unknown
  misc_feature (1)..( 9): Result.005 file - promoters50/2989991
gatgcagat

SEQ ID NO: 181307 - DNA, 9 bp, Unknown
  misc_feature (1)..( 9): Result.005 file - promoters50/2989991
aagctcgat

SEQ ID NO: 181308 - DNA, 9 bp, Unknown
  misc_feature (1)..( 9): Result.005 file - promoters50/2989991
aaggtcgat

SEQ ID NO: 181309 - DNA, 9 bp, Unknown
  misc_feature (1)..( 9): Result.005 file - promoters50/2989991
aagctcgat

SEQ ID NO: 181310 - DNA, 9 bp, Unknown
  misc_feature (1)..( 9): Result.005 file - promoters50/2989991
cccgtcgat

SEQ ID NO: 181311 - DNA, 6 bp, Unknown
  misc_feature (1)..( 6): Result.005 file - promoters50/2989991
aaaaaa

SEQ ID NO: 181312 - DNA, 6 bp, Unknown
  misc_feature (1)..( 6): Result.005 file - promoters50/2989991
aaaaaa

SEQ ID NO: 181313 - DNA, 6 bp, Unknown
  misc_feature (1)..( 6): Result.005 file - promoters50/2989991
aaaaaa

SEQ ID NO: 181314 - DNA, 6 bp, Unknown
  misc_feature (1)..( 6): Result.005 file - promoters50/2989991
aacaag

SEQ ID NO: 181315 - DNA, 6 bp, Unknown
  misc_feature (1)..( 6): Result.005 file - promoters50/2989991
aacaag

SEQ ID NO: 181316 - DNA, 6 bp, Unknown
  misc_feature (1)..( 6): Result.005 file - promoters50/2989991
aacaag

SEQ ID NO: 181317 - DNA, 6 bp, Unknown
  misc_feature (1)..( 6): Result.005 file - promoters50/2989991
ttaaaa

SEQ ID NO: 181318 - DNA, 6 bp, Unknown
  misc_feature (1)..( 6): Result.005 file - promoters50/2989991
ttaaaa

SEQ ID NO: 181319 - DNA, 6 bp, Unknown
  misc_feature (1)..( 6): Result.005 file - promoters50/2989991
ttaaaa

SEQ ID NO: 181320 - DNA, 8 bp, Unknown
  misc_feature (1)..( 8): Result.005 file - promoters50/2989991
agatttat

SEQ ID NO: 181321 - DNA, 8 bp, Unknown
  misc_feature (1)..( 8): Result.005 file - promoters50/2989991
taatttat

SEQ ID NO: 181322 - DNA, 8 bp, Unknown
  misc_feature (1)..( 8): Result.005 file - promoters50/2989991
taatttaa

SEQ ID NO: 181323 - DNA, 8 bp, Unknown
  misc_feature (1)..( 8): Result.005 file - promoters50/2989991
ttcgaatt

SEQ ID NO: 181324 - DNA, 8 bp, Unknown
  misc_feature (1)..( 8): Result.005 file - promoters50/2989991
atcgtatt

SEQ ID NO: 181325 - DNA, 8 bp, Unknown
  misc_feature (1)..( 8): Result.005 file - promoters50/2989991
ttcgaaat

SEQ ID NO: 181326 - DNA, 8 bp, Unknown
  misc_feature (1)..( 8): Result.005 file - promoters50/2989991
aagaaaaa

SEQ ID NO: 181327 - DNA, 8 bp, Unknown
  misc_feature (1)..( 8): Result.005 file - promoters50/2989991
gggaaaaa

SEQ ID NO: 181328 - DNA, 8 bp, Unknown
  misc_feature (1)..( 8): Result.005 file - promoters50/2989991
aagtaaac

SEQ ID NO: 181329 - DNA, 8 bp, Unknown
  misc_feature (1)..( 8): Result.005 file - promoters50/2990064
aatttatt

SEQ ID NO: 181330 - DNA, 8 bp, Unknown
  misc_feature (1)..( 8): Result.005 file - promoters50/2990064
aatctatt

SEQ ID NO: 181331 - DNA, 8 bp, Unknown
  misc_feature (1)..( 8): Result.005 file - promoters50/2990064
cattaatt

SEQ ID NO: 181332 - DNA, 10 bp, Unknown
  misc_feature (1)..( 10): Result.005 file - promoters50/2990064
tgcttcaaca

SEQ ID NO: 181333 - DNA, 10 bp, Unknown
  misc_feature (1)..( 10): Result.005 file - promoters50/2990064
tgcatcaaca

SEQ ID NO: 181334 - DNA, 10 bp, Unknown
  misc_feature (1)..( 10): Result.005 file - promoters50/2990064
agtatcaaca

SEQ ID NO: 181335 - DNA, 10 bp, Unknown
  misc_feature (1)..( 10): Result.005 file - promoters50/2990064
aacatcaaag

SEQ ID NO: 181336 - DNA, 11 bp, Unknown
  misc_feature (1)..( 11): Result.005 file - promoters50/2990064
taatctctgca

SEQ ID NO: 181337 - DNA, 11 bp, Unknown
  misc_feature (1)..( 11): Result.005 file - promoters50/2990064
taatgtctcag

SEQ ID NO: 181338 - DNA, 11 bp, Unknown
  misc_feature (1)..( 11): Result.005 file - promoters50/2990064
taatgtctcag

SEQ ID NO: 181339 - DNA, 11 bp, Unknown
  misc_feature (1)..( 11): Result.005 file - promoters50/2990064
ctttgtatcag

SEQ ID NO: 181340 - DNA, 9 bp, Unknown
  misc_feature (1)..( 9): Result.005 file - promoters50/2990064
ttctatata

SEQ ID NO: 181341 - DNA, 9 bp, Unknown
  misc_feature (1)..( 9): Result.005 file - promoters50/2990064
ttctatata

SEQ ID NO: 181342 - DNA, 9 bp, Unknown
  misc_feature (1)..( 9): Result.005 file - promoters50/2990064
ttctatata

SEQ ID NO: 181343 - DNA, 9 bp, Unknown
  misc_feature (1)..( 9): Result.005 file - promoters50/2990064
ttatatata

SEQ ID NO: 181344 - DNA, 8 bp, Unknown
  misc_feature (1)..( 8): Result.005 file - promoters50/2990064
atcaccag

SEQ ID NO: 181345 - DNA, 8 bp, Unknown
  misc_feature (1)..( 8): Result.005 file - promoters50/2990064
ttcaccag

SEQ ID NO: 181346 - DNA, 8 bp, Unknown
  misc_feature (1)..( 8): Result.005 file - promoters50/2990064
ttctccat

SEQ ID NO: 181347 - DNA, 10 bp, Unknown
  misc_feature (1)..( 10): Result.005 file - promoters50/2990064
gttgtccgat

SEQ ID NO: 181348 - DNA, 10 bp, Unknown
  misc_feature (1)..( 10): Result.005 file - promoters50/2990064
cttgtctgat

SEQ ID NO: 181349 - DNA, 10 bp, Unknown
  misc_feature (1)..( 10): Result.005 file - promoters50/2990064
cttgtcatat

SEQ ID NO: 181350 - DNA, 27 bp, Unknown
  misc_feature (1)..( 27): Result.005 file - promoters50/2990064
tcttgtcatataaacgtccgtatagga

SEQ ID NO: 181351 - DNA, 27 bp, Unknown
  misc_feature (1)..( 27): Result.005 file - promoters50/2990064
tcttgtcatataaatgtccatatagga

SEQ ID NO: 181352 - DNA, 27 bp, Unknown
  misc_feature (1)..( 27): Result.005 file - promoters50/2990064
tcgtgacatatgaacgttcttattaca

SEQ ID NO: 181353 - DNA, 39 bp, Unknown
  misc_feature (1)..( 39): Result.005 file - promoters50/2990064
gattcatacccacatgatcttgtcttctcaccataagtt

SEQ ID NO: 181354 - DNA, 39 bp, Unknown
  misc_feature (1)..( 39): Result.005 file - promoters50/2990064
aatttatacccacatgatcatgtcttctaaccacaagtt

SEQ ID NO: 181355 - DNA, 39 bp, Unknown
  misc_feature (1)..( 39): Result.005 file - promoters50/2990064
gattcatactcacatggtcatgtcttctcagttctcacc

SEQ ID NO: 181356 - DNA, 19 bp, Unknown
  misc_feature (1)..( 19): Result.005 file - promoters50/2990064
tatagtccacaagttgatt

SEQ ID NO: 181357 - DNA, 19 bp, Unknown
  misc_feature (1)..( 19): Result.005 file - promoters50/2990064
tatagtccactagttgaat

SEQ ID NO: 181358 - DNA, 19 bp, Unknown
  misc_feature (1)..( 19): Result.005 file - promoters50/2990064
tttaatccacaagttgatt

SEQ ID NO: 181359 - DNA, 16 bp, Unknown
  misc_feature (1)..( 16): Result.005 file - promoters50/2990064
tgacataattgattac

SEQ ID NO: 181360 - DNA, 16 bp, Unknown
  misc_feature (1)..( 16): Result.005 file - promoters50/2990064
agacataattgattac

SEQ ID NO: 181361 - DNA, 16 bp, Unknown
  misc_feature (1)..( 16): Result.005 file - promoters50/2990064
tgaaataagattgatt

SEQ ID NO: 181362 - DNA, 15 bp, Unknown
  misc_feature (1)..( 15): Result.005 file - promoters50/2990064
aacttgggaccctta

SEQ ID NO: 181363 - DNA, 15 bp, Unknown
  misc_feature (1)..( 15): Result.005 file - promoters50/2990064
aacttgggaccctta

SEQ ID NO: 181364 - DNA, 15 bp, Unknown
  misc_feature (1)..( 15): Result.005 file - promoters50/2990064
aacttgggaccatag

SEQ ID NO: 181365 - DNA, 10 bp, Unknown
  misc_feature (1)..( 10): Result.005 file - promoters50/2990087
aaaaatataa

SEQ ID NO: 181366 - DNA, 10 bp, Unknown
  misc_feature (1)..( 10): Result.005 file - promoters50/2990087
aaaactattt

SEQ ID NO: 181367 - DNA, 10 bp, Unknown
  misc_feature (1)..( 10): Result.005 file - promoters50/2990087
tcaaccattt

SEQ ID NO: 181368 - DNA, 7 bp, Unknown
  misc_feature (1)..( 7): Result.005 file - promoters50/2990087
ttttctt

SEQ ID NO: 181369 - DNA, 7 bp, Unknown
  misc_feature (1)..( 7): Result.005 file - promoters50/2990087
ttttctt

SEQ ID NO: 181370 - DNA, 7 bp, Unknown
  misc_feature (1)..( 7): Result.005 file - promoters50/2990087
ttttttg

SEQ ID NO: 181371 - DNA, 9 bp, Unknown
  misc_feature (1)..( 9): Result.005 file - promoters50/2990087
actatatat

SEQ ID NO: 181372 - DNA, 9 bp, Unknown
  misc_feature (1)..( 9): Result.005 file - promoters50/2990087
tgtatatat

SEQ ID NO: 181373 - DNA, 9 bp, Unknown
  misc_feature (1)..( 9): Result.005 file - promoters50/2990087
actttatat

SEQ ID NO: 181374 - DNA, 10 bp, Unknown
  misc_feature (1)..( 10): Result.005 file - promoters50/2990091
cttctttctt

SEQ ID NO: 181375 - DNA, 10 bp, Unknown
  misc_feature (1)..( 10): Result.005 file - promoters50/2990091
cttgttttaa

SEQ ID NO: 181376 - DNA, 10 bp, Unknown
  misc_feature (1)..( 10): Result.005 file - promoters50/2990091
tttgttttaa

SEQ ID NO: 181377 - DNA, 13 bp, Unknown
  misc_feature (1)..( 13): Result.005 file - promoters50/2990091
ttgtttctgttgt

SEQ ID NO: 181378 - DNA, 13 bp, Unknown
  misc_feature (1)..( 13): Result.005 file - promoters50/2990091
aagattctgtcac

SEQ ID NO: 181379 - DNA, 13 bp, Unknown
  misc_feature (1)..( 13): Result.005 file - promoters50/2990091
tctattgtgctct

SEQ ID NO: 181380 - DNA, 11 bp, Unknown
  misc_feature (1)..( 11): Result.005 file - promoters50/2990184
cgattttatat

SEQ ID NO: 181381 - DNA, 11 bp, Unknown
  misc_feature (1)..( 11): Result.005 file - promoters50/2990184
caattatatat

SEQ ID NO: 181382 - DNA, 11 bp, Unknown
  misc_feature (1)..( 11): Result.005 file - promoters50/2990184
taattatttgt

SEQ ID NO: 181383 - DNA, 11 bp, Unknown
  misc_feature (1)..( 11): Result.005 file - promoters50/2990184
taattaaagac

SEQ ID NO: 181384 - DNA, 10 bp, Unknown
  misc_feature (1)..( 10): Result.005 file - promoters50/2990184
ttgaataaat

SEQ ID NO: 181385 - DNA, 10 bp, Unknown
  misc_feature (1)..( 10): Result.005 file - promoters50/2990184
ttgactaaac

SEQ ID NO: 181386 - DNA, 10 bp, Unknown
  misc_feature (1)..( 10): Result.005 file - promoters50/2990184
taaaataaat

SEQ ID NO: 181387 - DNA, 10 bp, Unknown
  misc_feature (1)..( 10): Result.005 file - promoters50/2990184
aagaaaaaac

SEQ ID NO: 181388 - DNA, 10 bp, Unknown
  misc_feature (1)..( 10): Result.005 file - promoters50/2990184
ccaaacaaaa

SEQ ID NO: 181389 - DNA, 7 bp, Unknown
  misc_feature (1)..( 7): Result.005 file - promoters50/2990184
tttacat

SEQ ID NO: 181390 - DNA, 7 bp, Unknown
  misc_feature (1)..( 7): Result.005 file - promoters50/2990184
tttccat

SEQ ID NO: 181391 - DNA, 7 bp, Unknown
  misc_feature (1)..( 7): Result.005 file - promoters50/2990184
tttccaa

SEQ ID NO: 181392 - DNA, 8 bp, Unknown
  misc_feature (1)..( 8): Result.005 file - promoters50/2990184
tttgccag

SEQ ID NO: 181393 - DNA, 11 bp, Unknown
  misc_feature (1)..( 11): Result.005 file - promoters50/2990233
catttttgtta

SEQ ID NO: 181394 - DNA, 11 bp, Unknown
  misc_feature (1)..( 11): Result.005 file - promoters50/2990233
cgttttggtta

SEQ ID NO: 181395 - DNA, 11 bp, Unknown
  misc_feature (1)..( 11): Result.005 file - promoters50/2990233
cgtttcggtca

SEQ ID NO: 181396 - DNA, 13 bp, Unknown
  misc_feature (1)..( 13): Result.005 file - promoters50/2990233
tttattattttga

SEQ ID NO: 181397 - DNA, 13 bp, Unknown
  misc_feature (1)..( 13): Result.005 file - promoters50/2990233
tttgttatcttgc

SEQ ID NO: 181398 - DNA, 13 bp, Unknown
  misc_feature (1)..( 13): Result.005 file - promoters50/2990233
aaatgtattttga

SEQ ID NO: 181399 - DNA, 13 bp, Unknown
  misc_feature (1)..( 13): Result.005 file - promoters50/2990233
cagagtgtatttg

SEQ ID NO: 181400 - DNA, 6 bp, Unknown
  misc_feature (1)..( 6): Result.005 file - promoters50/2990233
agagac

SEQ ID NO: 181401 - DNA, 6 bp, Unknown
  misc_feature (1)..( 6): Result.005 file - promoters50/2990233
agagac

SEQ ID NO: 181402 - DNA, 6 bp, Unknown
  misc_feature (1)..( 6): Result.005 file - promoters50/2990233
agagac

SEQ ID NO: 181403 - DNA, 8 bp, Unknown
  misc_feature (1)..( 8): Result.005 file - promoters50/2990233
aaacataa

SEQ ID NO: 181404 - DNA, 8 bp, Unknown
  misc_feature (1)..( 8): Result.005 file - promoters50/2990233
aaacgtaa

SEQ ID NO: 181405 - DNA, 8 bp, Unknown
  misc_feature (1)..( 8): Result.005 file - promoters50/2990233
aaacataa

SEQ ID NO: 181406 - DNA, 7 bp, Unknown
  misc_feature (1)..( 7): Result.005 file - promoters50/2990249
acactta

SEQ ID NO: 181407 - DNA, 7 bp, Unknown
  misc_feature (1)..( 7): Result.005 file - promoters50/2990249
tcactta

SEQ ID NO: 181408 - DNA, 7 bp, Unknown
  misc_feature (1)..( 7): Result.005 file - promoters50/2990249
tcacttg

SEQ ID NO: 181409 - DNA, 7 bp, Unknown
  misc_feature (1)..( 7): Result.005 file - promoters50/2990249
tcacttt

SEQ ID NO: 181410 - DNA, 7 bp, Unknown
  misc_feature (1)..( 7): Result.005 file - promoters50/2990249
gcacttg

SEQ ID NO: 181411 - DNA, 12 bp, Unknown
  misc_feature (1)..( 12): Result.005 file - promoters50/2990249
ataacaatatat

SEQ ID NO: 181412 - DNA, 12 bp, Unknown
  misc_feature (1)..( 12): Result.005 file - promoters50/2990249
aaaacaatcaca

SEQ ID NO: 181413 - DNA, 12 bp, Unknown
  misc_feature (1)..( 12): Result.005 file - promoters50/2990249
ataagaatatat

SEQ ID NO: 181414 - DNA, 12 bp, Unknown
  misc_feature (1)..( 12): Result.005 file - promoters50/2990249
aaaacaatcgtc

SEQ ID NO: 181415 - DNA, 12 bp, Unknown
  misc_feature (1)..( 12): Result.005 file - promoters50/2990249
taaacaaaacgt

SEQ ID NO: 181416 - DNA, 13 bp, Unknown
  misc_feature (1)..( 13): Result.005 file - promoters50/2990249
aaaatcaaatagt

SEQ ID NO: 181417 - DNA, 13 bp, Unknown
  misc_feature (1)..( 13): Result.005 file - promoters50/2990249
aagcaaaagcaat

SEQ ID NO: 181418 - DNA, 13 bp, Unknown
  misc_feature (1)..( 13): Result.005 file - promoters50/2990249
ggtcaaaatcaaa

SEQ ID NO: 181419 - DNA, 13 bp, Unknown
  misc_feature (1)..( 13): Result.005 file - promoters50/2990249
aagaaaaagtttt

SEQ ID NO: 181420 - DNA, 13 bp, Unknown
  misc_feature (1)..( 13): Result.005 file - promoters50/2990249
tacgtgaagaaat

SEQ ID NO: 181421 - DNA, 13 bp, Unknown
  misc_feature (1)..( 13): Result.005 file - promoters50/2990249
acttaaaagaaag

SEQ ID NO: 181422 - DNA, 12 bp, Unknown
  misc_feature (1)..( 12): Result.005 file - promoters50/2990249
tgatatacacta

SEQ ID NO: 181423 - DNA, 12 bp, Unknown
  misc_feature (1)..( 12): Result.005 file - promoters50/2990249
aaatatacaaac

SEQ ID NO: 181424 - DNA, 12 bp, Unknown
  misc_feature (1)..( 12): Result.005 file - promoters50/2990249
tgatatactcta

SEQ ID NO: 181425 - DNA, 12 bp, Unknown
  misc_feature (1)..( 12): Result.005 file - promoters50/2990249
tgaaataaatta

SEQ ID NO: 181426 - DNA, 12 bp, Unknown
  misc_feature (1)..( 12): Result.005 file - promoters50/2990249
taatataactct

SEQ ID NO: 181427 - DNA, 9 bp, Unknown
  misc_feature (1)..( 9): Result.005 file - promoters50/2990253
agcatgcgt

SEQ ID NO: 181428 - DNA, 9 bp, Unknown
  misc_feature (1)..( 9): Result.005 file - promoters50/2990253
agcatgggc

SEQ ID NO: 181429 - DNA, 9 bp, Unknown
  misc_feature (1)..( 9): Result.005 file - promoters50/2990253
agaatgcat

SEQ ID NO: 181430 - DNA, 11 bp, Unknown
  misc_feature (1)..( 11): Result.005 file - promoters50/2990263
attggagtcga

SEQ ID NO: 181431 - DNA, 11 bp, Unknown
  misc_feature (1)..( 11): Result.005 file - promoters50/2990263
atttgagtaaa

SEQ ID NO: 181432 - DNA, 11 bp, Unknown
  misc_feature (1)..( 11): Result.005 file - promoters50/2990263
atttgagaaat

SEQ ID NO: 181433 - DNA, 11 bp, Unknown
  misc_feature (1)..( 11): Result.005 file - promoters50/2990263
atttgaaaaac

SEQ ID NO: 181434 - DNA, 11 bp, Unknown
  misc_feature (1)..( 11): Result.005 file - promoters50/2990263
ttttaagaaag

SEQ ID NO: 181435 - DNA, 11 bp, Unknown
  misc_feature (1)..( 11): Result.005 file - promoters50/2990263
gatttagaaag

SEQ ID NO: 181436 - DNA, 14 bp, Unknown
  misc_feature (1)..( 14): Result.005 file - promoters50/2990263
ggagtcgaagaagg

SEQ ID NO: 181437 - DNA, 14 bp, Unknown
  misc_feature (1)..( 14): Result.005 file - promoters50/2990263
caaatcgaagaaag

SEQ ID NO: 181438 - DNA, 14 bp, Unknown
  misc_feature (1)..( 14): Result.005 file - promoters50/2990263
caattttaagaaag

SEQ ID NO: 181439 - DNA, 14 bp, Unknown
  misc_feature (1)..( 14): Result.005 file - promoters50/2990263
caaattgaaaccaa

SEQ ID NO: 181440 - DNA, 14 bp, Unknown
  misc_feature (1)..( 14): Result.005 file - promoters50/2990263
gttatttgagaaat

SEQ ID NO: 181441 - DNA, 14 bp, Unknown
  misc_feature (1)..( 14): Result.005 file - promoters50/2990263
agagatttagaaag

SEQ ID NO: 181442 - DNA, 14 bp, Unknown
  misc_feature (1)..( 14): Result.005 file - promoters50/2990263
aaatttgaaaaaca

SEQ ID NO: 181443 - DNA, 7 bp, Unknown
  misc_feature (1)..( 7): Result.005 file - promoters50/2990355
caaatct

SEQ ID NO: 181444 - DNA, 7 bp, Unknown
  misc_feature (1)..( 7): Result.005 file - promoters50/2990355
taaatct

SEQ ID NO: 181445 - DNA, 7 bp, Unknown
  misc_feature (1)..( 7): Result.005 file - promoters50/2990355
taactct

SEQ ID NO: 181446 - DNA, 10 bp, Unknown
  misc_feature (1)..( 10): Result.005 file - promoters50/2990457
tccaaaggag

SEQ ID NO: 181447 - DNA, 10 bp, Unknown
  misc_feature (1)..( 10): Result.005 file - promoters50/2990457
tccaaacttt

SEQ ID NO: 181448 - DNA, 10 bp, Unknown
  misc_feature (1)..( 10): Result.005 file - promoters50/2990457
accaaatttt

SEQ ID NO: 181449 - DNA, 10 bp, Unknown
  misc_feature (1)..( 10): Result.005 file - promoters50/2990457
atgtttatta

SEQ ID NO: 181450 - DNA, 10 bp, Unknown
  misc_feature (1)..( 10): Result.005 file - promoters50/2990457
aagttgatta

SEQ ID NO: 181451 - DNA, 10 bp, Unknown
  misc_feature (1)..( 10): Result.005 file - promoters50/2990457
atgtatattc

SEQ ID NO: 181452 - DNA, 8 bp, Unknown
  misc_feature (1)..( 8): Result.005 file - promoters50/2990457
ctatataa

SEQ ID NO: 181453 - DNA, 8 bp, Unknown
  misc_feature (1)..( 8): Result.005 file - promoters50/2990457
ttatataa

SEQ ID NO: 181454 - DNA, 8 bp, Unknown
  misc_feature (1)..( 8): Result.005 file - promoters50/2990457
ttatatca

SEQ ID NO: 181455 - DNA, 7 bp, Unknown
  misc_feature (1)..( 7): Result.005 file - promoters50/2990457
caaatta

SEQ ID NO: 181456 - DNA, 7 bp, Unknown
  misc_feature (1)..( 7): Result.005 file - promoters50/2990457
caaattt

SEQ ID NO: 181457 - DNA, 7 bp, Unknown
  misc_feature (1)..( 7): Result.005 file - promoters50/2990457
caaattt

SEQ ID NO: 181458 - DNA, 7 bp, Unknown
  misc_feature (1)..( 7): Result.005 file - promoters50/2990457
attattt

SEQ ID NO: 181459 - DNA, 7 bp, Unknown
  misc_feature (1)..( 7): Result.005 file - promoters50/2990457
tttattt

SEQ ID NO: 181460 - DNA, 7 bp, Unknown
  misc_feature (1)..( 7): Result.005 file - promoters50/2990457
tttatta

SEQ ID NO: 181461 - DNA, 11 bp, Unknown
  misc_feature (1)..( 11): Result.005 file - promoters50/2990457
gatgtttaaca

SEQ ID NO: 181462 - DNA, 11 bp, Unknown
  misc_feature (1)..( 11): Result.005 file - promoters50/2990457
gatttttaaat

SEQ ID NO: 181463 - DNA, 11 bp, Unknown
  misc_feature (1)..( 11): Result.005 file - promoters50/2990457
gagtttcaaat

SEQ ID NO: 181464 - DNA, 12 bp, Unknown
  misc_feature (1)..( 12): Result.005 file - promoters50/2990528
gaattatacttg

SEQ ID NO: 181465 - DNA, 12 bp, Unknown
  misc_feature (1)..( 12): Result.005 file - promoters50/2990528
taattatgttat

SEQ ID NO: 181466 - DNA, 12 bp, Unknown
  misc_feature (1)..( 12): Result.005 file - promoters50/2990528
gaaatataaata

SEQ ID NO: 181467 - DNA, 12 bp, Unknown
  misc_feature (1)..( 12): Result.005 file - promoters50/2990528
gatatataaact

SEQ ID NO: 181468 - DNA, 12 bp, Unknown
  misc_feature (1)..( 12): Result.005 file - promoters50/2990528
ggtatataattc

SEQ ID NO: 181469 - DNA, 12 bp, Unknown
  misc_feature (1)..( 12): Result.005 file - promoters50/2990528
gttttatgaaat

SEQ ID NO: 181470 - DNA, 14 bp, Unknown
  misc_feature (1)..( 14): Result.005 file - promoters50/2990548
tcttcctttgtctc

SEQ ID NO: 181471 - DNA, 14 bp, Unknown
  misc_feature (1)..( 14): Result.005 file - promoters50/2990548
tcggtgtttgtcat

SEQ ID NO: 181472 - DNA, 14 bp, Unknown
  misc_feature (1)..( 14): Result.005 file - promoters50/2990548
tcttcgtttgttaa

SEQ ID NO: 181473 - DNA, 14 bp, Unknown
  misc_feature (1)..( 14): Result.005 file - promoters50/2990548
ggtttgtttatctc

SEQ ID NO: 181474 - DNA, 14 bp, Unknown
  misc_feature (1)..( 14): Result.005 file - promoters50/2990548
gacaggtttgtgag

SEQ ID NO: 181475 - DNA, 14 bp, Unknown
  misc_feature (1)..( 14): Result.005 file - promoters50/2990548
cctagatgtgtata

SEQ ID NO: 181476 - DNA, 9 bp, Unknown
  misc_feature (1)..( 9): Result.005 file - promoters50/2990611
atttattta

SEQ ID NO: 181477 - DNA, 9 bp, Unknown
  misc_feature (1)..( 9): Result.005 file - promoters50/2990611
gtttctttt

SEQ ID NO: 181478 - DNA, 9 bp, Unknown
  misc_feature (1)..( 9): Result.005 file - promoters50/2990611
atttatttt

SEQ ID NO: 181479 - DNA, 9 bp, Unknown
  misc_feature (1)..( 9): Result.005 file - promoters50/2990611
ttttcttaa

SEQ ID NO: 181480 - DNA, 9 bp, Unknown
  misc_feature (1)..( 9): Result.005 file - promoters50/2990611
gtttcttta

SEQ ID NO: 181481 - DNA, 9 bp, Unknown
  misc_feature (1)..( 9): Result.005 file - promoters50/2990611
ttttacttg

SEQ ID NO: 181482 - DNA, 15 bp, Unknown
  misc_feature (1)..( 15): Result.005 file - promoters50/2990611
tagtataaataaagc

SEQ ID NO: 181483 - DNA, 15 bp, Unknown
  misc_feature (1)..( 15): Result.005 file - promoters50/2990611
gtgtataaattgtaa

SEQ ID NO: 181484 - DNA, 15 bp, Unknown
  misc_feature (1)..( 15): Result.005 file - promoters50/2990611
cattatatatagaaa

SEQ ID NO: 181485 - DNA, 15 bp, Unknown
  misc_feature (1)..( 15): Result.005 file - promoters50/2990611
ccatataaatagagc

SEQ ID NO: 181486 - DNA, 15 bp, Unknown
  misc_feature (1)..( 15): Result.005 file - promoters50/2990611
tcctataaattgaac

SEQ ID NO: 181487 - DNA, 15 bp, Unknown
  misc_feature (1)..( 15): Result.005 file - promoters50/2990611
tcttatatattctta

SEQ ID NO: 181488 - DNA, 15 bp, Unknown
  misc_feature (1)..( 15): Result.005 file - promoters50/2990611
tcctataaatataag

SEQ ID NO: 181489 - DNA, 14 bp, Unknown
  misc_feature (1)..( 14): Result.005 file - promoters50/2990611
attaaaaacttaat

SEQ ID NO: 181490 - DNA, 14 bp, Unknown
  misc_feature (1)..( 14): Result.005 file - promoters50/2990611
gaaaaaaacaaata

SEQ ID NO: 181491 - DNA, 14 bp, Unknown
  misc_feature (1)..( 14): Result.005 file - promoters50/2990611
aaaaaaaacaaaga

SEQ ID NO: 181492 - DNA, 14 bp, Unknown
  misc_feature (1)..( 14): Result.005 file - promoters50/2990611
attacaaagagata

SEQ ID NO: 181493 - DNA, 14 bp, Unknown
  misc_feature (1)..( 14): Result.005 file - promoters50/2990611
cccataaagcaaac

SEQ ID NO: 181494 - DNA, 14 bp, Unknown
  misc_feature (1)..( 14): Result.005 file - promoters50/2990611
gctaaaaataacaa

SEQ ID NO: 181495 - DNA, 13 bp, Unknown
  misc_feature (1)..( 13): Result.005 file - promoters50/2990611
caacaaatttatt

SEQ ID NO: 181496 - DNA, 13 bp, Unknown
  misc_feature (1)..( 13): Result.005 file - promoters50/2990611
aaacaaataaaat

SEQ ID NO: 181497 - DNA, 13 bp, Unknown
  misc_feature (1)..( 13): Result.005 file - promoters50/2990611
aaacaaagacgtc

SEQ ID NO: 181498 - DNA, 13 bp, Unknown
  misc_feature (1)..( 13): Result.005 file - promoters50/2990611
caaaaaaaggaaa

SEQ ID NO: 181499 - DNA, 14 bp, Unknown
  misc_feature (1)..( 14): Result.005 file - promoters50/2990611
aaagcaaacaatgg

SEQ ID NO: 181500 - DNA, 14 bp, Unknown
  misc_feature (1)..( 14): Result.005 file - promoters50/2990611
gctaaaaataacaa

SEQ ID NO: 181501 - DNA, 11 bp, Unknown
  misc_feature (1)..( 11): Result.005 file - promoters50/2990611
ttaatttattc

SEQ ID NO: 181502 - DNA, 11 bp, Unknown
  misc_feature (1)..( 11): Result.005 file - promoters50/2990611
ttaaattaaca

SEQ ID NO: 181503 - DNA, 11 bp, Unknown
  misc_feature (1)..( 11): Result.005 file - promoters50/2990611
gtaatttggtt

SEQ ID NO: 181504 - DNA, 11 bp, Unknown
  misc_feature (1)..( 11): Result.005 file - promoters50/2990611
ataatcaaaag

SEQ ID NO: 181505 - DNA, 12 bp, Unknown
  misc_feature (1)..( 12): Result.005 file - promoters50/2990611
atgaattaccaa

SEQ ID NO: 181506 - DNA, 11 bp, Unknown
  misc_feature (1)..( 11): Result.005 file - promoters50/2990611
aaaaataagaa

SEQ ID NO: 181507 - DNA, 12 bp, Unknown
  misc_feature (1)..( 12): Result.005 file - promoters50/2990611
ttatatttagtc

SEQ ID NO: 181508 - DNA, 16 bp, Unknown
  misc_feature (1)..( 16): Result.005 file - promoters50/2990611
ccataaaggaaaaagc

SEQ ID NO: 181509 - DNA, 16 bp, Unknown
  misc_feature (1)..( 16): Result.005 file - promoters50/2990611
tgtttatggaaaattg

SEQ ID NO: 181510 - DNA, 16 bp, Unknown
  misc_feature (1)..( 16): Result.005 file - promoters50/2990611
ccaaaaaagaaatatg

SEQ ID NO: 181511 - DNA, 16 bp, Unknown
  misc_feature (1)..( 16): Result.005 file - promoters50/2990611
ttcttaaacaaaattg

SEQ ID NO: 181512 - DNA, 16 bp, Unknown
  misc_feature (1)..( 16): Result.005 file - promoters50/2990611
gattaatactaaataa

SEQ ID NO: 181513 - DNA, 16 bp, Unknown
  misc_feature (1)..( 16): Result.005 file - promoters50/2990611
gtatataagatatatg

SEQ ID NO: 181514 - DNA, 16 bp, Unknown
  misc_feature (1)..( 16): Result.005 file - promoters50/2990611
cacaaaataaagtaat

SEQ ID NO: 181515 - DNA, 16 bp, Unknown
  misc_feature (1)..( 16): Result.005 file - promoters50/2990611
cgaaaaataaataaaa

SEQ ID NO: 181516 - DNA, 16 bp, Unknown
  misc_feature (1)..( 16): Result.005 file - promoters50/2990611
ctcaaaaaaacgttaa

SEQ ID NO: 181517 - DNA, 16 bp, Unknown
  misc_feature (1)..( 16): Result.005 file - promoters50/2990611
cgataaatttgctcga

SEQ ID NO: 181518 - DNA, 16 bp, Unknown
  misc_feature (1)..( 16): Result.005 file - promoters50/2990611
gaaatcataattttgc

SEQ ID NO: 181519 - DNA, 16 bp, Unknown
  misc_feature (1)..( 16): Result.005 file - promoters50/2990611
atgtcgatagtttaac

SEQ ID NO: 181520 - DNA, 16 bp, Unknown
  misc_feature (1)..( 16): Result.005 file - promoters50/2990611
tgaacaattatcgact

SEQ ID NO: 181521 - DNA, 8 bp, Unknown
  misc_feature (1)..( 8): Result.005 file - promoters50/2990659
ttaaaaaa

SEQ ID NO: 181522 - DNA, 8 bp, Unknown
  misc_feature (1)..( 8): Result.005 file - promoters50/2990659
ttacaaaa

SEQ ID NO: 181523 - DNA, 8 bp, Unknown
  misc_feature (1)..( 8): Result.005 file - promoters50/2990659
ttaaaatc

SEQ ID NO: 181524 - DNA, 8 bp, Unknown
  misc_feature (1)..( 8): Result.005 file - promoters50/2990659
aaaatggt

SEQ ID NO: 181525 - DNA, 8 bp, Unknown
  misc_feature (1)..( 8): Result.005 file - promoters50/2990659
aaaatgaa

SEQ ID NO: 181526 - DNA, 8 bp, Unknown
  misc_feature (1)..( 8): Result.005 file - promoters50/2990659
aaattgtc

SEQ ID NO: 181527 - DNA, 7 bp, Unknown
  misc_feature (1)..( 7): Result.005 file - promoters50/2990712
actttag

SEQ ID NO: 181528 - DNA, 7 bp, Unknown
  misc_feature (1)..( 7): Result.005 file - promoters50/2990712
tctttag

SEQ ID NO: 181529 - DNA, 7 bp, Unknown
  misc_feature (1)..( 7): Result.005 file - promoters50/2990712
tctctag

SEQ ID NO: 181530 - DNA, 9 bp, Unknown
  misc_feature (1)..( 9): Result.005 file - promoters50/2990712
ataaataca

SEQ ID NO: 181531 - DNA, 9 bp, Unknown
  misc_feature (1)..( 9): Result.005 file - promoters50/2990712
atatataga

SEQ ID NO: 181532 - DNA, 9 bp, Unknown
  misc_feature (1)..( 9): Result.005 file - promoters50/2990712
atacagaaa

SEQ ID NO: 181533 - DNA, 8 bp, Unknown
  misc_feature (1)..( 8): Result.005 file - promoters50/2990777
attcaaaa

SEQ ID NO: 181534 - DNA, 8 bp, Unknown
  misc_feature (1)..( 8): Result.005 file - promoters50/2990777
tttcgaaa

SEQ ID NO: 181535 - DNA, 8 bp, Unknown
  misc_feature (1)..( 8): Result.005 file - promoters50/2990777
attcaaca

SEQ ID NO: 181536 - DNA, 9 bp, Unknown
  misc_feature (1)..( 9): Result.005 file - promoters50/2990777
aaagtacaa

SEQ ID NO: 181537 - DNA, 9 bp, Unknown
  misc_feature (1)..( 9): Result.005 file - promoters50/2990777
aaagtaaag

SEQ ID NO: 181538 - DNA, 9 bp, Unknown
  misc_feature (1)..( 9): Result.005 file - promoters50/2990777
aaagaaaag

SEQ ID NO: 181539 - DNA, 9 bp, Unknown
  misc_feature (1)..( 9): Result.005 file - promoters50/2990839
caacaaatt

SEQ ID NO: 181540 - DNA, 9 bp, Unknown
  misc_feature (1)..( 9): Result.005 file - promoters50/2990839
taacaaaaa

SEQ ID NO: 181541 - DNA, 9 bp, Unknown
  misc_feature (1)..( 9): Result.005 file - promoters50/2990839
taataaaga

SEQ ID NO: 181542 - DNA, 9 bp, Unknown
  misc_feature (1)..( 9): Result.005 file - promoters50/2990839
ggataaaga

SEQ ID NO: 181543 - DNA, 8 bp, Unknown
  misc_feature (1)..( 8): Result.005 file - promoters50/2990839
aaaaaagt

SEQ ID NO: 181544 - DNA, 8 bp, Unknown
  misc_feature (1)..( 8): Result.005 file - promoters50/2990839
aaaaaaat

SEQ ID NO: 181545 - DNA, 8 bp, Unknown
  misc_feature (1)..( 8): Result.005 file - promoters50/2990839
aaaacgtt

SEQ ID NO: 181546 - DNA, 26 bp, Unknown
  misc_feature (1)..( 26): Result.005 file - promoters50/2990839
tccatatacgttatgtaaaatatttt

SEQ ID NO: 181547 - DNA, 26 bp, Unknown
  misc_feature (1)..( 26): Result.005 file - promoters50/2990839
caagcccactacatgttaaagcccaa

SEQ ID NO: 181548 - DNA, 27 bp, Unknown
  misc_feature (1)..( 27): Result.005 file - promoters50/2990839
ttaaggcccaataagtaacaataaaga

SEQ ID NO: 181549 - DNA, 27 bp, Unknown
  misc_feature (1)..( 27): Result.005 file - promoters50/2990839
taaaatattttcgatacttaataaatt

SEQ ID NO: 181550 - DNA, 27 bp, Unknown
  misc_feature (1)..( 27): Result.005 file - promoters50/2990839
ttaaagcccaagaagtaacaataaaga

SEQ ID NO: 181551 - DNA, 27 bp, Unknown
  misc_feature (1)..( 27): Result.005 file - promoters50/2990839
ttaaggcccaataagtaacaataaaga

SEQ ID NO: 181552 - DNA, 10 bp, Unknown
  misc_feature (1)..( 10): Result.005 file - promoters50/2990839
tttattaaaa

SEQ ID NO: 181553 - DNA, 10 bp, Unknown
  misc_feature (1)..( 10): Result.005 file - promoters50/2990839
tattttaaaa

SEQ ID NO: 181554 - DNA, 10 bp, Unknown
  misc_feature (1)..( 10): Result.005 file - promoters50/2990839
tttattgaaa

SEQ ID NO: 181555 - DNA, 8 bp, Unknown
  misc_feature (1)..( 8): Result.005 file - promoters50/2990928
gaaaatta

SEQ ID NO: 181556 - DNA, 8 bp, Unknown
  misc_feature (1)..( 8): Result.005 file - promoters50/2990928
caaaattg

SEQ ID NO: 181557 - DNA, 8 bp, Unknown
  misc_feature (1)..( 8): Result.005 file - promoters50/2990928
gaaaatta

SEQ ID NO: 181558 - DNA, 8 bp, Unknown
  misc_feature (1)..( 8): Result.005 file - promoters50/2990928
caaaatca

SEQ ID NO: 181559 - DNA, 7 bp, Unknown
  misc_feature (1)..( 7): Result.005 file - promoters50/2991101
tttgttt

SEQ ID NO: 181560 - DNA, 7 bp, Unknown
  misc_feature (1)..( 7): Result.005 file - promoters50/2991101
ttttttt

SEQ ID NO: 181561 - DNA, 7 bp, Unknown
  misc_feature (1)..( 7): Result.005 file - promoters50/2991101
tttattt

SEQ ID NO: 181562 - DNA, 9 bp, Unknown
  misc_feature (1)..( 9): Result.005 file - promoters50/2991101
tctttttcc

SEQ ID NO: 181563 - DNA, 9 bp, Unknown
  misc_feature (1)..( 9): Result.005 file - promoters50/2991101
tctttttct

SEQ ID NO: 181564 - DNA, 9 bp, Unknown
  misc_feature (1)..( 9): Result.005 file - promoters50/2991101
gttttttcc

SEQ ID NO: 181565 - DNA, 10 bp, Unknown
  misc_feature (1)..( 10): Result.005 file - promoters50/2991141
aattatgtta

SEQ ID NO: 181566 - DNA, 10 bp, Unknown
  misc_feature (1)..( 10): Result.005 file - promoters50/2991141
aattatttta

SEQ ID NO: 181567 - DNA, 10 bp, Unknown
  misc_feature (1)..( 10): Result.005 file - promoters50/2991141
aatgattgga

SEQ ID NO: 181568 - DNA, 9 bp, Unknown
  misc_feature (1)..( 9): Result.005 file - promoters50/2991141
tcaaacaac

SEQ ID NO: 181569 - DNA, 9 bp, Unknown
  misc_feature (1)..( 9): Result.005 file - promoters50/2991141
ctaaacaac

SEQ ID NO: 181570 - DNA, 9 bp, Unknown
  misc_feature (1)..( 9): Result.005 file - promoters50/2991141
tcagacaca

SEQ ID NO: 181571 - DNA, 8 bp, Unknown
  misc_feature (1)..( 8): Result.005 file - promoters50/2991141
tttatttt

SEQ ID NO: 181572 - DNA, 8 bp, Unknown
  misc_feature (1)..( 8): Result.005 file - promoters50/2991141
tttatttt

SEQ ID NO: 181573 - DNA, 8 bp, Unknown
  misc_feature (1)..( 8): Result.005 file - promoters50/2991141
attagttt

SEQ ID NO: 181574 - DNA, 7 bp, Unknown
  misc_feature (1)..( 7): Result.005 file - promoters50/2991141
attaatg

SEQ ID NO: 181575 - DNA, 7 bp, Unknown
  misc_feature (1)..( 7): Result.005 file - promoters50/2991141
tttaatg

SEQ ID NO: 181576 - DNA, 7 bp, Unknown
  misc_feature (1)..( 7): Result.005 file - promoters50/2991141
tttcatg

SEQ ID NO: 181577 - DNA, 8 bp, Unknown
  misc_feature (1)..( 8): Result.005 file - promoters50/2991141
gttttttc

SEQ ID NO: 181578 - DNA, 8 bp, Unknown
  misc_feature (1)..( 8): Result.005 file - promoters50/2991141
gtttttaa

SEQ ID NO: 181579 - DNA, 8 bp, Unknown
  misc_feature (1)..( 8): Result.005 file - promoters50/2991141
gtttctaa

SEQ ID NO: 181580 - DNA, 16 bp, Unknown
  misc_feature (1)..( 16): Result.005 file - promoters50/2991227
atttagaccattgatt

SEQ ID NO: 181581 - DNA, 16 bp, Unknown
  misc_feature (1)..( 16): Result.005 file - promoters50/2991227
ccttagacaattgatt

SEQ ID NO: 181582 - DNA, 16 bp, Unknown
  misc_feature (1)..( 16): Result.005 file - promoters50/2991227
atttcgaccaatttta

SEQ ID NO: 181583 - DNA, 16 bp, Unknown
  misc_feature (1)..( 16): Result.005 file - promoters50/2991227
tggtcgatcaaacccg

SEQ ID NO: 181584 - DNA, 10 bp, Unknown
  misc_feature (1)..( 10): Result.005 file - promoters50/2991227
ttgacttctc

SEQ ID NO: 181585 - DNA, 10 bp, Unknown
  misc_feature (1)..( 10): Result.005 file - promoters50/2991227
ttgactgctc

SEQ ID NO: 181586 - DNA, 10 bp, Unknown
  misc_feature (1)..( 10): Result.005 file - promoters50/2991227
gtgattgcat

SEQ ID NO: 181587 - DNA, 10 bp, Unknown
  misc_feature (1)..( 10): Result.005 file - promoters50/2991227
cagactgctt

SEQ ID NO: 181588 - DNA, 9 bp, Unknown
  misc_feature (1)..( 9): Result.005 file - promoters50/2991235
catggaggt

SEQ ID NO: 181589 - DNA, 9 bp, Unknown
  misc_feature (1)..( 9): Result.005 file - promoters50/2991235
catagagaa

SEQ ID NO: 181590 - DNA, 9 bp, Unknown
  misc_feature (1)..( 9): Result.005 file - promoters50/2991235
agtagagaa

SEQ ID NO: 181591 - DNA, 8 bp, Unknown
  misc_feature (1)..( 8): Result.005 file - promoters50/2991235
cgataaca

SEQ ID NO: 181592 - DNA, 8 bp, Unknown
  misc_feature (1)..( 8): Result.005 file - promoters50/2991235
ggataaca

SEQ ID NO: 181593 - DNA, 8 bp, Unknown
  misc_feature (1)..( 8): Result.005 file - promoters50/2991235
ggataaaa

SEQ ID NO: 181594 - DNA, 9 bp, Unknown
  misc_feature (1)..( 9): Result.005 file - promoters50/2991235
aatcaacaa

SEQ ID NO: 181595 - DNA, 9 bp, Unknown
  misc_feature (1)..( 9): Result.005 file - promoters50/2991235
tagcaacaa

SEQ ID NO: 181596 - DNA, 9 bp, Unknown
  misc_feature (1)..( 9): Result.005 file - promoters50/2991235
tctcaacac

SEQ ID NO: 181597 - DNA, 9 bp, Unknown
  misc_feature (1)..( 9): Result.005 file - promoters50/2991235
tctgaacaa

SEQ ID NO: 181598 - DNA, 8 bp, Unknown
  misc_feature (1)..( 8): Result.005 file - promoters50/2991235
aaacccaa

SEQ ID NO: 181599 - DNA, 8 bp, Unknown
  misc_feature (1)..( 8): Result.005 file - promoters50/2991235
caacacaa

SEQ ID NO: 181600 - DNA, 8 bp, Unknown
  misc_feature (1)..( 8): Result.005 file - promoters50/2991235
aaacccta

SEQ ID NO: 181601 - DNA, 8 bp, Unknown
  misc_feature (1)..( 8): Result.005 file - promoters50/2991235
caacacca

SEQ ID NO: 181602 - DNA, 8 bp, Unknown
  misc_feature (1)..( 8): Result.005 file - promoters50/2991235
gaaaaaac

SEQ ID NO: 181603 - DNA, 8 bp, Unknown
  misc_feature (1)..( 8): Result.005 file - promoters50/2991235
gaagaaac

SEQ ID NO: 181604 - DNA, 8 bp, Unknown
  misc_feature (1)..( 8): Result.005 file - promoters50/2991235
gaagaaac

SEQ ID NO: 181605 - DNA, 8 bp, Unknown
  misc_feature (1)..( 8): Result.005 file - promoters50/2991235
gtgaagat

SEQ ID NO: 181606 - DNA, 8 bp, Unknown
  misc_feature (1)..( 8): Result.005 file - promoters50/2991235
aagaagat

SEQ ID NO: 181607 - DNA, 8 bp, Unknown
  misc_feature (1)..( 8): Result.005 file - promoters50/2991235
aagcagag

SEQ ID NO: 181608 - DNA, 13 bp, Unknown
  misc_feature (1)..( 13): Result.005 file - promoters50/2991235
gaagcatttagta

SEQ ID NO: 181609 - DNA, 13 bp, Unknown
  misc_feature (1)..( 13): Result.005 file - promoters50/2991235
gaagcacgaatgt

SEQ ID NO: 181610 - DNA, 13 bp, Unknown
  misc_feature (1)..( 13): Result.005 file - promoters50/2991235
gaagtagcattta

SEQ ID NO: 181611 - DNA, 8 bp, Unknown
  misc_feature (1)..( 8): Result.005 file - promoters50/2991235
gtagagtg

SEQ ID NO: 181612 - DNA, 8 bp, Unknown
  misc_feature (1)..( 8): Result.005 file - promoters50/2991235
gtagagaa

SEQ ID NO: 181613 - DNA, 8 bp, Unknown
  misc_feature (1)..( 8): Result.005 file - promoters50/2991235
atagagaa

SEQ ID NO: 181614 - DNA, 8 bp, Unknown
  misc_feature (1)..( 8): Result.005 file - promoters50/2991235
acttttgg

SEQ ID NO: 181615 - DNA, 8 bp, Unknown
  misc_feature (1)..( 8): Result.005 file - promoters50/2991235
tgttttgg

SEQ ID NO: 181616 - DNA, 8 bp, Unknown
  misc_feature (1)..( 8): Result.005 file - promoters50/2991235
tgttttgt

SEQ ID NO: 181617 - DNA, 13 bp, Unknown
  misc_feature (1)..( 13): Result.005 file - promoters50/2991239
aatattaaaaaag

SEQ ID NO: 181618 - DNA, 13 bp, Unknown
  misc_feature (1)..( 13): Result.005 file - promoters50/2991239
ccttttaaaaaaa

SEQ ID NO: 181619 - DNA, 13 bp, Unknown
  misc_feature (1)..( 13): Result.005 file - promoters50/2991239
aaatacaaaaaaa

SEQ ID NO: 181620 - DNA, 13 bp, Unknown
  misc_feature (1)..( 13): Result.005 file - promoters50/2991239
aatatcaaaacaa

SEQ ID NO: 181621 - DNA, 13 bp, Unknown
  misc_feature (1)..( 13): Result.005 file - promoters50/2991239
cagtaaaaaaaaa

SEQ ID NO: 181622 - DNA, 14 bp, Unknown
  misc_feature (1)..( 14): Result.005 file - promoters50/2991239
tgctataaagaaag

SEQ ID NO: 181623 - DNA, 14 bp, Unknown
  misc_feature (1)..( 14): Result.005 file - promoters50/2991239
ccaaccaaaccaat

SEQ ID NO: 181624 - DNA, 14 bp, Unknown
  misc_feature (1)..( 14): Result.005 file - promoters50/2991239
aaaagaaaaaaaaa

SEQ ID NO: 181625 - DNA, 9 bp, Unknown
  misc_feature (1)..( 9): Result.005 file - promoters50/2991239
taaatacaa

SEQ ID NO: 181626 - DNA, 9 bp, Unknown
  misc_feature (1)..( 9): Result.005 file - promoters50/2991239
taattacag

SEQ ID NO: 181627 - DNA, 9 bp, Unknown
  misc_feature (1)..( 9): Result.005 file - promoters50/2991239
aaaatgcaa

SEQ ID NO: 181628 - DNA, 9 bp, Unknown
  misc_feature (1)..( 9): Result.005 file - promoters50/2991239
taaataaat

SEQ ID NO: 181629 - DNA, 9 bp, Unknown
  misc_feature (1)..( 9): Result.005 file - promoters50/2991239
taattagtc

SEQ ID NO: 181630 - DNA, 9 bp, Unknown
  misc_feature (1)..( 9): Result.005 file - promoters50/2991239
caattagcc

SEQ ID NO: 181631 - DNA, 29 bp, Unknown
  misc_feature (1)..( 29): Result.005 file - promoters50/2991239
agcttttaagtctctcgctagactgtcca

SEQ ID NO: 181632 - DNA, 29 bp, Unknown
  misc_feature (1)..( 29): Result.005 file - promoters50/2991239
aagctttaagtctatcgctagactgtcca

SEQ ID NO: 181633 - DNA, 29 bp, Unknown
  misc_feature (1)..( 29): Result.005 file - promoters50/2991239
agcatttaatgatgataacgatttggaag

SEQ ID NO: 181634 - DNA, 29 bp, Unknown
  misc_feature (1)..( 29): Result.005 file - promoters50/2991239
tcctcacacatctctctttcttccttctc

SEQ ID NO: 181635 - DNA, 29 bp, Unknown
  misc_feature (1)..( 29): Result.005 file - promoters50/2991239
atcatccaccgagatatcaagactgctaa

SEQ ID NO: 181636 - DNA, 29 bp, Unknown
  misc_feature (1)..( 29): Result.005 file - promoters50/2991239
gtagtttagtgaaacagaagctgacaaga

SEQ ID NO: 181637 - DNA, 34 bp, Unknown; identical to SEQ ID NO: 76979
  misc_feature (1)..( 34): Result.005 file - promoters50/2991239

SEQ ID NO: 181638 - DNA, 34 bp, Unknown; identical to SEQ ID NO: 76977
  misc_feature (1)..( 34): Result.005 file - promoters50/2991239

SEQ ID NO: 181639 - DNA, 34 bp, Unknown; identical to SEQ ID NO: 76978
  misc_feature (1)..( 34): Result.005 file - promoters50/2991239

SEQ ID NO: 181640 - DNA, 34 bp, Unknown; identical to SEQ ID NO: 104971
  misc_feature (1)..( 34): Result.005 file - promoters50/2991239

SEQ ID NO: 181641 - DNA, 34 bp, Unknown
  misc_feature (1)..( 34): Result.005 file - promoters50/2991239
attctctaataaataagtgaagattcatcgccaa

SEQ ID NO: 181642 - DNA, 34 bp, Unknown
  misc_feature (1)..( 34): Result.005 file - promoters50/2991239
gtgcctataaatatccttgagttttttatttcta

SEQ ID NO: 181643 - DNA, 13 bp, Unknown
  misc_feature (1)..( 13): Result.005 file - promoters50/2991239
tcattaaaaatca

SEQ ID NO: 181644 - DNA, 13 bp, Unknown
  misc_feature (1)..( 13): Result.005 file - promoters50/2991239
tcaataaatggaa

SEQ ID NO: 181645 - DNA, 13 bp, Unknown
  misc_feature (1)..( 13): Result.005 file - promoters50/2991239
tcagtaaaaaaaa

SEQ ID NO: 181646 - DNA, 13 bp, Unknown
  misc_feature (1)..( 13): Result.005 file - promoters50/2991239
attatatatgtga

SEQ ID NO: 181647 - DNA, 13 bp, Unknown
  misc_feature (1)..( 13): Result.005 file - promoters50/2991239
ccaataacccaaa

SEQ ID NO: 181648 - DNA, 13 bp, Unknown
  misc_feature (1)..( 13): Result.005 file - promoters50/2991239
ggaaaaaaaaaaa

SEQ ID NO: 181649 - DNA, 13 bp, Unknown
  misc_feature (1)..( 13): Result.005 file - promoters50/2991239
agaaaaaaaaaaa

SEQ ID NO: 181650 - DNA, 13 bp, Unknown
  misc_feature (1)..( 13): Result.005 file - promoters50/2991239
agtgtacaaaggg

SEQ ID NO: 181651 - DNA, 14 bp, Unknown
  misc_feature (1)..( 14): Result.005 file - promoters50/2991239
cataaaataagtga

SEQ ID NO: 181652 - DNA, 14 bp, Unknown
  misc_feature (1)..( 14): Result.005 file - promoters50/2991239
tttcaaataaatgg

SEQ ID NO: 181653 - DNA, 14 bp, Unknown
  misc_feature (1)..( 14): Result.005 file - promoters50/2991239
aataaaataaaatt

SEQ ID NO: 181654 - DNA, 14 bp, Unknown
  misc_feature (1)..( 14): Result.005 file - promoters50/2991239
agcaaaagaaatgg

SEQ ID NO: 181655 - DNA, 14 bp, Unknown
  misc_feature (1)..( 14): Result.005 file - promoters50/2991239
gtgaaaaaaaaaca

SEQ ID NO: 181656 - DNA, 14 bp, Unknown
  misc_feature (1)..( 14): Result.005 file - promoters50/2991239
agcaacagaagtag

SEQ ID NO: 181657 - DNA, 15 bp, Unknown
  misc_feature (1)..( 15): Result.005 file - promoters50/2991239
tcattaaaaatcaaa

SEQ ID NO: 181658 - DNA, 15 bp, Unknown
  misc_feature (1)..( 15): Result.005 file - promoters50/2991239
aaaaaaaaaatatca

SEQ ID NO: 181659 - DNA, 15 bp, Unknown
  misc_feature (1)..( 15): Result.005 file - promoters50/2991239
tcagtaaaaaaaaat

SEQ ID NO: 181660 - DNA, 15 bp, Unknown
  misc_feature (1)..( 15): Result.005 file - promoters50/2991239
aaaaaaaaaaacaaa

SEQ ID NO: 181661 - DNA, 15 bp, Unknown
  misc_feature (1)..( 15): Result.005 file - promoters50/2991239
tacaaaaaaaaaaaa

SEQ ID NO: 181662 - DNA, 15 bp, Unknown
  misc_feature (1)..( 15): Result.005 file - promoters50/2991239
agtgtacaaagggat

SEQ ID NO: 181663 - DNA, 15 bp, Unknown
  misc_feature (1)..( 15): Result.005 file - promoters50/2991239
gccaaccaaaccaat

SEQ ID NO: 181664 - DNA, 11 bp, Unknown
  misc_feature (1)..( 11): Result.005 file - promoters50/2991239
aaaaaaagcct

SEQ ID NO: 181665 - DNA, 11 bp, Unknown
  misc_feature (1)..( 11): Result.005 file - promoters50/2991239
caaaacagctt

SEQ ID NO: 181666 - DNA, 11 bp, Unknown
  misc_feature (1)..( 11): Result.005 file - promoters50/2991239
caaaaaagttt

SEQ ID NO: 181667 - DNA, 12 bp, Unknown
  misc_feature (1)..( 12): Result.005 file - promoters50/2991239
taaagaaagctc

SEQ ID NO: 181668 - DNA, 12 bp, Unknown
  misc_feature (1)..( 12): Result.005 file - promoters50/2991239
aaaaaaaaaaaa

SEQ ID NO: 181669 - DNA, 13 bp, Unknown
  misc_feature (1)..( 13): Result.005 file - promoters50/2991239
aaaaacaaatcag

SEQ ID NO: 181670 - DNA, 13 bp, Unknown
  misc_feature (1)..( 13): Result.005 file - promoters50/2991239
caaaccaataacc

SEQ ID NO: 181671 - DNA, 10 bp, Unknown
  misc_feature (1)..( 10): Result.005 file - promoters50/2991239
aaatacaaaa

SEQ ID NO: 181672 - DNA, 10 bp, Unknown
  misc_feature (1)..( 10): Result.005 file - promoters50/2991239
caaaacaaaa

SEQ ID NO: 181673 - DNA, 10 bp, Unknown
  misc_feature (1)..( 10): Result.005 file - promoters50/2991239
aaaaacaaat

SEQ ID NO: 181674 - DNA, 10 bp, Unknown
  misc_feature (1)..( 10): Result.005 file - promoters50/2991239
gtgtacaaag

SEQ ID NO: 181675 - DNA, 10 bp, Unknown
  misc_feature (1)..( 10): Result.005 file - promoters50/2991239
taaaaaaaaa

SEQ ID NO: 181676 - DNA, 10 bp, Unknown
  misc_feature (1)..( 10): Result.005 file - promoters50/2991239
ccaaaccaat

SEQ ID NO: 181677 - DNA, 8 bp, Unknown
  misc_feature (1)..( 8): Result.005 file - promoters50/2991333
aaaagaaa

SEQ ID NO: 181678 - DNA, 8 bp, Unknown
  misc_feature (1)..( 8): Result.005 file - promoters50/2991333
aaaataaa

SEQ ID NO: 181679 - DNA, 8 bp, Unknown
  misc_feature (1)..( 8): Result.005 file - promoters50/2991333
gtaataaa

SEQ ID NO: 181680 - DNA, 7 bp, Unknown
  misc_feature (1)..( 7): Result.005 file - promoters50/2991333
aatcaag

SEQ ID NO: 181681 - DNA, 7 bp, Unknown
  misc_feature (1)..( 7): Result.005 file - promoters50/2991333
aataaag

SEQ ID NO: 181682 - DNA, 7 bp, Unknown
  misc_feature (1)..( 7): Result.005 file - promoters50/2991333
aataaat

SEQ ID NO: 181683 - DNA, 8 bp, Unknown
  misc_feature (1)..( 8): Result.005 file - promoters50/2991371
aacaactt

SEQ ID NO: 181684 - DNA, 8 bp, Unknown
  misc_feature (1)..( 8): Result.005 file - promoters50/2991371
aacatctt

SEQ ID NO: 181685 - DNA, 8 bp, Unknown
  misc_feature (1)..( 8): Result.005 file - promoters50/2991371
atcatctt

SEQ ID NO: 181686 - DNA, 11 bp, Unknown
  misc_feature (1)..( 11): Result.005 file - promoters50/2991417
aaccaaaaaca

SEQ ID NO: 181687 - DNA, 11 bp, Unknown
  misc_feature (1)..( 11): Result.005 file - promoters50/2991417
taccaaatttt

SEQ ID NO: 181688 - DNA, 11 bp, Unknown
  misc_feature (1)..( 11): Result.005 file - promoters50/2991417
aactaaaaagt

SEQ ID NO: 181689 - DNA, 11 bp, Unknown
  misc_feature (1)..( 11): Result.005 file - promoters50/2991417
ctccaaacttt

SEQ ID NO: 181690 - DNA, 11 bp, Unknown
  misc_feature (1)..( 11): Result.005 file - promoters50/2991417
agctaacaaga

SEQ ID NO: 181691 - DNA, 9 bp, Unknown
  misc_feature (1)..( 9): Result.005 file - promoters50/2991417
ctatcatac

SEQ ID NO: 181692 - DNA, 9 bp, Unknown
  misc_feature (1)..( 9): Result.005 file - promoters50/2991417
gtatcttac

SEQ ID NO: 181693 - DNA, 9 bp, Unknown
  misc_feature (1)..( 9): Result.005 file - promoters50/2991417
ttattttat

SEQ ID NO: 181694 - DNA, 9 bp, Unknown
  misc_feature (1)..( 9): Result.005 file - promoters50/2991417
ttatttttg

SEQ ID NO: 181695 - DNA, 10 bp, Unknown
  misc_feature (1)..( 10): Result.005 file - promoters50/2991431
caaaattatt

SEQ ID NO: 181696 - DNA, 10 bp, Unknown
  misc_feature (1)..( 10): Result.005 file - promoters50/2991431
caaacttaac

SEQ ID NO: 181697 - DNA, 10 bp, Unknown
  misc_feature (1)..( 10): Result.005 file - promoters50/2991431
aagaatgatt

SEQ ID NO: 181698 - DNA, 7 bp, Unknown
  misc_feature (1)..( 7): Result.005 file - promoters50/2991431
aattaga

SEQ ID NO: 181699 - DNA, 7 bp, Unknown
  misc_feature (1)..( 7): Result.005 file - promoters50/2991431
aattagt

SEQ ID NO: 181700 - DNA, 7 bp, Unknown
  misc_feature (1)..( 7): Result.005 file - promoters50/2991431
gattaga

SEQ ID NO: 181701 - DNA, 11 bp, Unknown
  misc_feature (1)..( 11): Result.005 file - promoters50/2991431
ttgttaatctc

SEQ ID NO: 181702 - DNA, 11 bp, Unknown
  misc_feature (1)..( 11): Result.005 file - promoters50/2991431
gttttaaactc

SEQ ID NO: 181703 - DNA, 10 bp, Unknown
  misc_feature (1)..( 10): Result.005 file - promoters50/2991431
atttacactt

SEQ ID NO: 181704 - DNA, 11 bp, Unknown
  misc_feature (1)..( 11): Result.005 file - promoters50/2991431
gttataaatgt

SEQ ID NO: 181705 - DNA, 8 bp, Unknown
  misc_feature (1)..( 8): Result.005 file - promoters50/2991431
acacttta

SEQ ID NO: 181706 - DNA, 8 bp, Unknown
  misc_feature (1)..( 8): Result.005 file - promoters50/2991431
tgacttta

SEQ ID NO: 181707 - DNA, 9 bp, Unknown
  misc_feature (1)..( 9): Result.005 file - promoters50/2991431
gtacatttt

SEQ ID NO: 181708 - DNA, 9 bp, Unknown
  misc_feature (1)..( 9): Result.005 file - promoters50/2991431
ttagttaca

SEQ ID NO: 181709 - DNA, 9 bp, Unknown
  misc_feature (1)..( 9): Result.005 file - promoters50/2991431
ttatttaaa

SEQ ID NO: 181710 - DNA, 9 bp, Unknown
  misc_feature (1)..( 9): Result.005 file - promoters50/2991431
ttatatatt

SEQ ID NO: 181711 - DNA, 9 bp, Unknown
  misc_feature (1)..( 9): Result.005 file - promoters50/2991431
aattagaac

SEQ ID NO: 181712 - DNA, 9 bp, Unknown
  misc_feature (1)..( 9): Result.005 file - promoters50/2991431
atttagaaa

SEQ ID NO: 181713 - DNA, 10 bp, Unknown
  misc_feature (1)..( 10): Result.005 file - promoters50/2991431
atttaggaaa

SEQ ID NO: 181714 - DNA, 10 bp, Unknown
  misc_feature (1)..( 10): Result.005 file - promoters50/2991431
tgtttaatgt

SEQ ID NO: 181715 - DNA, 10 bp, Unknown
  misc_feature (1)..( 10): Result.005 file - promoters50/2991431
ctgttaatgg

SEQ ID NO: 181716 - DNA, 10 bp, Unknown
  misc_feature (1)..( 10): Result.005 file - promoters50/2991431
tgtttaatgt

SEQ ID NO: 181717 - DNA, 9 bp, Unknown
  misc_feature (1)..( 9): Result.005 file - promoters50/2991431
ttataaaaa

SEQ ID NO: 181718 - DNA, 9 bp, Unknown
  misc_feature (1)..( 9): Result.005 file - promoters50/2991431
ttataaaac

SEQ ID NO: 181719 - DNA, 9 bp, Unknown
  misc_feature (1)..( 9): Result.005 file - promoters50/2991431
ttgtaaaaa

SEQ ID NO: 181720 - DNA, 6 bp, Unknown
  misc_feature (1)..( 6): Result.005 file - promoters50/2991431
aaaaag

SEQ ID NO: 181721 - DNA, 6 bp, Unknown
  misc_feature (1)..( 6): Result.005 file - promoters50/2991431
aaaaag

SEQ ID NO: 181722 - DNA, 7 bp, Unknown
  misc_feature (1)..( 7): Result.005 file - promoters50/2991431
aaacaaa

SEQ ID NO: 181723 - DNA, 9 bp, Unknown
  misc_feature (1)..( 9): Result.005 file - promoters50/2991466
tcattttta

SEQ ID NO: 181724 - DNA, 9 bp, Unknown
  misc_feature (1)..( 9): Result.005 file - promoters50/2991466
tcaatttta

SEQ ID NO: 181725 - DNA, 9 bp, Unknown
  misc_feature (1)..( 9): Result.005 file - promoters50/2991466
tcattatta

SEQ ID NO: 181726 - DNA, 9 bp, Unknown
  misc_feature (1)..( 9): Result.005 file - promoters50/2991466
taaataata

SEQ ID NO: 181727 - DNA, 9 bp, Unknown
  misc_feature (1)..( 9): Result.005 file - promoters50/2991466
taactaaca

SEQ ID NO: 181728 - DNA, 9 bp, Unknown
  misc_feature (1)..( 9): Result.005 file - promoters50/2991466
gaaacaaat

SEQ ID NO: 181729 - DNA, 10 bp, Unknown
  misc_feature (1)..( 10): Result.005 file - promoters50/2991466
attattcaaa

SEQ ID NO: 181730 - DNA, 10 bp, Unknown
  misc_feature (1)..( 10): Result.005 file - promoters50/2991466
atttttcaaa

SEQ ID NO: 181731 - DNA, 10 bp, Unknown
  misc_feature (1)..( 10): Result.005 file - promoters50/2991466
atttttggaa

SEQ ID NO: 181732 - DNA, 6 bp, Unknown
  misc_feature (1)..( 6): Result.005 file - promoters50/2991466
aaaaat

SEQ ID NO: 181733 - DNA, 6 bp, Unknown
  misc_feature (1)..( 6): Result.005 file - promoters50/2991466
aaaaat

SEQ ID NO: 181734 - DNA, 6 bp, Unknown
  misc_feature (1)..( 6): Result.005 file - promoters50/2991466
aaaaaa

SEQ ID NO: 181735 - DNA, 10 bp, Unknown
  misc_feature (1)..( 10): Result.005 file - promoters50/2991489
tttgattaaa

SEQ ID NO: 181736 - DNA, 10 bp, Unknown
  misc_feature (1)..( 10): Result.005 file - promoters50/2991489
ttttattatt

SEQ ID NO: 181737 - DNA, 10 bp, Unknown
  misc_feature (1)..( 10): Result.005 file - promoters50/2991489
tgatattata

SEQ ID NO: 181738 - DNA, 10 bp, Unknown
  misc_feature (1)..( 10): Result.005 file - promoters50/2991489
gtttcttacg

SEQ ID NO: 181739 - DNA, 10 bp, Unknown
  misc_feature (1)..( 10): Result.005 file - promoters50/2991489
tcgtataatt

SEQ ID NO: 181740 - DNA, 10 bp, Unknown
  misc_feature (1)..( 10): Result.005 file - promoters50/2991489
actcataatt

SEQ ID NO: 181741 - DNA, 13 bp, Unknown
  misc_feature (1)..( 13): Result.005 file - promoters50/2991489
ttacttttattat

SEQ ID NO: 181742 - DNA, 13 bp, Unknown
  misc_feature (1)..( 13): Result.005 file - promoters50/2991489
ttacttttaacaa

SEQ ID NO: 181743 - DNA, 13 bp, Unknown
  misc_feature (1)..( 13): Result.005 file - promoters50/2991489
aggtttttatttc

SEQ ID NO: 181744 - DNA, 13 bp, Unknown
  misc_feature (1)..( 13): Result.005 file - promoters50/2991489
attctttttacag

SEQ ID NO: 181745 - DNA, 13 bp, Unknown
  misc_feature (1)..( 13): Result.005 file - promoters50/2991489
gagtttttttctt

SEQ ID NO: 181746 - DNA, 14 bp, Unknown
  misc_feature (1)..( 14): Result.005 file - promoters50/2991489
tcactttctatttg

SEQ ID NO: 181747 - DNA, 10 bp, Unknown
  misc_feature (1)..( 10): Result.005 file - promoters50/2991489
gttgttactt

SEQ ID NO: 181748 - DNA, 10 bp, Unknown
  misc_feature (1)..( 10): Result.005 file - promoters50/2991489
gtttttattt

SEQ ID NO: 181749 - DNA, 10 bp, Unknown
  misc_feature (1)..( 10): Result.005 file - promoters50/2991489
atttttactt

SEQ ID NO: 181750 - DNA, 10 bp, Unknown
  misc_feature (1)..( 10): Result.005 file - promoters50/2991489
ctttttacag

SEQ ID NO: 181751 - DNA, 10 bp, Unknown
  misc_feature (1)..( 10): Result.005 file - promoters50/2991489
tttttttctt

SEQ ID NO: 181752 - DNA, 10 bp, Unknown
  misc_feature (1)..( 10): Result.005 file - promoters50/2991489
ctttctattt

SEQ ID NO: 181753 - DNA, 7 bp, Unknown
  misc_feature (1)..( 7): Result.005 file - promoters50/2991507
gatcgag

SEQ ID NO: 181754 - DNA, 7 bp, Unknown
  misc_feature (1)..( 7): Result.005 file - promoters50/2991507
gatcgat

SEQ ID NO: 181755 - DNA, 7 bp, Unknown
  misc_feature (1)..( 7): Result.005 file - promoters50/2991507
gatggat

SEQ ID NO: 181756 - DNA, 7 bp, Unknown
  misc_feature (1)..( 7): Result.005 file - promoters50/2991507
tttcaca

SEQ ID NO: 181757 - DNA, 7 bp, Unknown
  misc_feature (1)..( 7): Result.005 file - promoters50/2991507
tttcact

SEQ ID NO: 181758 - DNA, 7 bp, Unknown
  misc_feature (1)..( 7): Result.005 file - promoters50/2991507
ttttaca

SEQ ID NO: 181759 - DNA, 8 bp, Unknown
  misc_feature (1)..( 8): Result.005 file - promoters50/2991507
tgttttta

SEQ ID NO: 181760 - DNA, 8 bp, Unknown
  misc_feature (1)..( 8): Result.005 file - promoters50/2991507
tgtttttt

SEQ ID NO: 181761 - DNA, 9 bp, Unknown
  misc_feature (1)..( 9): Result.005 file - promoters50/2991507
gatttatta

SEQ ID NO: 181762 - DNA, 14 bp, Unknown
  misc_feature (1)..( 14): Result.005 file - promoters50/2991507
atcaactaattttc

SEQ ID NO: 181763 - DNA, 14 bp, Unknown
  misc_feature (1)..( 14): Result.005 file - promoters50/2991507
ttttactaactttc

SEQ ID NO: 181764 - DNA, 14 bp, Unknown
  misc_feature (1)..( 14): Result.005 file - promoters50/2991507
ttttaataacagga

SEQ ID NO: 181765 - DNA, 7 bp, Unknown
  misc_feature (1)..( 7): Result.005 file - promoters50/2991507
taaaatt

SEQ ID NO: 181766 - DNA, 7 bp, Unknown
  misc_feature (1)..( 7): Result.005 file - promoters50/2991507
taaaatc

SEQ ID NO: 181767 - DNA, 7 bp, Unknown
  misc_feature (1)..( 7): Result.005 file - promoters50/2991507
caaaatc

SEQ ID NO: 181768 - DNA, 9 bp, Unknown
  misc_feature (1)..( 9): Result.005 file - promoters50/2991515
tcaagttcg

SEQ ID NO: 181769 - DNA, 9 bp, Unknown
  misc_feature (1)..( 9): Result.005 file - promoters50/2991515
tcatgttct

SEQ ID NO: 181770 - DNA, 9 bp, Unknown
  misc_feature (1)..( 9): Result.005 file - promoters50/2991515
tcttgttct

SEQ ID NO: 181771 - DNA, 8 bp, Unknown
  misc_feature (1)..( 8): Result.005 file - promoters50/2991515
tatggttt

SEQ ID NO: 181772 - DNA, 8 bp, Unknown
  misc_feature (1)..( 8): Result.005 file - promoters50/2991515
tatagttt

SEQ ID NO: 181773 - DNA, 8 bp, Unknown
  misc_feature (1)..( 8): Result.005 file - promoters50/2991515
aatggttg

SEQ ID NO: 181774 - DNA, 13 bp, Unknown
  misc_feature (1)..( 13): Result.005 file - promoters50/2991515
aattgttttttgc

SEQ ID NO: 181775 - DNA, 13 bp, Unknown
  misc_feature (1)..( 13): Result.005 file - promoters50/2991515
gtaaattttttgt

SEQ ID NO: 181776 - DNA, 13 bp, Unknown
  misc_feature (1)..( 13): Result.005 file - promoters50/2991515
ttttgtttttgta

SEQ ID NO: 181777 - DNA, 13 bp, Unknown
  misc_feature (1)..( 13): Result.005 file - promoters50/2991515
ataatgtttatgc

SEQ ID NO: 181778 - DNA, 9 bp, Unknown
  misc_feature (1)..( 9): Result.005 file - promoters50/2991515
agaaaaagt

SEQ ID NO: 181779 - DNA, 9 bp, Unknown
  misc_feature (1)..( 9): Result.005 file - promoters50/2991515
ttaaacagt

SEQ ID NO: 181780 - DNA, 9 bp, Unknown
  misc_feature (1)..( 9): Result.005 file - promoters50/2991515
agaaacagt

SEQ ID NO: 181781 - DNA, 11 bp, Unknown
  misc_feature (1)..( 11): Result.005 file - promoters50/2991515
aattaaatact

SEQ ID NO: 181782 - DNA, 11 bp, Unknown
  misc_feature (1)..( 11): Result.005 file - promoters50/2991515
aataaaaaact

SEQ ID NO: 181783 - DNA, 11 bp, Unknown
  misc_feature (1)..( 11): Result.005 file - promoters50/2991515
aattaaaatta

SEQ ID NO: 181784 - DNA, 7 bp, Unknown
  misc_feature (1)..( 7): Result.005 file - promoters50/2991515
tttgata

SEQ ID NO: 181785 - DNA, 7 bp, Unknown
  misc_feature (1)..( 7): Result.005 file - promoters50/2991515
tttaata

SEQ ID NO: 181786 - DNA, 7 bp, Unknown
  misc_feature (1)..( 7): Result.005 file - promoters50/2991515
tttaatt

SEQ ID NO: 181787 - DNA, 11 bp, Unknown
  misc_feature (1)..( 11): Result.005 file - promoters50/2991515
aacaaattcat

SEQ ID NO: 181788 - DNA, 11 bp, Unknown
  misc_feature (1)..( 11): Result.005 file - promoters50/2991515
tataaattcat

SEQ ID NO: 181789 - DNA, 11 bp, Unknown
  misc_feature (1)..( 11): Result.005 file - promoters50/2991515
tatatattaac

SEQ ID NO: 181790 - DNA, 8 bp, Unknown
  misc_feature (1)..( 8): Result.005 file - promoters50/2991515
agttttat

SEQ ID NO: 181791 - DNA, 8 bp, Unknown
  misc_feature (1)..( 8): Result.005 file - promoters50/2991515
tgttctat

SEQ ID NO: 181792 - DNA, 8 bp, Unknown
  misc_feature (1)..( 8): Result.005 file - promoters50/2991515
tgttctct

SEQ ID NO: 181793 - DNA, 11 bp, Unknown
  misc_feature (1)..( 11): Result.005 file - promoters50/2991515
atgttttgttg

SEQ ID NO: 181794 - DNA, 11 bp, Unknown
  misc_feature (1)..( 11): Result.005 file - promoters50/2991515
ctttttttttg

SEQ ID NO: 181795 - DNA, 12 bp, Unknown
  misc_feature (1)..( 12): Result.005 file - promoters50/2991515
tctttttatttg

SEQ ID NO: 181796 - DNA, 8 bp, Unknown
  misc_feature (1)..( 8): Result.005 file - promoters50/2991515
gaaacatt

SEQ ID NO: 181797 - DNA, 8 bp, Unknown
  misc_feature (1)..( 8): Result.005 file - promoters50/2991515
caaaaatt

SEQ ID NO: 181798 - DNA, 8 bp, Unknown
  misc_feature (1)..( 8): Result.005 file - promoters50/2991515
gaatcata

SEQ ID NO: 181799 - DNA, 8 bp, Unknown
  misc_feature (1)..( 8): Result.005 file - promoters50/2991944
aatacatt

SEQ ID NO: 181800 - DNA, 8 bp, Unknown
  misc_feature (1)..( 8): Result.005 file - promoters50/2991944
aataaatt

SEQ ID NO: 181801 - DNA, 8 bp, Unknown
  misc_feature (1)..( 8): Result.005 file - promoters50/2991944
aattaatt

SEQ ID NO: 181802 - DNA, 11 bp, Unknown
  misc_feature (1)..( 11): Result.005 file - promoters50/2991944
acatgataagc

SEQ ID NO: 181803 - DNA, 11 bp, Unknown
  misc_feature (1)..( 11): Result.005 file - promoters50/2991944
acataataata

SEQ ID NO: 181804 - DNA, 11 bp, Unknown
  misc_feature (1)..( 11): Result.005 file - promoters50/2991944
ttctgaaaagc

SEQ ID NO: 181805 - DNA, 10 bp, Unknown
  misc_feature (1)..( 10): Result.005 file - promoters50/2991944
aaaagtctaa

SEQ ID NO: 181806 - DNA, 10 bp, Unknown
  misc_feature (1)..( 10): Result.005 file - promoters50/2991944
aaaattctaa

SEQ ID NO: 181807 - DNA, 10 bp, Unknown
  misc_feature (1)..( 10): Result.005 file - promoters50/2991944
gcgtgtctaa

SEQ ID NO: 181808 - DNA, 8 bp, Unknown
  misc_feature (1)..( 8): Result.005 file - promoters50/2991944
ggcccaga

SEQ ID NO: 181809 - DNA, 8 bp, Unknown
  misc_feature (1)..( 8): Result.005 file - promoters50/2991944
ggcccatt

SEQ ID NO: 181810 - DNA, 8 bp, Unknown
  misc_feature (1)..( 8): Result.005 file - promoters50/2991944
agcccatt

SEQ ID NO: 181811 - DNA, 8 bp, Unknown
  misc_feature (1)..( 8): Result.005 file - promoters50/2991944
ttcgttac

SEQ ID NO: 181812 - DNA, 8 bp, Unknown
  misc_feature (1)..( 8): Result.005 file - promoters50/2991944
ttcattac

SEQ ID NO: 181813 - DNA, 8 bp, Unknown
  misc_feature (1)..( 8): Result.005 file - promoters50/2991944
gtcattaa

SEQ ID NO: 181814 - DNA, 9 bp, Unknown
  misc_feature (1)..( 9): Result.005 file - promoters50/2991944
tttaatatt

SEQ ID NO: 181815 - DNA, 9 bp, Unknown
  misc_feature (1)..( 9): Result.005 file - promoters50/2991944
tttactata

SEQ ID NO: 181816 - DNA, 9 bp, Unknown
  misc_feature (1)..( 9): Result.005 file - promoters50/2991944
gttattatt

SEQ ID NO: 181817 - DNA, 10 bp, Unknown
  misc_feature (1)..( 10): Result.005 file - promoters50/2991944
aaaaattaaa

SEQ ID NO: 181818 - DNA, 10 bp, Unknown
  misc_feature (1)..( 10): Result.005 file - promoters50/2991944
ccaaattaac

SEQ ID NO: 181819 - DNA, 10 bp, Unknown
  misc_feature (1)..( 10): Result.005 file - promoters50/2991944
tcaaataatt

SEQ ID NO: 181820 - DNA, 9 bp, Unknown
  misc_feature (1)..( 9): Result.005 file - promoters50/2991944
taaatcaca

SEQ ID NO: 181821 - DNA, 9 bp, Unknown
  misc_feature (1)..( 9): Result.005 file - promoters50/2991944
ataattaca

SEQ ID NO: 181822 - DNA, 9 bp, Unknown
  misc_feature (1)..( 9): Result.005 file - promoters50/2991944
atacttatt

SEQ ID NO: 181823 - DNA, 10 bp, Unknown
  misc_feature (1)..( 10): Result.005 file - promoters50/2991944
aataactgat

SEQ ID NO: 181824 - DNA, 10 bp, Unknown
  misc_feature (1)..( 10): Result.005 file - promoters50/2991944
aataaatgat

SEQ ID NO: 181825 - DNA, 10 bp, Unknown
  misc_feature (1)..( 10): Result.005 file - promoters50/2991944
attaacaaaa

SEQ ID NO: 181826 - DNA, 7 bp, Unknown
  misc_feature (1)..( 7): Result.005 file - promoters50/2991955
attgatt

SEQ ID NO: 181827 - DNA, 7 bp, Unknown
  misc_feature (1)..( 7): Result.005 file - promoters50/2991955
attaatt

SEQ ID NO: 181828 - DNA, 7 bp, Unknown
  misc_feature (1)..( 7): Result.005 file - promoters50/2991955
attaatg

SEQ ID NO: 181829 - DNA, 11 bp, Unknown
  misc_feature (1)..( 11): Result.005 file - promoters50/2991974
agttgtttttt

SEQ ID NO: 181830 - DNA, 11 bp, Unknown
  misc_feature (1)..( 11): Result.005 file - promoters50/2991974
tgttttttttt

SEQ ID NO: 181831 - DNA, 11 bp, Unknown
  misc_feature (1)..( 11): Result.005 file - promoters50/2991974
agtggttggga

SEQ ID NO: 181832 - DNA, 12 bp, Unknown
  misc_feature (1)..( 12): Result.005 file - promoters50/2992000
attggaaaggta

SEQ ID NO: 181833 - DNA, 12 bp, Unknown
  misc_feature (1)..( 12): Result.005 file - promoters50/2992000
atttgaaagaca

SEQ ID NO: 181834 - DNA, 12 bp, Unknown
  misc_feature (1)..( 12): Result.005 file - promoters50/2992000
ttgggaaaaaca

SEQ ID NO: 181835 - DNA, 7 bp, Unknown
  misc_feature (1)..( 7): Result.005 file - promoters50/2992181
ttaaaat

SEQ ID NO: 181836 - DNA, 7 bp, Unknown
  misc_feature (1)..( 7): Result.005 file - promoters50/2992181
ttaaaag

SEQ ID NO: 181837 - DNA, 7 bp, Unknown
  misc_feature (1)..( 7): Result.005 file - promoters50/2992181
ttacaat

SEQ ID NO: 181838 - DNA, 7 bp, Unknown
  misc_feature (1)..( 7): Result.005 file - promoters50/2992181
tttatct

SEQ ID NO: 181839 - DNA, 7 bp, Unknown
  misc_feature (1)..( 7): Result.005 file - promoters50/2992181
gttatct

SEQ ID NO: 181840 - DNA, 7 bp, Unknown
  misc_feature (1)..( 7): Result.005 file - promoters50/2992181
gttttct

SEQ ID NO: 181841 - DNA, 8 bp, Unknown
  misc_feature (1)..( 8): Result.005 file - promoters50/2992181
cttatgta

SEQ ID NO: 181842 - DNA, 8 bp, Unknown
  misc_feature (1)..( 8): Result.005 file - promoters50/2992181
tttacgta

SEQ ID NO: 181843 - DNA, 9 bp, Unknown
  misc_feature (1)..( 9): Result.005 file - promoters50/2992181
tttaacgtt

SEQ ID NO: 181844 - DNA, 9 bp, Unknown
  misc_feature (1)..( 9): Result.005 file - promoters50/2992181
cataataat

SEQ ID NO: 181845 - DNA, 9 bp, Unknown
  misc_feature (1)..( 9): Result.005 file - promoters50/2992181
gataaaaat

SEQ ID NO: 181846 - DNA, 9 bp, Unknown
  misc_feature (1)..( 9): Result.005 file - promoters50/2992181
aattatacc

SEQ ID NO: 181847 - DNA, 7 bp, Unknown
  misc_feature (1)..( 7): Result.005 file - promoters50/2992181
aactaat

SEQ ID NO: 181848 - DNA, 7 bp, Unknown
  misc_feature (1)..( 7): Result.005 file - promoters50/2992181
aacaaat

SEQ ID NO: 181849 - DNA, 7 bp, Unknown
  misc_feature (1)..( 7): Result.005 file - promoters50/2992181
aacaaag

SEQ ID NO: 181850 - DNA, 8 bp, Unknown
  misc_feature (1)..( 8): Result.005 file - promoters50/2992181
gaagccaa

SEQ ID NO: 181851 - DNA, 8 bp, Unknown
  misc_feature (1)..( 8): Result.005 file - promoters50/2992181
aaagacaa

SEQ ID NO: 181852 - DNA, 8 bp, Unknown
  misc_feature (1)..( 8): Result.005 file - promoters50/2992181
aaaaacaa

SEQ ID NO: 181853 - DNA, 9 bp, Unknown
  misc_feature (1)..( 9): Result.005 file - promoters50/2992316
tttatcatt

SEQ ID NO: 181854 - DNA, 9 bp, Unknown
  misc_feature (1)..( 9): Result.005 file - promoters50/2992316
tctatcatc

SEQ ID NO: 181855 - DNA, 9 bp, Unknown
  misc_feature (1)..( 9): Result.005 file - promoters50/2992316
catattatt

SEQ ID NO: 181856 - DNA, 9 bp, Unknown
  misc_feature (1)..( 9): Result.005 file - promoters50/2992316
catattacc

SEQ ID NO: 181857 - DNA, 11 bp, Unknown
  misc_feature (1)..( 11): Result.005 file - promoters50/2992316
tcccccatgag

SEQ ID NO: 181858 - DNA, 11 bp, Unknown
  misc_feature (1)..( 11): Result.005 file - promoters50/2992316
tccaccattca

SEQ ID NO: 181859 - DNA, 11 bp, Unknown
  misc_feature (1)..( 11): Result.005 file - promoters50/2992316
ccaaccaatca

SEQ ID NO: 181860 - DNA, 11 bp, Unknown
  misc_feature (1)..( 11): Result.005 file - promoters50/2992316
acaaacattgt

SEQ ID NO: 181861 - DNA, 21 bp, Unknown
  misc_feature (1)..( 21): Result.005 file - promoters50/2992349
attgtgtgcatttgtatgaag

SEQ ID NO: 181862 - DNA, 21 bp, Unknown
  misc_feature (1)..( 21): Result.005 file - promoters50/2992349
tttttgatcatttgtggcagc

SEQ ID NO: 181863 - DNA, 21 bp, Unknown
  misc_feature (1)..( 21): Result.005 file - promoters50/2992349
atacatttcatatgtttccaa

SEQ ID NO: 181864 - DNA, 21 bp, Unknown
  misc_feature (1)..( 21): Result.005 file - promoters50/2992349
aaaaacaaaatttctatcatt

SEQ ID NO: 181865 - DNA, 21 bp, Unknown
  misc_feature (1)..( 21): Result.005 file - promoters50/2992349
aatttcactttttctataaag

SEQ ID NO: 181866 - DNA, 21 bp, Unknown
  misc_feature (1)..( 21): Result.005 file - promoters50/2992349
aaaaaccaaatttcaataacc

SEQ ID NO: 181867 - DNA, 21 bp, Unknown
  misc_feature (1)..( 21): Result.005 file - promoters50/2992349
tgtggtaaaacttctatccat

SEQ ID NO: 181868 - DNA, 11 bp, Unknown
  misc_feature (1)..( 11): Result.005 file - promoters50/2992349
ggaactaaaaa

SEQ ID NO: 181869 - DNA, 11 bp, Unknown
  misc_feature (1)..( 11): Result.005 file - promoters50/2992349
ccaactaaagt

SEQ ID NO: 181870 - DNA, 11 bp, Unknown
  misc_feature (1)..( 11): Result.005 file - promoters50/2992349
ttaacaaaaaa

SEQ ID NO: 181871 - DNA, 11 bp, Unknown
  misc_feature (1)..( 11): Result.005 file - promoters50/2992349
caaacaaaacc

SEQ ID NO: 181872 - DNA, 11 bp, Unknown
  misc_feature (1)..( 11): Result.005 file - promoters50/2992349
aaaaataaata

SEQ ID NO: 181873 - DNA, 11 bp, Unknown
  misc_feature (1)..( 11): Result.005 file - promoters50/2992349
acaaaaaaaat

SEQ ID NO: 181874 - DNA, 11 bp, Unknown
  misc_feature (1)..( 11): Result.005 file - promoters50/2992349
ttaccaaaaat

SEQ ID NO: 181875 - DNA, 9 bp, Unknown
  misc_feature (1)..( 9): Result.005 file - promoters50/2992349
tcacaaatc

SEQ ID NO: 181876 - DNA, 9 bp, Unknown
  misc_feature (1)..( 9): Result.005 file - promoters50/2992349
aaacaaatc

SEQ ID NO: 181877 - DNA, 9 bp, Unknown
  misc_feature (1)..( 9): Result.005 file - promoters50/2992349
gtacaaata

SEQ ID NO: 181878 - DNA, 9 bp, Unknown
  misc_feature (1)..( 9): Result.005 file - promoters50/2992349
tcataaata

SEQ ID NO: 181879 - DNA, 9 bp, Unknown
  misc_feature (1)..( 9): Result.005 file - promoters50/2992349
tattaaata

SEQ ID NO: 181880 - DNA, 9 bp, Unknown
  misc_feature (1)..( 9): Result.005 file - promoters50/2992349
ttatatata

SEQ ID NO: 181881 - DNA, 14 bp, Unknown
  misc_feature (1)..( 14): Result.005 file - promoters50/2992349
ttttacaaagttta

SEQ ID NO: 181882 - DNA, 14 bp, Unknown
  misc_feature (1)..( 14): Result.005 file - promoters50/2992349
aaaaacaaaatttc

SEQ ID NO: 181883 - DNA, 14 bp, Unknown
  misc_feature (1)..( 14): Result.005 file - promoters50/2992349
ttcagtaaaatttc

SEQ ID NO: 181884 - DNA, 14 bp, Unknown
  misc_feature (1)..( 14): Result.005 file - promoters50/2992349
aaaaaccaaatttc

SEQ ID NO: 181885 - DNA, 14 bp, Unknown
  misc_feature (1)..( 14): Result.005 file - promoters50/2992349
tgtggtaaaacttc

SEQ ID NO: 181886 - DNA, 14 bp, Unknown
  misc_feature (1)..( 14): Result.005 file - promoters50/2992349
tcaaagaaagaaac

SEQ ID NO: 181887 - DNA, 14 bp, Unknown
  misc_feature (1)..( 14): Result.005 file - promoters50/2992349
aaaattaaaatcaa

SEQ ID NO: 181888 - DNA, 10 bp, Unknown
  misc_feature (1)..( 10): Result.005 file - promoters50/2992349
aacacataat

SEQ ID NO: 181889 - DNA, 10 bp, Unknown
  misc_feature (1)..( 10): Result.005 file - promoters50/2992349
tacaaataaa

SEQ ID NO: 181890 - DNA, 10 bp, Unknown
  misc_feature (1)..( 10): Result.005 file - promoters50/2992349
ttaaaataca

SEQ ID NO: 181891 - DNA, 10 bp, Unknown
  misc_feature (1)..( 10): Result.005 file - promoters50/2992349
caaaactaca

SEQ ID NO: 181892 - DNA, 10 bp, Unknown
  misc_feature (1)..( 10): Result.005 file - promoters50/2992349
agaaaatagt

SEQ ID NO: 181893 - DNA, 10 bp, Unknown
  misc_feature (1)..( 10): Result.005 file - promoters50/2992349
agagaatggc

SEQ ID NO: 181894 - DNA, 12 bp, Unknown
  misc_feature (1)..( 12): Result.005 file - promoters50/2992349
tttttataaaaa

SEQ ID NO: 181895 - DNA, 12 bp, Unknown
  misc_feature (1)..( 12): Result.005 file - promoters50/2992349
tgtatattaaat

SEQ ID NO: 181896 - DNA, 12 bp, Unknown
  misc_feature (1)..( 12): Result.005 file - promoters50/2992349
attatataaaca

SEQ ID NO: 181897 - DNA, 12 bp, Unknown
  misc_feature (1)..( 12): Result.005 file - promoters50/2992349
attatatataga

SEQ ID NO: 181898 - DNA, 12 bp, Unknown
  misc_feature (1)..( 12): Result.005 file - promoters50/2992349
ccagaattaaac

SEQ ID NO: 181899 - DNA, 12 bp, Unknown
  misc_feature (1)..( 12): Result.005 file - promoters50/2992349
atctcataaata

SEQ ID NO: 181900 - DNA, 16 bp, Unknown
  misc_feature (1)..( 16): Result.005 file - promoters50/2992349
ctaaaaagtatttttg

SEQ ID NO: 181901 - DNA, 16 bp, Unknown
  misc_feature (1)..( 16): Result.005 file - promoters50/2992349
ctaaaaacaaaatttc

SEQ ID NO: 181902 - DNA, 16 bp, Unknown
  misc_feature (1)..( 16): Result.005 file - promoters50/2992349
acaaaaaccaaatttc

SEQ ID NO: 181903 - DNA, 16 bp, Unknown
  misc_feature (1)..( 16): Result.005 file - promoters50/2992349
ggtaaaacttctatcc

SEQ ID NO: 181904 - DNA, 16 bp, Unknown
  misc_feature (1)..( 16): Result.005 file - promoters50/2992349
ttaaaatcaagaatac

SEQ ID NO: 181905 - DNA, 16 bp, Unknown
  misc_feature (1)..( 16): Result.005 file - promoters50/2992349
gtaaaatttcactttt

SEQ ID NO: 181906 - DNA, 13 bp, Unknown
  misc_feature (1)..( 13): Result.005 file - promoters50/2992349
attctacataatt

SEQ ID NO: 181907 - DNA, 13 bp, Unknown
  misc_feature (1)..( 13): Result.005 file - promoters50/2992349
catttacatcatt

SEQ ID NO: 181908 - DNA, 13 bp, Unknown
  misc_feature (1)..( 13): Result.005 file - promoters50/2992349
aaactacatattc

SEQ ID NO: 181909 - DNA, 13 bp, Unknown
  misc_feature (1)..( 13): Result.005 file - promoters50/2992349
aaaatacagctgt

SEQ ID NO: 181910 - DNA, 13 bp, Unknown
  misc_feature (1)..( 13): Result.005 file - promoters50/2992349
aaaatagtgttaa

SEQ ID NO: 181911 - DNA, 13 bp, Unknown
  misc_feature (1)..( 13): Result.005 file - promoters50/2992349
ataatagagaatg

SEQ ID NO: 181912 - DNA, 15 bp, Unknown
  misc_feature (1)..( 15): Result.005 file - promoters50/2992349
aaaaaccaaatttca

SEQ ID NO: 181913 - DNA, 15 bp, Unknown
  misc_feature (1)..( 15): Result.005 file - promoters50/2992349
taaaatcaagaatac

SEQ ID NO: 181914 - DNA, 15 bp, Unknown
  misc_feature (1)..( 15): Result.005 file - promoters50/2992349
taaaaacaaaatttc

SEQ ID NO: 181915 - DNA, 15 bp, Unknown
  misc_feature (1)..( 15): Result.005 file - promoters50/2992349
ttcaaagaaagaaac

SEQ ID NO: 181916 - DNA, 15 bp, Unknown
  misc_feature (1)..( 15): Result.005 file - promoters50/2992349
tgaaaaaaaaatgtg

SEQ ID NO: 181917 - DNA, 15 bp, Unknown
  misc_feature (1)..( 15): Result.005 file - promoters50/2992349
taaaatttcactttt

SEQ ID NO: 181918 - DNA, 11 bp, Unknown
  misc_feature (1)..( 11): Result.005 file - promoters50/2992396
cgccacaccaa

SEQ ID NO: 181919 - DNA, 11 bp, Unknown
  misc_feature (1)..( 11): Result.005 file - promoters50/2992396
agccacaagcg

SEQ ID NO: 181920 - DNA, 11 bp, Unknown
  misc_feature (1)..( 11): Result.005 file - promoters50/2992396
agctacaggcg

SEQ ID NO: 181921 - DNA, 11 bp, Unknown
  misc_feature (1)..( 11): Result.005 file - promoters50/2992722
cattattaatt

SEQ ID NO: 181922 - DNA, 11 bp, Unknown
  misc_feature (1)..( 11): Result.005 file - promoters50/2992722
ttgtataaatt

SEQ ID NO: 181923 - DNA, 11 bp, Unknown
  misc_feature (1)..( 11): Result.005 file - promoters50/2992722
atttactaaaa

SEQ ID NO: 181924 - DNA, 11 bp, Unknown
  misc_feature (1)..( 11): Result.005 file - promoters50/2992722
ttgtataaaat

SEQ ID NO: 181925 - DNA, 11 bp, Unknown
  misc_feature (1)..( 11): Result.005 file - promoters50/2992722
ttgtatattag

SEQ ID NO: 181926 - DNA, 12 bp, Unknown
  misc_feature (1)..( 12): Result.005 file - promoters50/2992722
gagaactgaaag

SEQ ID NO: 181927 - DNA, 12 bp, Unknown
  misc_feature (1)..( 12): Result.005 file - promoters50/2993154
cattttaaaatt

SEQ ID NO: 181928 - DNA, 12 bp, Unknown
  misc_feature (1)..( 12): Result.005 file - promoters50/2993154
cattctaaagaa

SEQ ID NO: 181929 - DNA, 12 bp, Unknown
  misc_feature (1)..( 12): Result.005 file - promoters50/2993154
cagcctaaggaa

SEQ ID NO: 181930 - DNA, 10 bp, Unknown
  misc_feature (1)..( 10): Result.005 file - promoters50/2993154
ccaagatctt

SEQ ID NO: 181931 - DNA, 10 bp, Unknown
  misc_feature (1)..( 10): Result.005 file - promoters50/2993154
taaagaactt

SEQ ID NO: 181932 - DNA, 11 bp, Unknown
  misc_feature (1)..( 11): Result.005 file - promoters50/2993154
ctaaggaagag

SEQ ID NO: 181933 - DNA, 8 bp, Unknown
  misc_feature (1)..( 8): Result.005 file - promoters50/2993154
tttaattt

SEQ ID NO: 181934 - DNA, 8 bp, Unknown
  misc_feature (1)..( 8): Result.005 file - promoters50/2993154
attaattt

SEQ ID NO: 181935 - DNA, 9 bp, Unknown
  misc_feature (1)..( 9): Result.005 file - promoters50/2993154
gttcaatga

SEQ ID NO: 181936 - DNA, 9 bp, Unknown
  misc_feature (1)..( 9): Result.005 file - promoters50/2993154
atttgaagg

SEQ ID NO: 181937 - DNA, 9 bp, Unknown
  misc_feature (1)..( 9): Result.005 file - promoters50/2993154
ttttcaagt

SEQ ID NO: 181938 - DNA, 9 bp, Unknown
  misc_feature (1)..( 9): Result.005 file - promoters50/2993154
ttttcaagt

SEQ ID NO: 181939 - DNA, 9 bp, Unknown
  misc_feature (1)..( 9): Result.005 file - promoters50/2993154
aaattagat

SEQ ID NO: 181940 - DNA, 9 bp, Unknown
  misc_feature (1)..( 9): Result.005 file - promoters50/2993154
gcattagac

SEQ ID NO: 181941 - DNA, 9 bp, Unknown
  misc_feature (1)..( 9): Result.005 file - promoters50/2993154
aaaatagat

SEQ ID NO: 181942 - DNA, 7 bp, Unknown
  misc_feature (1)..( 7): Result.005 file - promoters50/2993154
atttttt

SEQ ID NO: 181943 - DNA, 7 bp, Unknown
  misc_feature (1)..( 7): Result.005 file - promoters50/2993154
attattt

SEQ ID NO: 181944 - DNA, 7 bp, Unknown
  misc_feature (1)..( 7): Result.005 file - promoters50/2993154
attatta

SEQ ID NO: 181945 - DNA, 13 bp, Unknown
  misc_feature (1)..( 13): Result.005 file - promoters50/2993154
aattacaaataaa

SEQ ID NO: 181946 - DNA, 13 bp, Unknown
  misc_feature (1)..( 13): Result.005 file - promoters50/2993154
aattaaaaaaaaa

SEQ ID NO: 181947 - DNA, 13 bp, Unknown
  misc_feature (1)..( 13): Result.005 file - promoters50/2993154
aagtgttaataaa

SEQ ID NO: 181948 - DNA, 9 bp, Unknown
  misc_feature (1)..( 9): Result.005 file - promoters50/2993240
aatttaaac

SEQ ID NO: 181949 - DNA, 9 bp, Unknown
  misc_feature (1)..( 9): Result.005 file - promoters50/2993240
aattttaac

SEQ ID NO: 181950 - DNA, 9 bp, Unknown
  misc_feature (1)..( 9): Result.005 file - promoters50/2993240
aatataaaa

SEQ ID NO: 181951 - DNA, 6 bp, Unknown
  misc_feature (1)..( 6): Result.005 file - promoters50/2993240
aaccgt

SEQ ID NO: 181952 - DNA, 6 bp, Unknown
  misc_feature (1)..( 6): Result.005 file - promoters50/2993240
aaccgt

SEQ ID NO: 181953 - DNA, 6 bp, Unknown
  misc_feature (1)..( 6): Result.005 file - promoters50/2993240
aaccgt

SEQ ID NO: 181954 - DNA, 8 bp, Unknown
  misc_feature (1)..( 8): Result.005 file - promoters50/2993642
gatttttt

SEQ ID NO: 181955 - DNA, 8 bp, Unknown
  misc_feature (1)..( 8): Result.005 file - promoters50/2993642
tattttta

SEQ ID NO: 181956 - DNA, 9 bp, Unknown
  misc_feature (1)..( 9): Result.005 file - promoters50/2993642
gattctttg

SEQ ID NO: 181957 - DNA, 9 bp, Unknown
  misc_feature (1)..( 9): Result.005 file - promoters50/2993642
gattcttac

SEQ ID NO: 181958 - DNA, 9 bp, Unknown
  misc_feature (1)..( 9): Result.005 file - promoters50/2993642
gatttttct

SEQ ID NO: 181959 - DNA, 9 bp, Unknown
  misc_feature (1)..( 9): Result.005 file - promoters50/2993642
cattcgtac

SEQ ID NO: 181960 - DNA, 9 bp, Unknown
  misc_feature (1)..( 9): Result.005 file - promoters50/2993642
aaatctttg

SEQ ID NO: 181961 - DNA, 15 bp, Unknown
  misc_feature (1)..( 15): Result.005 file - promoters50/2993642
aaaaaactattgggg

SEQ ID NO: 181962 - DNA, 15 bp, Unknown
  misc_feature (1)..( 15): Result.005 file - promoters50/2993642
aataaaatatttaaa

SEQ ID NO: 181963 - DNA, 15 bp, Unknown
  misc_feature (1)..( 15): Result.005 file - promoters50/2993642
aataaagtatttaaa

SEQ ID NO: 181964 - DNA, 15 bp, Unknown
  misc_feature (1)..( 15): Result.005 file - promoters50/2993642
aacaaaaaaattgaa

SEQ ID NO: 181965 - DNA, 15 bp, Unknown
  misc_feature (1)..( 15): Result.005 file - promoters50/2993642
tatcgtctatttaaa

SEQ ID NO: 181966 - DNA, 15 bp, Unknown
  misc_feature (1)..( 15): Result.005 file - promoters50/2993642
agaaaaagattgtgt

SEQ ID NO: 181967 - DNA, 8 bp, Unknown
  misc_feature (1)..( 8): Result.005 file - promoters50/2994131
gcattaga

SEQ ID NO: 181968 - DNA, 8 bp, Unknown
  misc_feature (1)..( 8): Result.005 file - promoters50/2994131
acataaga

SEQ ID NO: 181969 - DNA, 8 bp, Unknown
  misc_feature (1)..( 8): Result.005 file - promoters50/2994131
acacaagt

SEQ ID NO: 181970 - DNA, 7 bp, Unknown
  misc_feature (1)..( 7): Result.005 file - promoters50/2994131
ggcacat

SEQ ID NO: 181971 - DNA, 7 bp, Unknown
  misc_feature (1)..( 7): Result.005 file - promoters50/2994131
ggcccat

SEQ ID NO: 181972 - DNA, 7 bp, Unknown
  misc_feature (1)..( 7): Result.005 file - promoters50/2994131
ggcccat

SEQ ID NO: 181973 - DNA, 9 bp, Unknown
  misc_feature (1)..( 9): Result.005 file - promoters50/2994131
attttagat

SEQ ID NO: 181974 - DNA, 9 bp, Unknown
  misc_feature (1)..( 9): Result.005 file - promoters50/2994131
attttaaac

SEQ ID NO: 181975 - DNA, 9 bp, Unknown
  misc_feature (1)..( 9): Result.005 file - promoters50/2994131
tttttaaaa

SEQ ID NO: 181976 - DNA, 9 bp, Unknown
  misc_feature (1)..( 9): Result.005 file - promoters50/2994131
taccacaac

SEQ ID NO: 181977 - DNA, 9 bp, Unknown
  misc_feature (1)..( 9): Result.005 file - promoters50/2994131
tacaacaac

SEQ ID NO: 181978 - DNA, 9 bp, Unknown
  misc_feature (1)..( 9): Result.005 file - promoters50/2994131
tactacagt

SEQ ID NO: 181979 - DNA, 9 bp, Unknown
  misc_feature (1)..( 9): Result.005 file - promoters50/2994131
taaaactac

SEQ ID NO: 181980 - DNA, 9 bp, Unknown
  misc_feature (1)..( 9): Result.005 file - promoters50/2994131
aaaaactaa

SEQ ID NO: 181981 - DNA, 9 bp, Unknown
  misc_feature (1)..( 9): Result.005 file - promoters50/2994131
tacaacaac

SEQ ID NO: 181982 - DNA, 12 bp, Unknown
  misc_feature (1)..( 12): Result.005 file - promoters50/2994202
aagacatttggg

SEQ ID NO: 181983 - DNA, 12 bp, Unknown
  misc_feature (1)..( 12): Result.005 file - promoters50/2994202
ttggcatttgga

SEQ ID NO: 181984 - DNA, 12 bp, Unknown
  misc_feature (1)..( 12): Result.005 file - promoters50/2994202
cctacattttat

SEQ ID NO: 181985 - DNA, 12 bp, Unknown
  misc_feature (1)..( 12): Result.005 file - promoters50/2994202
cactgttttgac

SEQ ID NO: 181986 - DNA, 12 bp, Unknown
  misc_feature (1)..( 12): Result.005 file - promoters50/2994202
tgaacattatat

SEQ ID NO: 181987 - DNA, 12 bp, Unknown
  misc_feature (1)..( 12): Result.005 file - promoters50/2994202
tatactttcgcc

SEQ ID NO: 181988 - DNA, 7 bp, Unknown
  misc_feature (1)..( 7): Result.005 file - promoters50/2994225
cttttat

SEQ ID NO: 181989 - DNA, 7 bp, Unknown
  misc_feature (1)..( 7): Result.005 file - promoters50/2994225
tttttat

SEQ ID NO: 181990 - DNA, 7 bp, Unknown
  misc_feature (1)..( 7): Result.005 file - promoters50/2994225
tttttaa

SEQ ID NO: 181991 - DNA, 8 bp, Unknown
  misc_feature (1)..( 8): Result.005 file - promoters50/2994869
aaagatta

SEQ ID NO: 181992 - DNA, 8 bp, Unknown
  misc_feature (1)..( 8): Result.005 file - promoters50/2994869
aaagattc

SEQ ID NO: 181993 - DNA, 8 bp, Unknown
  misc_feature (1)..( 8): Result.005 file - promoters50/2994869
ccagattc

SEQ ID NO: 181994 - DNA, 10 bp, Unknown
  misc_feature (1)..( 10): Result.005 file - promoters50/2994916
agaaacaaaa

SEQ ID NO: 181995 - DNA, 10 bp, Unknown
  misc_feature (1)..( 10): Result.005 file - promoters50/2994916
ttgaacaaac

SEQ ID NO: 181996 - DNA, 10 bp, Unknown
  misc_feature (1)..( 10): Result.005 file - promoters50/2994916
acaaataaaa

SEQ ID NO: 181997 - DNA, 10 bp, Unknown
  misc_feature (1)..( 10): Result.005 file - promoters50/2994916
ctaaacaaca

SEQ ID NO: 181998 - DNA, 10 bp, Unknown
  misc_feature (1)..( 10): Result.005 file - promoters50/2994916
taaaacaaag

SEQ ID NO: 181999 - DNA, 11 bp, Unknown
  misc_feature (1)..( 11): Result.005 file - promoters50/2994916
ttaaatcaaat

SEQ ID NO: 182000 - DNA, 14 bp, Unknown
  misc_feature (1)..( 14): Result.005 file - promoters50/2994916
ggttcctaaatcaa

SEQ ID NO: 182001 - DNA, 14 bp, Unknown
  misc_feature (1)..( 14): Result.005 file - promoters50/2994916
atacactaaaacaa

SEQ ID NO: 182002 - DNA, 14 bp, Unknown
  misc_feature (1)..( 14): Result.005 file - promoters50/2994916
aaaaactaaatgat

SEQ ID NO: 182003 - DNA, 13 bp, Unknown
  misc_feature (1)..( 13): Result.005 file - promoters50/2994916
tcttctaaaacat

SEQ ID NO: 182004 - DNA, 14 bp, Unknown
  misc_feature (1)..( 14): Result.005 file - promoters50/2994916
aaattataacacac

SEQ ID NO: 182005 - DNA, 14 bp, Unknown
  misc_feature (1)..( 14): Result.005 file - promoters50/2994916
aaaaagtaaataca

SEQ ID NO: 182006 - DNA, 15 bp, Unknown
  misc_feature (1)..( 15): Result.005 file - promoters50/2994916
caacaatcttaaaat

SEQ ID NO: 182007 - DNA, 15 bp, Unknown
  misc_feature (1)..( 15): Result.005 file - promoters50/2994916
atacaattttaagcg

SEQ ID NO: 182008 - DNA, 15 bp, Unknown
  misc_feature (1)..( 15): Result.005 file - promoters50/2994916
ggggtatctgaaaaa

SEQ ID NO: 182009 - DNA, 15 bp, Unknown
  misc_feature (1)..( 15): Result.005 file - promoters50/2994916
gactaattttagggt

SEQ ID NO: 182010 - DNA, 15 bp, Unknown
  misc_feature (1)..( 15): Result.005 file - promoters50/2994916
ttactattcctaccc

SEQ ID NO: 182011 - DNA, 15 bp, Unknown
  misc_feature (1)..( 15): Result.005 file - promoters50/2994916
atacaataagttgta

SEQ ID NO: 182012 - DNA, 15 bp, Unknown
  misc_feature (1)..( 15): Result.005 file - promoters50/2994916
acacaccaagaaaaa

SEQ ID NO: 182013 - DNA, 12 bp, Unknown
  misc_feature (1)..( 12): Result.005 file - promoters50/2994916
atttaaaaacta

SEQ ID NO: 182014 - DNA, 12 bp, Unknown
  misc_feature (1)..( 12): Result.005 file - promoters50/2994916
caataaaaaaaa

SEQ ID NO: 182015 - DNA, 12 bp, Unknown
  misc_feature (1)..( 12): Result.005 file - promoters50/2994916
atttcaaatata

SEQ ID NO: 182016 - DNA, 12 bp, Unknown
  misc_feature (1)..( 12): Result.005 file - promoters50/2994916
cgtcaaaaaagt

SEQ ID NO: 182017 - DNA, 12 bp, Unknown
  misc_feature (1)..( 12): Result.005 file - promoters50/2994916
aatttaatttct

SEQ ID NO: 182018 - DNA, 12 bp, Unknown
  misc_feature (1)..( 12): Result.005 file - promoters50/2994916
caaaaaaattca

SEQ ID NO: 182019 - DNA, 8 bp, Unknown
  misc_feature (1)..( 8): Result.005 file - promoters50/2994916
aaaacaaa

SEQ ID NO: 182020 - DNA, 8 bp, Unknown
  misc_feature (1)..( 8): Result.005 file - promoters50/2994916
aaaacaaa

SEQ ID NO: 182021 - DNA, 8 bp, Unknown
  misc_feature (1)..( 8): Result.005 file - promoters50/2994916
aaatcaaa

SEQ ID NO: 182022 - DNA, 8 bp, Unknown
  misc_feature (1)..( 8): Result.005 file - promoters50/2994916
caaataaa

SEQ ID NO: 182023 - DNA, 8 bp, Unknown
  misc_feature (1)..( 8): Result.005 file - promoters50/2994916
taaacaac

SEQ ID NO: 182024 - DNA, 8 bp, Unknown
  misc_feature (1)..( 8): Result.005 file - promoters50/2994916
tgaacaaa

SEQ ID NO: 182025 - DNA, 11 bp, Unknown
  misc_feature (1)..( 11): Result.005 file - promoters50/2994916
tcacaattttt

SEQ ID NO: 182026 - DNA, 11 bp, Unknown
  misc_feature (1)..( 11): Result.005 file - promoters50/2994916
gttcaatttaa

SEQ ID NO: 182027 - DNA, 11 bp, Unknown
  misc_feature (1)..( 11): Result.005 file - promoters50/2994916
atataatttta

SEQ ID NO: 182028 - DNA, 11 bp, Unknown
  misc_feature (1)..( 11): Result.005 file - promoters50/2994916
aagatattttt

SEQ ID NO: 182029 - DNA, 11 bp, Unknown
  misc_feature (1)..( 11): Result.005 file - promoters50/2994916
gttaaatttca

SEQ ID NO: 182030 - DNA, 11 bp, Unknown
  misc_feature (1)..( 11): Result.005 file - promoters50/2994916
aaaaaattcac

SEQ ID NO: 182031 - DNA, 9 bp, Unknown
  misc_feature (1)..( 9): Result.005 file - promoters50/2994916
agaaggttg

SEQ ID NO: 182032 - DNA, 9 bp, Unknown
  misc_feature (1)..( 9): Result.005 file - promoters50/2994916
agaatgttt

SEQ ID NO: 182033 - DNA, 9 bp, Unknown
  misc_feature (1)..( 9): Result.005 file - promoters50/2994916
ttaatgttg

SEQ ID NO: 182034 - DNA, 9 bp, Unknown
  misc_feature (1)..( 9): Result.005 file - promoters50/2994916
ataattttt

SEQ ID NO: 182035 - DNA, 9 bp, Unknown
  misc_feature (1)..( 9): Result.005 file - promoters50/2994916
atcattttt

SEQ ID NO: 182036 - DNA, 9 bp, Unknown
  misc_feature (1)..( 9): Result.005 file - promoters50/2994916
atcatttta

SEQ ID NO: 182037 - DNA, 10 bp, Unknown
  misc_feature (1)..( 10): Result.005 file - promoters50/2994916
taaatgattt

SEQ ID NO: 182038 - DNA, 12 bp, Unknown
  misc_feature (1)..( 12): Result.005 file - promoters50/2994916
gaatctcttttc

SEQ ID NO: 182039 - DNA, 12 bp, Unknown
  misc_feature (1)..( 12): Result.005 file - promoters50/2994916
gaatgtctcaat

SEQ ID NO: 182040 - DNA, 12 bp, Unknown
  misc_feature (1)..( 12): Result.005 file - promoters50/2994916
taatttcttcac

SEQ ID NO: 182041 - DNA, 12 bp, Unknown
  misc_feature (1)..( 12): Result.005 file - promoters50/2994916
gtctgtctcaat

SEQ ID NO: 182042 - DNA, 12 bp, Unknown
  misc_feature (1)..( 12): Result.005 file - promoters50/2994916
aaatttcaaata

SEQ ID NO: 182043 - DNA, 12 bp, Unknown
  misc_feature (1)..( 12): Result.005 file - promoters50/2994916
aaaattcacggt

SEQ ID NO: 182044 - DNA, 13 bp, Unknown
  misc_feature (1)..( 13): Result.005 file - promoters50/2994916
cttcatataaata

SEQ ID NO: 182045 - DNA, 13 bp, Unknown
  misc_feature (1)..( 13): Result.005 file - promoters50/2994916
gtttatataagtg

SEQ ID NO: 182046 - DNA, 13 bp, Unknown
  misc_feature (1)..( 13): Result.005 file - promoters50/2994916
ttagctataaaag

SEQ ID NO: 182047 - DNA, 13 bp, Unknown
  misc_feature (1)..( 13): Result.005 file - promoters50/2994916
cttcctatattta

SEQ ID NO: 182048 - DNA, 13 bp, Unknown
  misc_feature (1)..( 13): Result.005 file - promoters50/2994916
gtatatataaata

SEQ ID NO: 182049 - DNA, 13 bp, Unknown
  misc_feature (1)..( 13): Result.005 file - promoters50/2994916
ttatttatatgtt

SEQ ID NO: 182050 - DNA, 9 bp, Unknown
  misc_feature (1)..( 9): Result.005 file - promoters50/2995201
aatttatag

SEQ ID NO: 182051 - DNA, 9 bp, Unknown
  misc_feature (1)..( 9): Result.005 file - promoters50/2995201
aatgtataa

SEQ ID NO: 182052 - DNA, 9 bp, Unknown
  misc_feature (1)..( 9): Result.005 file - promoters50/2995201
attttatac

SEQ ID NO: 182053 - DNA, 9 bp, Unknown
  misc_feature (1)..( 9): Result.005 file - promoters50/2995201
tctttataa

SEQ ID NO: 182054 - DNA, 9 bp, Unknown
  misc_feature (1)..( 9): Result.005 file - promoters50/2995201
attgtctaa

SEQ ID NO: 182055 - DNA, 8 bp, Unknown
  misc_feature (1)..( 8): Result.005 file - promoters50/2995201
aaaaatta

SEQ ID NO: 182056 - DNA, 8 bp, Unknown
  misc_feature (1)..( 8): Result.005 file - promoters50/2995201
aaatatta

SEQ ID NO: 182057 - DNA, 8 bp, Unknown
  misc_feature (1)..( 8): Result.005 file - promoters50/2995201
aaaaatca

SEQ ID NO: 182058 - DNA, 9 bp, Unknown
  misc_feature (1)..( 9): Result.005 file - promoters50/2995201
aaagtattt

SEQ ID NO: 182059 - DNA, 11 bp, Unknown
  misc_feature (1)..( 11): Result.005 file - promoters50/2995201
ttaattatgga

SEQ ID NO: 182060 - DNA, 11 bp, Unknown
  misc_feature (1)..( 11): Result.005 file - promoters50/2995201
tatattttggt

SEQ ID NO: 182061 - DNA, 11 bp, Unknown
  misc_feature (1)..( 11): Result.005 file - promoters50/2995201
tataatttgtg

SEQ ID NO: 182062 - DNA, 11 bp, Unknown
  misc_feature (1)..( 11): Result.005 file - promoters50/2995201
ccagctttggt

SEQ ID NO: 182063 - DNA, 8 bp, Unknown
  misc_feature (1)..( 8): Result.005 file - promoters50/2995201
aacataat

SEQ ID NO: 182064 - DNA, 8 bp, Unknown
  misc_feature (1)..( 8): Result.005 file - promoters50/2995201
aacctaaa

SEQ ID NO: 182065 - DNA, 8 bp, Unknown
  misc_feature (1)..( 8): Result.005 file - promoters50/2995201
gacataag

SEQ ID NO: 182066 - DNA, 8 bp, Unknown
  misc_feature (1)..( 8): Result.005 file - promoters50/2995201
agcataag

SEQ ID NO: 182067 - DNA, 7 bp, Unknown
  misc_feature (1)..( 7): Result.005 file - promoters50/2995898
agagaaa

SEQ ID NO: 182068 - DNA, 7 bp, Unknown
  misc_feature (1)..( 7): Result.005 file - promoters50/2995898
agagaaa

SEQ ID NO: 182069 - DNA, 7 bp, Unknown
  misc_feature (1)..( 7): Result.005 file - promoters50/2995898
agagaag

SEQ ID NO: 182070 - DNA, 10 bp, Unknown
  misc_feature (1)..( 10): Result.005 file - promoters50/2995898
tgacgatgaa

SEQ ID NO: 182071 - DNA, 10 bp, Unknown
  misc_feature (1)..( 10): Result.005 file - promoters50/2995898
aaacgaagaa

SEQ ID NO: 182072 - DNA, 10 bp, Unknown
  misc_feature (1)..( 10): Result.005 file - promoters50/2995898
tgaggatgtt

SEQ ID NO: 182073 - DNA, 8 bp, Unknown
  misc_feature (1)..( 8): Result.005 file - promoters50/2995898
gataattt

SEQ ID NO: 182074 - DNA, 8 bp, Unknown
  misc_feature (1)..( 8): Result.005 file - promoters50/2995898
gatagttt

SEQ ID NO: 182075 - DNA, 8 bp, Unknown
  misc_feature (1)..( 8): Result.005 file - promoters50/2995898
attaattt

SEQ ID NO: 182076 - DNA, 7 bp, Unknown
  misc_feature (1)..( 7): Result.005 file - promoters50/2995898
atataat

SEQ ID NO: 182077 - DNA, 7 bp, Unknown
  misc_feature (1)..( 7): Result.005 file - promoters50/2995898
atataat

SEQ ID NO: 182078 - DNA, 8 bp, Unknown
  misc_feature (1)..( 8): Result.005 file - promoters50/2995898
atagtatt

SEQ ID NO: 182079 - DNA, 12 bp, Unknown
  misc_feature (1)..( 12): Result.005 file - promoters50/2995898
tttaagttttta

SEQ ID NO: 182080 - DNA, 12 bp, Unknown
  misc_feature (1)..( 12): Result.005 file - promoters50/2995898
tttaactttttt

SEQ ID NO: 182081 - DNA, 12 bp, Unknown
  misc_feature (1)..( 12): Result.005 file - promoters50/2995898
tcgtcgttttta

SEQ ID NO: 182082 - DNA, 11 bp, Unknown
  misc_feature (1)..( 11): Result.005 file - promoters50/2996021
tcctatcatct

SEQ ID NO: 182083 - DNA, 11 bp, Unknown
  misc_feature (1)..( 11): Result.005 file - promoters50/2996021
tccgatcacaa

SEQ ID NO: 182084 - DNA, 11 bp, Unknown
  misc_feature (1)..( 11): Result.005 file - promoters50/2996021
gtagattacaa

SEQ ID NO: 182085 - DNA, 6 bp, Unknown
  misc_feature (1)..( 6): Result.005 file - promoters50/2996054
caaaaa

SEQ ID NO: 182086 - DNA, 6 bp, Unknown
  misc_feature (1)..( 6): Result.005 file - promoters50/2996054
caaaaa

SEQ ID NO: 182087 - DNA, 6 bp, Unknown
  misc_feature (1)..( 6): Result.005 file - promoters50/2996054
caaaaa

SEQ ID NO: 182088 - DNA, 10 bp, Unknown
  misc_feature (1)..( 10): Result.005 file - promoters50/2996054
taattttact

SEQ ID NO: 182089 - DNA, 10 bp, Unknown
  misc_feature (1)..( 10): Result.005 file - promoters50/2996054
tgttttcact

SEQ ID NO: 182090 - DNA, 10 bp, Unknown
  misc_feature (1)..( 10): Result.005 file - promoters50/2996054
tgtattcacc

SEQ ID NO: 182091 - DNA, 9 bp, Unknown
  misc_feature (1)..( 9): Result.005 file - promoters50/2996054
aactttttt

SEQ ID NO: 182092 - DNA, 9 bp, Unknown
  misc_feature (1)..( 9): Result.005 file - promoters50/2996054
aactcttta

SEQ ID NO: 182093 - DNA, 10 bp, Unknown
  misc_feature (1)..( 10): Result.005 file - promoters50/2996054
tgttttatta

SEQ ID NO: 182094 - DNA, 9 bp, Unknown
  misc_feature (1)..( 9): Result.005 file - promoters50/2996054
ttgtctaag

SEQ ID NO: 182095 - DNA, 9 bp, Unknown
  misc_feature (1)..( 9): Result.005 file - promoters50/2996054
ctgtcaaag

SEQ ID NO: 182096 - DNA, 9 bp, Unknown
  misc_feature (1)..( 9): Result.005 file - promoters50/2996054
ctgtcatta

SEQ ID NO: 182097 - DNA, 13 bp, Unknown
  misc_feature (1)..( 13): Result.005 file - promoters50/2996080
gattaatgatcaa

SEQ ID NO: 182098 - DNA, 13 bp, Unknown
  misc_feature (1)..( 13): Result.005 file - promoters50/2996080
atataaagataag

SEQ ID NO: 182099 - DNA, 13 bp, Unknown
  misc_feature (1)..( 13): Result.005 file - promoters50/2996080
cgattatgatcaa

SEQ ID NO: 182100 - DNA, 13 bp, Unknown
  misc_feature (1)..( 13): Result.005 file - promoters50/2996080
gattaaagattaa

SEQ ID NO: 182101 - DNA, 13 bp, Unknown
  misc_feature (1)..( 13): Result.005 file - promoters50/2996080
aaaaaaaaataac

SEQ ID NO: 182102 - DNA, 13 bp, Unknown
  misc_feature (1)..( 13): Result.005 file - promoters50/2996080
agatacagaacaa

SEQ ID NO: 182103 - DNA, 13 bp, Unknown
  misc_feature (1)..( 13): Result.005 file - promoters50/2996080
ctacaattacttt

SEQ ID NO: 182104 - DNA, 10 bp, Unknown
  misc_feature (1)..( 10): Result.005 file - promoters50/2996092
gagattaata

SEQ ID NO: 182105 - DNA, 10 bp, Unknown
  misc_feature (1)..( 10): Result.005 file - promoters50/2996092
tcgattaaca

SEQ ID NO: 182106 - DNA, 10 bp, Unknown
  misc_feature (1)..( 10): Result.005 file - promoters50/2996092
aagatcaatc

SEQ ID NO: 182107 - DNA, 10 bp, Unknown
  misc_feature (1)..( 10): Result.005 file - promoters50/2996092
aagagtaaac

SEQ ID NO: 182108 - DNA, 10 bp, Unknown
  misc_feature (1)..( 10): Result.005 file - promoters50/2996092
actattgaca

SEQ ID NO: 182109 - DNA, 10 bp, Unknown
  misc_feature (1)..( 10): Result.005 file - promoters50/2996092
aagagtcttg

SEQ ID NO: 182110 - DNA, 8 bp, Unknown
  misc_feature (1)..( 8): Result.005 file - promoters50/2996109
attttttt

SEQ ID NO: 182111 - DNA, 8 bp, Unknown
  misc_feature (1)..( 8): Result.005 file - promoters50/2996109
attatttg

SEQ ID NO: 182112 - DNA, 8 bp, Unknown
  misc_feature (1)..( 8): Result.005 file - promoters50/2996109
attgtttt

SEQ ID NO: 182113 - DNA, 13 bp, Unknown
  misc_feature (1)..( 13): Result.005 file - promoters50/2996109
taattaaacataa

SEQ ID NO: 182114 - DNA, 13 bp, Unknown
  misc_feature (1)..( 13): Result.005 file - promoters50/2996109
taattatgttttg

SEQ ID NO: 182115 - DNA, 13 bp, Unknown
  misc_feature (1)..( 13): Result.005 file - promoters50/2996109
taataaaatataa

SEQ ID NO: 182116 - DNA, 13 bp, Unknown
  misc_feature (1)..( 13): Result.005 file - promoters50/2996109
caattaaaaaagg

SEQ ID NO: 182117 - DNA, 13 bp, Unknown
  misc_feature (1)..( 13): Result.005 file - promoters50/2996109
taattaaacataa

SEQ ID NO: 182118 - DNA, 13 bp, Unknown
  misc_feature (1)..( 13): Result.005 file - promoters50/2996109
gcttccaacttaa

SEQ ID NO: 182119 - DNA, 13 bp, Unknown
  misc_feature (1)..( 13): Result.005 file - promoters50/2996109
taataaaatataa

SEQ ID NO: 182120 - DNA, 7 bp, Unknown
  misc_feature (1)..( 7): Result.005 file - promoters50/2996109
aaacatc

SEQ ID NO: 182121 - DNA, 7 bp, Unknown
  misc_feature (1)..( 7): Result.005 file - promoters50/2996109
taacatc

SEQ ID NO: 182122 - DNA, 7 bp, Unknown
  misc_feature (1)..( 7): Result.005 file - promoters50/2996109
aaacatt

SEQ ID NO: 182123 - DNA, 8 bp, Unknown
  misc_feature (1)..( 8): Result.005 file - promoters50/2996109
aatatacc

SEQ ID NO: 182124 - DNA, 8 bp, Unknown
  misc_feature (1)..( 8): Result.005 file - promoters50/2996109
aatatata

SEQ ID NO: 182125 - DNA, 8 bp, Unknown
  misc_feature (1)..( 8): Result.005 file - promoters50/2996109
catagata

SEQ ID NO: 182126 - DNA, 7 bp, Unknown
  misc_feature (1)..( 7): Result.005 file - promoters50/2996109
tataata

SEQ ID NO: 182127 - DNA, 7 bp, Unknown
  misc_feature (1)..( 7): Result.005 file - promoters50/2996109
tattata

SEQ ID NO: 182128 - DNA, 7 bp, Unknown
  misc_feature (1)..( 7): Result.005 file - promoters50/2996109
tattatg

SEQ ID NO: 182129 - DNA, 13 bp, Unknown
  misc_feature (1)..( 13): Result.005 file - promoters50/2996109
aacaatcaaatgt

SEQ ID NO: 182130 - DNA, 13 bp, Unknown
  misc_feature (1)..( 13): Result.005 file - promoters50/2996109
aacagtcaaaaaa

SEQ ID NO: 182131 - DNA, 13 bp, Unknown
  misc_feature (1)..( 13): Result.005 file - promoters50/2996109
tcaggtcaaatcc

SEQ ID NO: 182132 - DNA, 13 bp, Unknown
  misc_feature (1)..( 13): Result.005 file - promoters50/2996109
aaatctcaaaaaa

SEQ ID NO: 182133 - DNA, 7 bp, Unknown
  misc_feature (1)..( 7): Result.005 file - promoters50/2996109
caaaaag

SEQ ID NO: 182134 - DNA, 7 bp, Unknown
  misc_feature (1)..( 7): Result.005 file - promoters50/2996109
aaaaaag

SEQ ID NO: 182135 - DNA, 7 bp, Unknown
  misc_feature (1)..( 7): Result.005 file - promoters50/2996109
aaaaaag

SEQ ID NO: 182136 - DNA, 8 bp, Unknown
  misc_feature (1)..( 8): Result.005 file - promoters50/2996109
ttttctat

SEQ ID NO: 182137 - DNA, 8 bp, Unknown
  misc_feature (1)..( 8): Result.005 file - promoters50/2996109
ttttgtat

SEQ ID NO: 182138 - DNA, 8 bp, Unknown
  misc_feature (1)..( 8): Result.005 file - promoters50/2996109
atttgtaa

SEQ ID NO: 182139 - DNA, 8 bp, Unknown
  misc_feature (1)..( 8): Result.005 file - promoters50/2996115
tttttact

SEQ ID NO: 182140 - DNA, 8 bp, Unknown
  misc_feature (1)..( 8): Result.005 file - promoters50/2996115
tttataca

SEQ ID NO: 182141 - DNA, 8 bp, Unknown
  misc_feature (1)..( 8): Result.005 file - promoters50/2996115
ttttaact

SEQ ID NO: 182142 - DNA, 12 bp, Unknown
  misc_feature (1)..( 12): Result.005 file - promoters50/2996115
tttacaatatat

SEQ ID NO: 182143 - DNA, 12 bp, Unknown
  misc_feature (1)..( 12): Result.005 file - promoters50/2996115
tttaaaatatat

SEQ ID NO: 182144 - DNA, 12 bp, Unknown
  misc_feature (1)..( 12): Result.005 file - promoters50/2996115
tttaaacatgtc

SEQ ID NO: 182145 - DNA, 9 bp, Unknown
  misc_feature (1)..( 9): Result.005 file - promoters50/2996115
aattgccat

SEQ ID NO: 182146 - DNA, 9 bp, Unknown
  misc_feature (1)..( 9): Result.005 file - promoters50/2996115
aattcccac

SEQ ID NO: 182147 - DNA, 9 bp, Unknown
  misc_feature (1)..( 9): Result.005 file - promoters50/2996115
gattctcac

SEQ ID NO: 182148 - DNA, 10 bp, Unknown
  misc_feature (1)..( 10): Result.005 file - promoters50/2996115
caaagttgtt

SEQ ID NO: 182149 - DNA, 10 bp, Unknown
  misc_feature (1)..( 10): Result.005 file - promoters50/2996115
caaatttggc

SEQ ID NO: 182150 - DNA, 10 bp, Unknown
  misc_feature (1)..( 10): Result.005 file - promoters50/2996115
caaagttgtt

SEQ ID NO: 182151 - DNA, 10 bp, Unknown
  misc_feature (1)..( 10): Result.005 file - promoters50/2996115
gtaatttgaa

SEQ ID NO: 182152 - DNA, 9 bp, Unknown
  misc_feature (1)..( 9): Result.005 file - promoters50/2996119
aaacaacga

SEQ ID NO: 182153 - DNA, 9 bp, Unknown
  misc_feature (1)..( 9): Result.005 file - promoters50/2996119
aaaaaacga

SEQ ID NO: 182154 - DNA, 9 bp, Unknown
  misc_feature (1)..( 9): Result.005 file - promoters50/2996119
aaataacat

SEQ ID NO: 182155 - DNA, 18 bp, Unknown
  misc_feature (1)..( 18): Result.005 file - promoters50/2996222
aaaaattattaaagtata

SEQ ID NO: 182156 - DNA, 18 bp, Unknown
  misc_feature (1)..( 18): Result.005 file - promoters50/2996222
aaagattattaaattata

SEQ ID NO: 182157 - DNA, 18 bp, Unknown
  misc_feature (1)..( 18): Result.005 file - promoters50/2996222
aaaatttatctgtaaatg

SEQ ID NO: 182158 - DNA, 18 bp, Unknown
  misc_feature (1)..( 18): Result.005 file - promoters50/2996222
aaaatatgaatataatga

SEQ ID NO: 182159 - DNA, 18 bp, Unknown
  misc_feature (1)..( 18): Result.005 file - promoters50/2996222
tatgtatattgcggatta

SEQ ID NO: 182160 - DNA, 18 bp, Unknown
  misc_feature (1)..( 18): Result.005 file - promoters50/2996222
gctatttatctgcaactt

SEQ ID NO: 182161 - DNA, 18 bp, Unknown
  misc_feature (1)..( 18): Result.005 file - promoters50/2996222
aaaacatgagtactcgat

SEQ ID NO: 182162 - DNA, 18 bp, Unknown
  misc_feature (1)..( 18): Result.005 file - promoters50/2996222
ttaatatgagaaactaaa

SEQ ID NO: 182163 - DNA, 10 bp, Unknown
  misc_feature (1)..( 10): Result.005 file - promoters50/2996222
tttactaata

SEQ ID NO: 182164 - DNA, 10 bp, Unknown
  misc_feature (1)..( 10): Result.005 file - promoters50/2996222
attattaaag

SEQ ID NO: 182165 - DNA, 10 bp, Unknown
  misc_feature (1)..( 10): Result.005 file - promoters50/2996222
tttgctatac

SEQ ID NO: 182166 - DNA, 10 bp, Unknown
  misc_feature (1)..( 10): Result.005 file - promoters50/2996222
tataataatt

SEQ ID NO: 182167 - DNA, 10 bp, Unknown
  misc_feature (1)..( 10): Result.005 file - promoters50/2996222
actaaaaata

SEQ ID NO: 182168 - DNA, 10 bp, Unknown
  misc_feature (1)..( 10): Result.005 file - promoters50/2996222
cgaaccaaaa

SEQ ID NO: 182169 - DNA, 11 bp, Unknown
  misc_feature (1)..( 11): Result.005 file - promoters50/2996222
ataattttaga

SEQ ID NO: 182170 - DNA, 11 bp, Unknown
  misc_feature (1)..( 11): Result.005 file - promoters50/2996222
ctaattttaat

SEQ ID NO: 182171 - DNA, 11 bp, Unknown
  misc_feature (1)..( 11): Result.005 file - promoters50/2996222
ataattatttg

SEQ ID NO: 182172 - DNA, 11 bp, Unknown
  misc_feature (1)..( 11): Result.005 file - promoters50/2996222
atactttatcg

SEQ ID NO: 182173 - DNA, 11 bp, Unknown
  misc_feature (1)..( 11): Result.005 file - promoters50/2996222
atatttatttg

SEQ ID NO: 182174 - DNA, 11 bp, Unknown
  misc_feature (1)..( 11): Result.005 file - promoters50/2996222
atatttgccaa

SEQ ID NO: 182175 - DNA, 13 bp, Unknown
  misc_feature (1)..( 13): Result.005 file - promoters50/2996222
atcattttacttt

SEQ ID NO: 182176 - DNA, 13 bp, Unknown
  misc_feature (1)..( 13): Result.005 file - promoters50/2996222
aatattttagtcg

SEQ ID NO: 182177 - DNA, 13 bp, Unknown
  misc_feature (1)..( 13): Result.005 file - promoters50/2996222
ttatttttactca

SEQ ID NO: 182178 - DNA, 13 bp, Unknown
  misc_feature (1)..( 13): Result.005 file - promoters50/2996222
acgtttttaccct

SEQ ID NO: 182179 - DNA, 13 bp, Unknown
  misc_feature (1)..( 13): Result.005 file - promoters50/2996222
aatactttatcgt

SEQ ID NO: 182180 - DNA, 13 bp, Unknown
  misc_feature (1)..( 13): Result.005 file - promoters50/2996222
ctaattttagcaa

SEQ ID NO: 182181 - DNA, 13 bp, Unknown
  misc_feature (1)..( 13): Result.005 file - promoters50/2996222
ccatctttaacaa

SEQ ID NO: 182182 - DNA, 12 bp, Unknown
  misc_feature (1)..( 12): Result.005 file - promoters50/2996222
actatatatatc

SEQ ID NO: 182183 - DNA, 12 bp, Unknown
  misc_feature (1)..( 12): Result.005 file - promoters50/2996222
tttatttatatg

SEQ ID NO: 182184 - DNA, 12 bp, Unknown
  misc_feature (1)..( 12): Result.005 file - promoters50/2996222
actctatataaa

SEQ ID NO: 182185 - DNA, 12 bp, Unknown
  misc_feature (1)..( 12): Result.005 file - promoters50/2996222
cgtatatataaa

SEQ ID NO: 182186 - DNA, 12 bp, Unknown
  misc_feature (1)..( 12): Result.005 file - promoters50/2996222
actataaataga

SEQ ID NO: 182187 - DNA, 12 bp, Unknown
  misc_feature (1)..( 12): Result.005 file - promoters50/2996222
tgtctatatgac

SEQ ID NO: 182188 - DNA, 12 bp, Unknown
  misc_feature (1)..( 12): Result.005 file - promoters50/2996222
aatctataaaaa

SEQ ID NO: 182189 - DNA, 12 bp, Unknown
  misc_feature (1)..( 12): Result.005 file - promoters50/2996222
ttcgtatatgaa

SEQ ID NO: 182190 - DNA, 9 bp, Unknown
  misc_feature (1)..( 9): Result.005 file - promoters50/2996222
taatagaag

SEQ ID NO: 182191 - DNA, 9 bp, Unknown
  misc_feature (1)..( 9): Result.005 file - promoters50/2996222
taattgaac

SEQ ID NO: 182192 - DNA, 9 bp, Unknown
  misc_feature (1)..( 9): Result.005 file - promoters50/2996222
aaattatta

SEQ ID NO: 182193 - DNA, 9 bp, Unknown
  misc_feature (1)..( 9): Result.005 file - promoters50/2996222
taaaaatat

SEQ ID NO: 182194 - DNA, 9 bp, Unknown
  misc_feature (1)..( 9): Result.005 file - promoters50/2996222
tgaatataa

SEQ ID NO: 182195 - DNA, 9 bp, Unknown
  misc_feature (1)..( 9): Result.005 file - promoters50/2996222
tatgtatat

SEQ ID NO: 182196 - DNA, 9 bp, Unknown
  misc_feature (1)..( 9): Result.005 file - promoters50/2996222
tatttatct

SEQ ID NO: 182197 - DNA, 10 bp, Unknown
  misc_feature (1)..( 10): Result.005 file - promoters50/2996222
aattttgtta

SEQ ID NO: 182198 - DNA, 10 bp, Unknown
  misc_feature (1)..( 10): Result.005 file - promoters50/2996222
ctttttgttt

SEQ ID NO: 182199 - DNA, 10 bp, Unknown
  misc_feature (1)..( 10): Result.005 file - promoters50/2996222
agatttgtta

SEQ ID NO: 182200 - DNA, 10 bp, Unknown
  misc_feature (1)..( 10): Result.005 file - promoters50/2996222
atatttgtaa

SEQ ID NO: 182201 - DNA, 10 bp, Unknown
  misc_feature (1)..( 10): Result.005 file - promoters50/2996222
ttatttgtaa

SEQ ID NO: 182202 - DNA, 10 bp, Unknown
  misc_feature (1)..( 10): Result.005 file - promoters50/2996222
gtatatgtta

SEQ ID NO: 182203 - DNA, 10 bp, Unknown
  misc_feature (1)..( 10): Result.005 file - promoters50/2996222
ttatttgaag

SEQ ID NO: 182204 - DNA, 8 bp, Unknown
  misc_feature (1)..( 8): Result.005 file - promoters50/2996281
atcaaaaa

SEQ ID NO: 182205 - DNA, 8 bp, Unknown
  misc_feature (1)..( 8): Result.005 file - promoters50/2996281
atccaaat

SEQ ID NO: 182206 - DNA, 8 bp, Unknown
  misc_feature (1)..( 8): Result.005 file - promoters50/2996281
atcgaaaa

SEQ ID NO: 182207 - DNA, 8 bp, Unknown
  misc_feature (1)..( 8): Result.005 file - promoters50/2996281
taagtttt

SEQ ID NO: 182208 - DNA, 8 bp, Unknown
  misc_feature (1)..( 8): Result.005 file - promoters50/2996281
ttagtttt

SEQ ID NO: 182209 - DNA, 8 bp, Unknown
  misc_feature (1)..( 8): Result.005 file - promoters50/2996281
taagtttt

SEQ ID NO: 182210 - DNA, 19 bp, Unknown
  misc_feature (1)..( 19): Result.005 file - promoters50/2996290
cacaaggacaagtttctcc

SEQ ID NO: 182211 - DNA, 19 bp, Unknown
  misc_feature (1)..( 19): Result.005 file - promoters50/2996290
cactaggccaactttcata

SEQ ID NO: 182212 - DNA, 19 bp, Unknown
  misc_feature (1)..( 19): Result.005 file - promoters50/2996290
cagaaatgtaactttcaca

SEQ ID NO: 182213 - DNA, 19 bp, Unknown
  misc_feature (1)..( 19): Result.005 file - promoters50/2996290
ccatcatcaatctttcaaa

SEQ ID NO: 182214 - DNA, 19 bp, Unknown
  misc_feature (1)..( 19): Result.005 file - promoters50/2996290
gctcgctgtttctttcttc

SEQ ID NO: 182215 - DNA, 19 bp, Unknown
  misc_feature (1)..( 19): Result.005 file - promoters50/2996290
aattataaagtatttaaaa

SEQ ID NO: 182216 - DNA, 14 bp, Unknown
  misc_feature (1)..( 14): Result.005 file - promoters50/2997951
acttttcttgaatc

SEQ ID NO: 182217 - DNA, 14 bp, Unknown
  misc_feature (1)..( 14): Result.005 file - promoters50/2997951
acttatcttcatga

SEQ ID NO: 182218 - DNA, 14 bp, Unknown
  misc_feature (1)..( 14): Result.005 file - promoters50/2997951
cgctttcttcaatc

SEQ ID NO: 182219 - DNA, 14 bp, Unknown
  misc_feature (1)..( 14): Result.005 file - promoters50/2997951
caggttcgtgaacc

SEQ ID NO: 182220 - DNA, 14 bp, Unknown
  misc_feature (1)..( 14): Result.005 file - promoters50/2997951
ccgtatctgcaacc

SEQ ID NO: 182221 - DNA, 15 bp, Unknown
  misc_feature (1)..( 15): Result.005 file - promoters50/2997951
tcaattctatcaata

SEQ ID NO: 182222 - DNA, 12 bp, Unknown
  misc_feature (1)..( 12): Result.005 file - promoters50/2997951
aaaaaacattcc

SEQ ID NO: 182223 - DNA, 12 bp, Unknown
  misc_feature (1)..( 12): Result.005 file - promoters50/2997951
ttaaaatatttc

SEQ ID NO: 182224 - DNA, 12 bp, Unknown
  misc_feature (1)..( 12): Result.005 file - promoters50/2997951
tcaagatatttc

SEQ ID NO: 182225 - DNA, 12 bp, Unknown
  misc_feature (1)..( 12): Result.005 file - promoters50/2997951
ttaaaatagtag

SEQ ID NO: 182226 - DNA, 12 bp, Unknown
  misc_feature (1)..( 12): Result.005 file - promoters50/2997951
agttaatattaa

SEQ ID NO: 182227 - DNA, 12 bp, Unknown
  misc_feature (1)..( 12): Result.005 file - promoters50/2997951
ataaagtatact

SEQ ID NO: 182228 - DNA, 8 bp, Unknown
  misc_feature (1)..( 8): Result.005 file - promoters50/2997951
taattacc

SEQ ID NO: 182229 - DNA, 8 bp, Unknown
  misc_feature (1)..( 8): Result.005 file - promoters50/2997951
aaatcacc

SEQ ID NO: 182230 - DNA, 8 bp, Unknown
  misc_feature (1)..( 8): Result.005 file - promoters50/2997951
taattatt

SEQ ID NO: 182231 - DNA, 8 bp, Unknown
  misc_feature (1)..( 8): Result.005 file - promoters50/2997951
gaatcact

SEQ ID NO: 182232 - DNA, 8 bp, Unknown
  misc_feature (1)..( 8): Result.005 file - promoters50/2997951
taattaaa

SEQ ID NO: 182233 - DNA, 8 bp, Unknown
  misc_feature (1)..( 8): Result.005 file - promoters50/2997951
taatcaaa

SEQ ID NO: 182234 - DNA, 11 bp, Unknown
  misc_feature (1)..( 11): Result.005 file - promoters50/2997951
tttagtactat

SEQ ID NO: 182235 - DNA, 11 bp, Unknown
  misc_feature (1)..( 11): Result.005 file - promoters50/2997951
ttgagtgctaa

SEQ ID NO: 182236 - DNA, 11 bp, Unknown
  misc_feature (1)..( 11): Result.005 file - promoters50/2997951
gccaatactat

SEQ ID NO: 182237 - DNA, 11 bp, Unknown
  misc_feature (1)..( 11): Result.005 file - promoters50/2997951
aacaattctaa

SEQ ID NO: 182238 - DNA, 11 bp, Unknown
  misc_feature (1)..( 11): Result.005 file - promoters50/2997951
aacaagtctct

SEQ ID NO: 182239 - DNA, 11 bp, Unknown
  misc_feature (1)..( 11): Result.005 file - promoters50/2997951
tataatagtat

SEQ ID NO: 182240 - DNA, 8 bp, Unknown
  misc_feature (1)..( 8): Result.005 file - promoters50/3003006
taaagttc

SEQ ID NO: 182241 - DNA, 8 bp, Unknown
  misc_feature (1)..( 8): Result.005 file - promoters50/3003006
gaaacttc

SEQ ID NO: 182242 - DNA, 8 bp, Unknown
  misc_feature (1)..( 8): Result.005 file - promoters50/3003006
gaaccttt

SEQ ID NO: 182243 - DNA, 10 bp, Unknown
  misc_feature (1)..( 10): Result.005 file - promoters50/3003006
gaagttatcg

SEQ ID NO: 182244 - DNA, 10 bp, Unknown
  misc_feature (1)..( 10): Result.005 file - promoters50/3003006
gaaattagat

SEQ ID NO: 182245 - DNA, 10 bp, Unknown
  misc_feature (1)..( 10): Result.005 file - promoters50/3003006
ggaattggat

SEQ ID NO: 182246 - DNA, 10 bp, Unknown
  misc_feature (1)..( 10): Result.005 file - promoters50/3003006
tcgattgaaa

SEQ ID NO: 182247 - DNA, 10 bp, Unknown
  misc_feature (1)..( 10): Result.005 file - promoters50/3003006
tagatcgaaa

SEQ ID NO: 182248 - DNA, 10 bp, Unknown
  misc_feature (1)..( 10): Result.005 file - promoters50/3003006
taggtcgata

SEQ ID NO: 182249 - DNA, 9 bp, Unknown
  misc_feature (1)..( 9): Result.005 file - promoters50/3003010
atcaatttt

SEQ ID NO: 182250 - DNA, 9 bp, Unknown
  misc_feature (1)..( 9): Result.005 file - promoters50/3003010
actaatttt

SEQ ID NO: 182251 - DNA, 9 bp, Unknown
  misc_feature (1)..( 9): Result.005 file - promoters50/3003010
atctatttt

SEQ ID NO: 182252 - DNA, 7 bp, Unknown
  misc_feature (1)..( 7): Result.005 file - promoters50/3003010
taaaaat

SEQ ID NO: 182253 - DNA, 7 bp, Unknown
  misc_feature (1)..( 7): Result.005 file - promoters50/3003010
taataat

SEQ ID NO: 182254 - DNA, 7 bp, Unknown
  misc_feature (1)..( 7): Result.005 file - promoters50/3003010
aaataat

SEQ ID NO: 182255 - DNA, 7 bp, Unknown
  misc_feature (1)..( 7): Result.005 file - promoters50/3003010
caaaatt

SEQ ID NO: 182256 - DNA, 7 bp, Unknown
  misc_feature (1)..( 7): Result.005 file - promoters50/3003010
caatatt

SEQ ID NO: 182257 - DNA, 7 bp, Unknown
  misc_feature (1)..( 7): Result.005 file - promoters50/3003010
caatatg

SEQ ID NO: 182258 - DNA, 8 bp, Unknown
  misc_feature (1)..( 8): Result.005 file - promoters50/3003010
gaataaaa

SEQ ID NO: 182259 - DNA, 8 bp, Unknown
  misc_feature (1)..( 8): Result.005 file - promoters50/3003010
acataaaa

SEQ ID NO: 182260 - DNA, 8 bp, Unknown
  misc_feature (1)..( 8): Result.005 file - promoters50/3003010
acacaaag

SEQ ID NO: 182261 - DNA, 6 bp, Unknown
  misc_feature (1)..( 6): Result.005 file - promoters50/3011901
agaaaa

SEQ ID NO: 182262 - DNA, 6 bp, Unknown
  misc_feature (1)..( 6): Result.005 file - promoters50/3011901
agaaaa

SEQ ID NO: 182263 - DNA, 6 bp, Unknown
  misc_feature (1)..( 6): Result.005 file - promoters50/3011901
agaaaa

SEQ ID NO: 182264 - DNA, 8 bp, Unknown
  misc_feature (1)..( 8): Result.005 file - promoters50/3011901
gagtgaac

SEQ ID NO: 182265 - DNA, 8 bp, Unknown
  misc_feature (1)..( 8): Result.005 file - promoters50/3011901
gagtgaaa

SEQ ID NO: 182266 - DNA, 8 bp, Unknown
  misc_feature (1)..( 8): Result.005 file - promoters50/3011901
gagtaaaa

SEQ ID NO: 182267 - DNA, 10 bp, Unknown
  misc_feature (1)..( 10): Result.005 file - promoters50/3011901
taacataaat

SEQ ID NO: 182268 - DNA, 10 bp, Unknown
  misc_feature (1)..( 10): Result.005 file - promoters50/3011901
taacataaaa

SEQ ID NO: 182269 - DNA, 10 bp, Unknown
  misc_feature (1)..( 10): Result.005 file - promoters50/3011901
gtaaataaaa

SEQ ID NO: 182270 - DNA, 8 bp, Unknown
  misc_feature (1)..( 8): Result.005 file - promoters50/3011901
agtgcatg

SEQ ID NO: 182271 - DNA, 8 bp, Unknown
  misc_feature (1)..( 8): Result.005 file - promoters50/3011901
agtgcaac

SEQ ID NO: 182272 - DNA, 8 bp, Unknown
  misc_feature (1)..( 8): Result.005 file - promoters50/3011901
cgtgaaac

SEQ ID NO: 182273 - DNA, 10 bp, Unknown
  misc_feature (1)..( 10): Result.005 file - promoters50/3011901
tttaaaaaat

SEQ ID NO: 182274 - DNA, 10 bp, Unknown
  misc_feature (1)..( 10): Result.005 file - promoters50/3011901
cttaaaaggg

SEQ ID NO: 182275 - DNA, 10 bp, Unknown
  misc_feature (1)..( 10): Result.005 file - promoters50/3011901
tttaaaaaat

SEQ ID NO: 182276 - DNA, 12 bp, Unknown
  misc_feature (1)..( 12): Result.005 file - promoters50/3011901
tgggatatttta

SEQ ID NO: 182277 - DNA, 12 bp, Unknown
  misc_feature (1)..( 12): Result.005 file - promoters50/3011901
gatgatatatta

SEQ ID NO: 182278 - DNA, 12 bp, Unknown
  misc_feature (1)..( 12): Result.005 file - promoters50/3011901
tgagataataat

SEQ ID NO: 182279 - DNA, 8 bp, Unknown
  misc_feature (1)..( 8): Result.005 file - promoters50/3020615
ctttatgc

SEQ ID NO: 182280 - DNA, 8 bp, Unknown
  misc_feature (1)..( 8): Result.005 file - promoters50/3020615
ctttttgc

SEQ ID NO: 182281 - DNA, 8 bp, Unknown
  misc_feature (1)..( 8): Result.005 file - promoters50/3020615
ctttttat

SEQ ID NO: 182282 - DNA, 9 bp, Unknown
  misc_feature (1)..( 9): Result.005 file - promoters50/3036674
aaaaagaaa

SEQ ID NO: 182283 - DNA, 9 bp, Unknown
  misc_feature (1)..( 9): Result.005 file - promoters50/3036674
caaaacaaa

SEQ ID NO: 182284 - DNA, 9 bp, Unknown
  misc_feature (1)..( 9): Result.005 file - promoters50/3036674
caaaaccac

SEQ ID NO: 182285 - DNA, 12 bp, Unknown
  misc_feature (1)..( 12): Result.005 file - promoters50/3043322
ttctaaaatctt

SEQ ID NO: 182286 - DNA, 12 bp, Unknown
  misc_feature (1)..( 12): Result.005 file - promoters50/3043322
caataaaatcct

SEQ ID NO: 182287 - DNA, 12 bp, Unknown
  misc_feature (1)..( 12): Result.005 file - promoters50/3043322
acaaaaaatcat

SEQ ID NO: 182288 - DNA, 12 bp, Unknown
  misc_feature (1)..( 12): Result.005 file - promoters50/3043322
aaataaaattaa

SEQ ID NO: 182289 - DNA, 12 bp, Unknown
  misc_feature (1)..( 12): Result.005 file - promoters50/3043322
caaaaaaaaaaa

SEQ ID NO: 182290 - DNA, 12 bp, Unknown
  misc_feature (1)..( 12): Result.005 file - promoters50/3043322
ttagaaaatcat

SEQ ID NO: 182291 - DNA, 16 bp, Unknown
  misc_feature (1)..( 16): Result.005 file - promoters50/3043322
aaaacctgaattttaa

SEQ ID NO: 182292 - DNA, 16 bp, Unknown
  misc_feature (1)..( 16): Result.005 file - promoters50/3043322
ggctatccaatttttt

SEQ ID NO: 182293 - DNA, 16 bp, Unknown
  misc_feature (1)..( 16): Result.005 file - promoters50/3043322
aattctaaaatttcta

SEQ ID NO: 182294 - DNA, 16 bp, Unknown
  misc_feature (1)..( 16): Result.005 file - promoters50/3043322
ttgttacaaattttct

SEQ ID NO: 182295 - DNA, 16 bp, Unknown
  misc_feature (1)..( 16): Result.005 file - promoters50/3043322
acctaacatatttttt

SEQ ID NO: 182296 - DNA, 16 bp, Unknown
  misc_feature (1)..( 16): Result.005 file - promoters50/3043322
gatgactccatttttg

SEQ ID NO: 182297 - DNA, 16 bp, Unknown
  misc_feature (1)..( 16): Result.005 file - promoters50/3043322
agttgttcaattctcc

SEQ ID NO: 182298 - DNA, 13 bp, Unknown
  misc_feature (1)..( 13): Result.005 file - promoters50/3043322
gaaaaaaaaatat

SEQ ID NO: 182299 - DNA, 13 bp, Unknown
  misc_feature (1)..( 13): Result.005 file - promoters50/3043322
caaaacaaatcat

SEQ ID NO: 182300 - DNA, 13 bp, Unknown
  misc_feature (1)..( 13): Result.005 file - promoters50/3043322
gaataaatgacat

SEQ ID NO: 182301 - DNA, 13 bp, Unknown
  misc_feature (1)..( 13): Result.005 file - promoters50/3043322
tgttacaaatttt

SEQ ID NO: 182302 - DNA, 13 bp, Unknown
  misc_feature (1)..( 13): Result.005 file - promoters50/3043322
gaaatcaagatca

SEQ ID NO: 182303 - DNA, 13 bp, Unknown
  misc_feature (1)..( 13): Result.005 file - promoters50/3043322
agaagcaattttt

SEQ ID NO: 182304 - DNA, 11 bp, Unknown
  misc_feature (1)..( 11): Result.005 file - promoters50/3043962
cttctatataa

SEQ ID NO: 182305 - DNA, 11 bp, Unknown
  misc_feature (1)..( 11): Result.005 file - promoters50/3043962
aaactatttaa

SEQ ID NO: 182306 - DNA, 11 bp, Unknown
  misc_feature (1)..( 11): Result.005 file - promoters50/3043962
tgactattatc

SEQ ID NO: 182307 - DNA, 11 bp, Unknown
  misc_feature (1)..( 11): Result.005 file - promoters50/3043962
aacctagttac

SEQ ID NO: 182308 - DNA, 11 bp, Unknown
  misc_feature (1)..( 11): Result.005 file - promoters50/3043962
tgattatcctt

SEQ ID NO: 182309 - DNA, 11 bp, Unknown
  misc_feature (1)..( 11): Result.005 file - promoters50/3043962
ctactcttagg

SEQ ID NO: 182310 - DNA, 15 bp, Unknown
  misc_feature (1)..( 15): Result.005 file - promoters50/3043962
attcaataataatat

SEQ ID NO: 182311 - DNA, 15 bp, Unknown
  misc_feature (1)..( 15): Result.005 file - promoters50/3043962
ttttcataatcatat

SEQ ID NO: 182312 - DNA, 15 bp, Unknown
  misc_feature (1)..( 15): Result.005 file - promoters50/3043962
aaaactcaataatac

SEQ ID NO: 182313 - DNA, 15 bp, Unknown
  misc_feature (1)..( 15): Result.005 file - promoters50/3043962
ccaaacaaataataa

SEQ ID NO: 182314 - DNA, 15 bp, Unknown
  misc_feature (1)..( 15): Result.005 file - promoters50/3043962
ttttcttaatttaag

SEQ ID NO: 182315 - DNA, 15 bp, Unknown
  misc_feature (1)..( 15): Result.005 file - promoters50/3043962
agactaaaaaaatat

SEQ ID NO: 182316 - DNA, 10 bp, Unknown
  misc_feature (1)..( 10): Result.005 file - promoters50/3043962
tgacaatttt

SEQ ID NO: 182317 - DNA, 10 bp, Unknown
  misc_feature (1)..( 10): Result.005 file - promoters50/3043962
tgactattat

SEQ ID NO: 182318 - DNA, 10 bp, Unknown
  misc_feature (1)..( 10): Result.005 file - promoters50/3043962
aaactattta

SEQ ID NO: 182319 - DNA, 11 bp, Unknown
  misc_feature (1)..( 11): Result.005 file - promoters50/3043962
aacctagttac

SEQ ID NO: 182320 - DNA, 11 bp, Unknown
  misc_feature (1)..( 11): Result.005 file - promoters50/3043962
aaataaaatat

SEQ ID NO: 182321 - DNA, 11 bp, Unknown
  misc_feature (1)..( 11): Result.005 file - promoters50/3043962
gtgttgattat

SEQ ID NO: 182322 - DNA, 11 bp, Unknown
  misc_feature (1)..( 11): Result.005 file - promoters50/3043962
ctactcttagg

SEQ ID NO: 182323 - DNA, 10 bp, Unknown
  misc_feature (1)..( 10): Result.005 file - promoters50/3046192
atgaatctga

SEQ ID NO: 182324 - DNA, 10 bp, Unknown
  misc_feature (1)..( 10): Result.005 file - promoters50/3046192
agaaatctgt

SEQ ID NO: 182325 - DNA, 10 bp, Unknown
  misc_feature (1)..( 10): Result.005 file - promoters50/3046192
agaaatatgt

SEQ ID NO: 182326 - DNA, 10 bp, Unknown
  misc_feature (1)..( 10): Result.005 file - promoters50/3046192
ataaatcttg

SEQ ID NO: 182327 - DNA, 10 bp, Unknown
  misc_feature (1)..( 10): Result.005 file - promoters50/3046192
tataatttgt

SEQ ID NO: 182328 - DNA, 10 bp, Unknown
  misc_feature (1)..( 10): Result.005 file - promoters50/3046192
tgaaatatgt

SEQ ID NO: 182329 - DNA, 10 bp, Unknown
  misc_feature (1)..( 10): Result.005 file - promoters50/3046192
agaaatatgt

SEQ ID NO: 182330 - DNA, 10 bp, Unknown
  misc_feature (1)..( 10): Result.005 file - promoters50/3046192
tataatttgt

SEQ ID NO: 182331 - DNA, 10 bp, Unknown
  misc_feature (1)..( 10): Result.005 file - promoters50/3046192
tgaaatatgt

SEQ ID NO: 182332 - DNA, 10 bp, Unknown
  misc_feature (1)..( 10): Result.005 file - promoters50/3046192
agaaatctgt

SEQ ID NO: 182333 - DNA, 10 bp, Unknown
  misc_feature (1)..( 10): Result.005 file - promoters50/3046192
ataaatcttg

SEQ ID NO: 182334 - DNA, 10 bp, Unknown
  misc_feature (1)..( 10): Result.005 file - promoters50/3046192
agaaatggaa

SEQ ID NO: 182335 - DNA, 11 bp, Unknown
  misc_feature (1)..( 11): Result.005 file - promoters50/3062012
atatatatata

SEQ ID NO: 182336 - DNA, 11 bp, Unknown
  misc_feature (1)..( 11): Result.005 file - promoters50/3062012
atatttataat

SEQ ID NO: 182337 - DNA, 11 bp, Unknown
  misc_feature (1)..( 11): Result.005 file - promoters50/3062012
agattgataag

SEQ ID NO: 182338 - DNA, 11 bp, Unknown
  misc_feature (1)..( 11): Result.005 file - promoters50/3062012
ttaattaaaat

SEQ ID NO: 182339 - DNA, 14 bp, Unknown
  misc_feature (1)..( 14): Result.005 file - promoters50/3062012
taacaaatatatta

SEQ ID NO: 182340 - DNA, 14 bp, Unknown
  misc_feature (1)..( 14): Result.005 file - promoters50/3062012
tttcaaaaatatta

SEQ ID NO: 182341 - DNA, 14 bp, Unknown
  misc_feature (1)..( 14): Result.005 file - promoters50/3062012
actaaaatttatga

SEQ ID NO: 182342 - DNA, 14 bp, Unknown
  misc_feature (1)..( 14): Result.005 file - promoters50/3062012
tttaaaaaacattt

SEQ ID NO: 182343 - DNA, 14 bp, Unknown
  misc_feature (1)..( 14): Result.005 file - promoters50/3062012
ttttaaatgttgca

SEQ ID NO: 182344 - DNA, 12 bp, Unknown
  misc_feature (1)..( 12): Result.005 file - promoters50/3062012
tcaaatgaattt

SEQ ID NO: 182345 - DNA, 12 bp, Unknown
  misc_feature (1)..( 12): Result.005 file - promoters50/3062012
ataaattaatac

SEQ ID NO: 182346 - DNA, 12 bp, Unknown
  misc_feature (1)..( 12): Result.005 file - promoters50/3062012
tttaataaattt

SEQ ID NO: 182347 - DNA, 12 bp, Unknown
  misc_feature (1)..( 12): Result.005 file - promoters50/3062012
taaaaataatat

SEQ ID NO: 182348 - DNA, 12 bp, Unknown
  misc_feature (1)..( 12): Result.005 file - promoters50/3062012
ttaaaaaagcat

SEQ ID NO: 182349 - DNA, 12 bp, Unknown
  misc_feature (1)..( 12): Result.005 file - promoters50/3062012
caaatgaattta

SEQ ID NO: 182350 - DNA, 12 bp, Unknown
  misc_feature (1)..( 12): Result.005 file - promoters50/3062012
ttgaaaaattta

SEQ ID NO: 182351 - DNA, 12 bp, Unknown
  misc_feature (1)..( 12): Result.005 file - promoters50/3062012
ttaataaatttt

SEQ ID NO: 182352 - DNA, 12 bp, Unknown
  misc_feature (1)..( 12): Result.005 file - promoters50/3062012
atgaaagattta

SEQ ID NO: 182353 - DNA, 12 bp, Unknown
  misc_feature (1)..( 12): Result.005 file - promoters50/3062012
ttaaaaaagcat

SEQ ID NO: 182354 - DNA, 8 bp, Unknown
  misc_feature (1)..( 8): Result.005 file - promoters50/3062012
aaaaaatc

SEQ ID NO: 182355 - DNA, 8 bp, Unknown
  misc_feature (1)..( 8): Result.005 file - promoters50/3062012
ttaaaatc

SEQ ID NO: 182356 - DNA, 8 bp, Unknown
  misc_feature (1)..( 8): Result.005 file - promoters50/3062012
ttataata

SEQ ID NO: 182357 - DNA, 8 bp, Unknown
  misc_feature (1)..( 8): Result.005 file - promoters50/3062012
ttaaaatt

SEQ ID NO: 182358 - DNA, 8 bp, Unknown
  misc_feature (1)..( 8): Result.005 file - promoters50/3062012
tgaaaatc

SEQ ID NO: 182359 - DNA, 11 bp, Unknown
  misc_feature (1)..( 11): Result.005 file - promoters50/3062012
tgaattaaaac

SEQ ID NO: 182360 - DNA, 11 bp, Unknown
  misc_feature (1)..( 11): Result.005 file - promoters50/3062012
ggaagtaaaga

SEQ ID NO: 182361 - DNA, 11 bp, Unknown
  misc_feature (1)..( 11): Result.005 file - promoters50/3062012
tgaaataaaac

SEQ ID NO: 182362 - DNA, 11 bp, Unknown
  misc_feature (1)..( 11): Result.005 file - promoters50/3062012
ttcatgaaaaa

SEQ ID NO: 182363 - DNA, 9 bp, Unknown
  misc_feature (1)..( 9): Result.005 file - promoters50/3062012
ctgaaaaaa

SEQ ID NO: 182364 - DNA, 9 bp, Unknown
  misc_feature (1)..( 9): Result.005 file - promoters50/3062012
attaaaaaa

SEQ ID NO: 182365 - DNA, 9 bp, Unknown
  misc_feature (1)..( 9): Result.005 file - promoters50/3062012
tttaataaa

SEQ ID NO: 182366 - DNA, 9 bp, Unknown
  misc_feature (1)..( 9): Result.005 file - promoters50/3062012
attcaaaat

SEQ ID NO: 182367 - DNA, 12 bp, Unknown
  misc_feature (1)..( 12): Result.005 file - promoters50/3062012
tcccatatttta

SEQ ID NO: 182368 - DNA, 12 bp, Unknown
  misc_feature (1)..( 12): Result.005 file - promoters50/3062012
tcccaaatttat

SEQ ID NO: 182369 - DNA, 12 bp, Unknown
  misc_feature (1)..( 12): Result.005 file - promoters50/3062012
taacatcttttt

SEQ ID NO: 182370 - DNA, 12 bp, Unknown
  misc_feature (1)..( 12): Result.005 file - promoters50/3062012
tttgaacttttt

SEQ ID NO: 182371 - DNA, 10 bp, Unknown
  misc_feature (1)..( 10): Result.005 file - promoters50/3062012
tttattgtaa

SEQ ID NO: 182372 - DNA, 10 bp, Unknown
  misc_feature (1)..( 10): Result.005 file - promoters50/3062012
tttatttaaa

SEQ ID NO: 182373 - DNA, 10 bp, Unknown
  misc_feature (1)..( 10): Result.005 file - promoters50/3062012
ttttttttac

SEQ ID NO: 182374 - DNA, 10 bp, Unknown
  misc_feature (1)..( 10): Result.005 file - promoters50/3062012
tttttaacat

SEQ ID NO: 182375 - DNA, 11 bp, Unknown
  misc_feature (1)..( 11): Result.005 file - promoters50/3062012
attgtaaaatc

SEQ ID NO: 182376 - DNA, 11 bp, Unknown
  misc_feature (1)..( 11): Result.005 file - promoters50/3062012
tatttaaaata

SEQ ID NO: 182377 - DNA, 11 bp, Unknown
  misc_feature (1)..( 11): Result.005 file - promoters50/3062012
tttttaacatc

SEQ ID NO: 182378 - DNA, 11 bp, Unknown
  misc_feature (1)..( 11): Result.005 file - promoters50/3062012
ttttttacata

SEQ ID NO: 182379 - DNA, 8 bp, Unknown
  misc_feature (1)..( 8): Result.005 file - promoters50/3062012
aatcaaac

SEQ ID NO: 182380 - DNA, 8 bp, Unknown
  misc_feature (1)..( 8): Result.005 file - promoters50/3062012
catcaaat

SEQ ID NO: 182381 - DNA, 8 bp, Unknown
  misc_feature (1)..( 8): Result.005 file - promoters50/3062012
aattaaaa

SEQ ID NO: 182382 - DNA, 9 bp, Unknown
  misc_feature (1)..( 9): Result.005 file - promoters50/3062012
atttataat

SEQ ID NO: 182383 - DNA, 9 bp, Unknown
  misc_feature (1)..( 9): Result.005 file - promoters50/3062012
aaaatttga

SEQ ID NO: 182384 - DNA, 9 bp, Unknown
  misc_feature (1)..( 9): Result.005 file - promoters50/3062012
aaaattcat

SEQ ID NO: 182385 - DNA, 9 bp, Unknown
  misc_feature (1)..( 9): Result.005 file - promoters50/3062012
aaaatttat

SEQ ID NO: 182386 - DNA, 9 bp, Unknown
  misc_feature (1)..( 9): Result.005 file - promoters50/3062012
ttaatttat

SEQ ID NO: 182387 - DNA, 14 bp, Unknown
  misc_feature (1)..( 14): Result.005 file - promoters50/3062012
ccgtaacaaatata

SEQ ID NO: 182388 - DNA, 14 bp, Unknown
  misc_feature (1)..( 14): Result.005 file - promoters50/3062012
atttaaaaaacatt

SEQ ID NO: 182389 - DNA, 14 bp, Unknown
  misc_feature (1)..( 14): Result.005 file - promoters50/3062012
ttttcaaaaatatt

SEQ ID NO: 182390 - DNA, 14 bp, Unknown
  misc_feature (1)..( 14): Result.005 file - promoters50/3062012
ttttaaatgttgca

SEQ ID NO: 182391 - DNA, 14 bp, Unknown
  misc_feature (1)..( 14): Result.005 file - promoters50/3062012
ttttcaaaaatatt

SEQ ID NO: 182392 - DNA, 14 bp, Unknown
  misc_feature (1)..( 14): Result.005 file - promoters50/3062012
ttttcatgtatggt

SEQ ID NO: 182393 - DNA, 14 bp, Unknown
  misc_feature (1)..( 14): Result.005 file - promoters50/3062012
atttaaaaaacatt

SEQ ID NO: 182394 - DNA, 14 bp, Unknown
  misc_feature (1)..( 14): Result.005 file - promoters50/3062012
ttttattctctcta

SEQ ID NO: 182395 - DNA, 11 bp, Unknown
  misc_feature (1)..( 11): Result.005 file - promoters50/3238306
gttttggcgtt

SEQ ID NO: 182396 - DNA, 11 bp, Unknown
  misc_feature (1)..( 11): Result.005 file - promoters50/3238306
gtttgggcgag

SEQ ID NO: 182397 - DNA, 11 bp, Unknown
  misc_feature (1)..( 11): Result.005 file - promoters50/3238306
gatggggtgag

SEQ ID NO: 182398 - DNA, 8 bp, Unknown
  misc_feature (1)..( 8): Result.005 file - promoters50/3238306
taaattat

SEQ ID NO: 182399 - DNA, 8 bp, Unknown
  misc_feature (1)..( 8): Result.005 file - promoters50/3238306
aaaaatat

SEQ ID NO: 182400 - DNA, 8 bp, Unknown
  misc_feature (1)..( 8): Result.005 file - promoters50/3238306
aaaaatcc

SEQ ID NO: 182401 - DNA, 7 bp, Unknown
  misc_feature (1)..( 7): Result.005 file - promoters50/3238306
gattaat

SEQ ID NO: 182402 - DNA, 7 bp, Unknown
  misc_feature (1)..( 7): Result.005 file - promoters50/3238306
gatcaat

SEQ ID NO: 182403 - DNA, 7 bp, Unknown
  misc_feature (1)..( 7): Result.005 file - promoters50/3238306
gattaag

SEQ ID NO: 182404 - DNA, 8 bp, Unknown
  misc_feature (1)..( 8): Result.005 file - promoters50/3238306
gttggata

SEQ ID NO: 182405 - DNA, 8 bp, Unknown
  misc_feature (1)..( 8): Result.005 file - promoters50/3238306
gttggaga

SEQ ID NO: 182406 - DNA, 8 bp, Unknown
  misc_feature (1)..( 8): Result.005 file - promoters50/3238306
cttggaga

SEQ ID NO: 182407 - DNA, 10 bp, Unknown
  misc_feature (1)..( 10): Result.005 file - promoters50/3239163
aagtgttctg

SEQ ID NO: 182408 - DNA, 10 bp, Unknown
  misc_feature (1)..( 10): Result.005 file - promoters50/3239163
aagtgtggta

SEQ ID NO: 182409 - DNA, 10 bp, Unknown
  misc_feature (1)..( 10): Result.005 file - promoters50/3239163
tagtgtgtga

SEQ ID NO: 182410 - DNA, 10 bp, Unknown
  misc_feature (1)..( 10): Result.005 file - promoters50/3239163
aggtgtctga

SEQ ID NO: 182411 - DNA, 7 bp, Unknown
  misc_feature (1)..( 7): Result.005 file - promoters50/3239163
gatatat

SEQ ID NO: 182412 - DNA, 7 bp, Unknown
  misc_feature (1)..( 7): Result.005 file - promoters50/3239163
aatatat

SEQ ID NO: 182413 - DNA, 7 bp, Unknown
  misc_feature (1)..( 7): Result.005 file - promoters50/3239163
aatataa

SEQ ID NO: 182414 - DNA, 9 bp, Unknown
  misc_feature (1)..( 9): Result.005 file - promoters50/3239163
atacacata

SEQ ID NO: 182415 - DNA, 9 bp, Unknown
  misc_feature (1)..( 9): Result.005 file - promoters50/3239163
atacaaata

SEQ ID NO: 182416 - DNA, 9 bp, Unknown
  misc_feature (1)..( 9): Result.005 file - promoters50/3239163
tgtcacata

SEQ ID NO: 182417 - DNA, 8 bp, Unknown
  misc_feature (1)..( 8): Result.005 file - promoters50/3239175
gaaagaca

SEQ ID NO: 182418 - DNA, 8 bp, Unknown
  misc_feature (1)..( 8): Result.005 file - promoters50/3239175
gaaagaaa

SEQ ID NO: 182419 - DNA, 8 bp, Unknown
  misc_feature (1)..( 8): Result.005 file - promoters50/3239175
caaaaaca

SEQ ID NO: 182420 - DNA, 9 bp, Unknown
  misc_feature (1)..( 9): Result.005 file - promoters50/3239175
aaaggaaga

SEQ ID NO: 182421 - DNA, 9 bp, Unknown
  misc_feature (1)..( 9): Result.005 file - promoters50/3239175
aaaagaaaa

SEQ ID NO: 182422 - DNA, 9 bp, Unknown
  misc_feature (1)..( 9): Result.005 file - promoters50/3239175
aaagtaaag

SEQ ID NO: 182423 - DNA, 9 bp, Unknown
  misc_feature (1)..( 9): Result.005 file - promoters50/3239175
gagaataac

SEQ ID NO: 182424 - DNA, 9 bp, Unknown
  misc_feature (1)..( 9): Result.005 file - promoters50/3239175
gagtatata

SEQ ID NO: 182425 - DNA, 9 bp, Unknown
  misc_feature (1)..( 9): Result.005 file - promoters50/3239175
ttgtatata

SEQ ID NO: 182426 - DNA, 10 bp, Unknown
  misc_feature (1)..( 10): Result.005 file - promoters50/3245308
accaatatca

SEQ ID NO: 182427 - DNA, 10 bp, Unknown
  misc_feature (1)..( 10): Result.005 file - promoters50/3245308
ttcaatttca

SEQ ID NO: 182428 - DNA, 10 bp, Unknown
  misc_feature (1)..( 10): Result.005 file - promoters50/3245308
ttcaattttt

SEQ ID NO: 182429 - DNA, 7 bp, Unknown
  misc_feature (1)..( 7): Result.005 file - promoters50/3245308
aaattag

SEQ ID NO: 182430 - DNA, 7 bp, Unknown
  misc_feature (1)..( 7): Result.005 file - promoters50/3245308
gaattag

SEQ ID NO: 182431 - DNA, 7 bp, Unknown
  misc_feature (1)..( 7): Result.005 file - promoters50/3245308
aaattaa

SEQ ID NO: 182432 - DNA, 7 bp, Unknown
  misc_feature (1)..( 7): Result.005 file - promoters50/3245308
aagtgtt

SEQ ID NO: 182433 - DNA, 7 bp, Unknown
  misc_feature (1)..( 7): Result.005 file - promoters50/3245308
tagtgtt

SEQ ID NO: 182434 - DNA, 7 bp, Unknown
  misc_feature (1)..( 7): Result.005 file - promoters50/3245308
tagagtt

SEQ ID NO: 182435 - DNA, 7 bp, Unknown
  misc_feature (1)..( 7): Result.005 file - promoters50/3245308
ttcaatt

SEQ ID NO: 182436 - DNA, 7 bp, Unknown
  misc_feature (1)..( 7): Result.005 file - promoters50/3245308
ttctatt

SEQ ID NO: 182437 - DNA, 7 bp, Unknown
  misc_feature (1)..( 7): Result.005 file - promoters50/3245308
ttcaatt

SEQ ID NO: 182438 - DNA, 10 bp, Unknown
  misc_feature (1)..( 10): Result.005 file - promoters50/3245330
tggttgattt

SEQ ID NO: 182439 - DNA, 10 bp, Unknown
  misc_feature (1)..( 10): Result.005 file - promoters50/3245330
atgttaattc

SEQ ID NO: 182440 - DNA, 10 bp, Unknown
  misc_feature (1)..( 10): Result.005 file - promoters50/3245330
cttttgtttt

SEQ ID NO: 182441 - DNA, 10 bp, Unknown
  misc_feature (1)..( 10): Result.005 file - promoters50/3245330
ctgttgattt

SEQ ID NO: 182442 - DNA, 10 bp, Unknown
  misc_feature (1)..( 10): Result.005 file - promoters50/3245330
atggtaaaaa

SEQ ID NO: 182443 - DNA, 10 bp, Unknown
  misc_feature (1)..( 10): Result.005 file - promoters50/3245330
atgataaaac

SEQ ID NO: 182444 - DNA, 9 bp, Unknown
  misc_feature (1)..( 9): Result.005 file - promoters50/3245330
attcttttt

SEQ ID NO: 182445 - DNA, 9 bp, Unknown
  misc_feature (1)..( 9): Result.005 file - promoters50/3245330
aatctttta

SEQ ID NO: 182446 - DNA, 10 bp, Unknown
  misc_feature (1)..( 10): Result.005 file - promoters50/3245330
attcattttt

SEQ ID NO: 182447 - DNA, 10 bp, Unknown
  misc_feature (1)..( 10): Result.005 file - promoters50/3245330
actcttttaa

SEQ ID NO: 182448 - DNA, 10 bp, Unknown
  misc_feature (1)..( 10): Result.005 file - promoters50/3245330
cttaagttca

SEQ ID NO: 182449 - DNA, 13 bp, Unknown
  misc_feature (1)..( 13): Result.005 file - promoters50/3408983
aatgtgatttacg

SEQ ID NO: 182450 - DNA, 13 bp, Unknown
  misc_feature (1)..( 13): Result.005 file - promoters50/3408983
aatatgaatttgc

SEQ ID NO: 182451 - DNA, 13 bp, Unknown
  misc_feature (1)..( 13): Result.005 file - promoters50/3408983
attgtgttttacg

SEQ ID NO: 182452 - DNA, 11 bp, Unknown
  misc_feature (1)..( 11): Result.005 file - promoters50/3409019
ttttaaagatg

SEQ ID NO: 182453 - DNA, 11 bp, Unknown
  misc_feature (1)..( 11): Result.005 file - promoters50/3409019
tttgaaacata

SEQ ID NO: 182454 - DNA, 11 bp, Unknown
  misc_feature (1)..( 11): Result.005 file - promoters50/3409019
tttgattttga

SEQ ID NO: 182455 - DNA, 8 bp, Unknown
  misc_feature (1)..( 8): Result.005 file - promoters50/3409052
tataaaaa

SEQ ID NO: 182456 - DNA, 8 bp, Unknown
  misc_feature (1)..( 8): Result.005 file - promoters50/3409052
tatagaaa

SEQ ID NO: 182457 - DNA, 8 bp, Unknown
  misc_feature (1)..( 8): Result.005 file - promoters50/3409052
tataaaaa

SEQ ID NO: 182458 - DNA, 8 bp, Unknown
  misc_feature (1)..( 8): Result.005 file - promoters50/3409052
taaaaata

SEQ ID NO: 182459 - DNA, 8 bp, Unknown
  misc_feature (1)..( 8): Result.005 file - promoters50/3409052
taaaaagt

SEQ ID NO: 182460 - DNA, 8 bp, Unknown
  misc_feature (1)..( 8): Result.005 file - promoters50/3409052
aaaaaagt

SEQ ID NO: 182461 - DNA, 12 bp, Unknown
  misc_feature (1)..( 12): Result.005 file - promoters50/3409075
aggtttatatga

SEQ ID NO: 182462 - DNA, 12 bp, Unknown
  misc_feature (1)..( 12): Result.005 file - promoters50/3409075
tgcattatgtga

SEQ ID NO: 182463 - DNA, 12 bp, Unknown
  misc_feature (1)..( 12): Result.005 file - promoters50/3409075
atttttatacat

SEQ ID NO: 182464 - DNA, 12 bp, Unknown
  misc_feature (1)..( 12): Result.005 file - promoters50/3409075
tgatttatgttc

SEQ ID NO: 182465 - DNA, 12 bp, Unknown
  misc_feature (1)..( 12): Result.005 file - promoters50/3409075
atttgtatacca

SEQ ID NO: 182466 - DNA, 12 bp, Unknown
  misc_feature (1)..( 12): Result.005 file - promoters50/3409075
atttgtttgctg

SEQ ID NO: 182467 - DNA, 10 bp, Unknown
  misc_feature (1)..( 10): Result.005 file - promoters50/3409075
agttttatta

SEQ ID NO: 182468 - DNA, 10 bp, Unknown
  misc_feature (1)..( 10): Result.005 file - promoters50/3409075
tcttttatgt

SEQ ID NO: 182469 - DNA, 10 bp, Unknown
  misc_feature (1)..( 10): Result.005 file - promoters50/3409075
aatttaatgt

SEQ ID NO: 182470 - DNA, 10 bp, Unknown
  misc_feature (1)..( 10): Result.005 file - promoters50/3409075
tcttttaata

SEQ ID NO: 182471 - DNA, 10 bp, Unknown
  misc_feature (1)..( 10): Result.005 file - promoters50/3409075
atatttatgc

SEQ ID NO: 182472 - DNA, 10 bp, Unknown
  misc_feature (1)..( 10): Result.005 file - promoters50/3409075
tatttttgtt

SEQ ID NO: 182473 - DNA, 11 bp, Unknown
  misc_feature (1)..( 11): Result.005 file - promoters50/3409075
gaattgaactt

SEQ ID NO: 182474 - DNA, 11 bp, Unknown
  misc_feature (1)..( 11): Result.005 file - promoters50/3409075
gaattgagaga

SEQ ID NO: 182475 - DNA, 11 bp, Unknown
  misc_feature (1)..( 11): Result.005 file - promoters50/3409075
gaatcgaaccc

SEQ ID NO: 182476 - DNA, 11 bp, Unknown
  misc_feature (1)..( 11): Result.005 file - promoters50/3409075
gaatggaaaac

SEQ ID NO: 182477 - DNA, 11 bp, Unknown
  misc_feature (1)..( 11): Result.005 file - promoters50/3409075
tgatttagaga

SEQ ID NO: 182478 - DNA, 11 bp, Unknown
  misc_feature (1)..( 11): Result.005 file - promoters50/3409075
acttcgagccc

SEQ ID NO: 182479 - DNA, 13 bp, Unknown
  misc_feature (1)..( 13): Result.005 file - promoters50/3409075
cttctaattatat

SEQ ID NO: 182480 - DNA, 13 bp, Unknown
  misc_feature (1)..( 13): Result.005 file - promoters50/3409075
cttttaatagcac

SEQ ID NO: 182481 - DNA, 13 bp, Unknown
  misc_feature (1)..( 13): Result.005 file - promoters50/3409075
catttaatctttt

SEQ ID NO: 182482 - DNA, 13 bp, Unknown
  misc_feature (1)..( 13): Result.005 file - promoters50/3409075
aattaaatattca

SEQ ID NO: 182483 - DNA, 13 bp, Unknown
  misc_feature (1)..( 13): Result.005 file - promoters50/3409075
agattaatatttt

SEQ ID NO: 182484 - DNA, 13 bp, Unknown
  misc_feature (1)..( 13): Result.005 file - promoters50/3409075
aatttaatgtcta

SEQ ID NO: 182485 - DNA, 10 bp, Unknown
  misc_feature (1)..( 10): Result.005 file - promoters50/3409141
aagcaaaaag

SEQ ID NO: 182486 - DNA, 10 bp, Unknown
  misc_feature (1)..( 10): Result.005 file - promoters50/3409141
aagcaaaaaa

SEQ ID NO: 182487 - DNA, 10 bp, Unknown
  misc_feature (1)..( 10): Result.005 file - promoters50/3409141
tagtaaaaaa

SEQ ID NO: 182488 - DNA, 9 bp, Unknown
  misc_feature (1)..( 9): Result.005 file - promoters50/3409141
atttatatg

SEQ ID NO: 182489 - DNA, 9 bp, Unknown
  misc_feature (1)..( 9): Result.005 file - promoters50/3409141
ctttataga

SEQ ID NO: 182490 - DNA, 9 bp, Unknown
  misc_feature (1)..( 9): Result.005 file - promoters50/3409141
cttcataga

SEQ ID NO: 182491 - DNA, 7 bp, Unknown
  misc_feature (1)..( 7): Result.005 file - promoters50/3409141
taaatct

SEQ ID NO: 182492 - DNA, 7 bp, Unknown
  misc_feature (1)..( 7): Result.005 file - promoters50/3409141
caaatct

SEQ ID NO: 182493 - DNA, 7 bp, Unknown
  misc_feature (1)..( 7): Result.005 file - promoters50/3409141
taactct

SEQ ID NO: 182494 - DNA, 9 bp, Unknown
  misc_feature (1)..( 9): Result.005 file - promoters50/3409141
cgttcaaat

SEQ ID NO: 182495 - DNA, 9 bp, Unknown
  misc_feature (1)..( 9): Result.005 file - promoters50/3409141
ttttcaaat

SEQ ID NO: 182496 - DNA, 10 bp, Unknown
  misc_feature (1)..( 10): Result.005 file - promoters50/3409141
ttttacaagt

SEQ ID NO: 182497 - DNA, 7 bp, Unknown
  misc_feature (1)..( 7): Result.005 file - promoters50/3409141
taaaata

SEQ ID NO: 182498 - DNA, 7 bp, Unknown
  misc_feature (1)..( 7): Result.005 file - promoters50/3409141
taaaatc

SEQ ID NO: 182499 - DNA, 7 bp, Unknown
  misc_feature (1)..( 7): Result.005 file - promoters50/3409141
caaaatc

SEQ ID NO: 182500 - DNA, 6 bp, Unknown
  misc_feature (1)..( 6): Result.005 file - promoters50/3409141
aaaaaa

SEQ ID NO: 182501 - DNA, 6 bp, Unknown
  misc_feature (1)..( 6): Result.005 file - promoters50/3409141
aaaaaa

SEQ ID NO: 182502 - DNA, 6 bp, Unknown
  misc_feature (1)..( 6): Result.005 file - promoters50/3409141
aaaaaa

SEQ ID NO: 182503 - DNA, 7 bp, Unknown
  misc_feature (1)..( 7): Result.005 file - promoters50/3409141
ttttttt

SEQ ID NO: 182504 - DNA, 7 bp, Unknown
  misc_feature (1)..( 7): Result.005 file - promoters50/3409141
tttttta

SEQ ID NO: 182505 - DNA, 7 bp, Unknown
  misc_feature (1)..( 7): Result.005 file - promoters50/3409141
tttatta

SEQ ID NO: 182506 - DNA, 10 bp, Unknown
  misc_feature (1)..( 10): Result.005 file - promoters50/3409141
tttttatata

SEQ ID NO: 182507 - DNA, 10 bp, Unknown
  misc_feature (1)..( 10): Result.005 file - promoters50/3409141
ttttaataac

SEQ ID NO: 182508 - DNA, 10 bp, Unknown
  misc_feature (1)..( 10): Result.005 file - promoters50/3409141
ttttactaac

SEQ ID NO: 182509 - DNA, 11 bp, Unknown
  misc_feature (1)..( 11): Result.005 file - promoters50/3409161
ataaagttcac

SEQ ID NO: 182510 - DNA, 11 bp, Unknown
  misc_feature (1)..( 11): Result.005 file - promoters50/3409161
gaaaaattcaa

SEQ ID NO: 182511 - DNA, 11 bp, Unknown
  misc_feature (1)..( 11): Result.005 file - promoters50/3409161
ataaagtttgg

SEQ ID NO: 182512 - DNA, 11 bp, Unknown
  misc_feature (1)..( 11): Result.005 file - promoters50/3409161
acaaacttcca

SEQ ID NO: 182513 - DNA, 11 bp, Unknown
  misc_feature (1)..( 11): Result.005 file - promoters50/3409161
ttaaattttgg

SEQ ID NO: 182514 - DNA, 11 bp, Unknown
  misc_feature (1)..( 11): Result.005 file - promoters50/3409161
gcaaatgttgg

SEQ ID NO: 182515 - DNA, 11 bp, Unknown
  misc_feature (1)..( 11): Result.005 file - promoters50/3409165
acaaacaactc

SEQ ID NO: 182516 - DNA, 11 bp, Unknown
  misc_feature (1)..( 11): Result.005 file - promoters50/3409165
tcaatcaaact

SEQ ID NO: 182517 - DNA, 11 bp, Unknown
  misc_feature (1)..( 11): Result.005 file - promoters50/3409165
ataaaaaactc

SEQ ID NO: 182518 - DNA, 11 bp, Unknown
  misc_feature (1)..( 11): Result.005 file - promoters50/3409165
ggaaacactta

SEQ ID NO: 182519 - DNA, 11 bp, Unknown
  misc_feature (1)..( 11): Result.005 file - promoters50/3409165
tcaaccaacta

SEQ ID NO: 182520 - DNA, 11 bp, Unknown
  misc_feature (1)..( 11): Result.005 file - promoters50/3409165
ccaatcacaac

SEQ ID NO: 182521 - DNA, 12 bp, Unknown
  misc_feature (1)..( 12): Result.005 file - promoters50/3409165
atttttattcta

SEQ ID NO: 182522 - DNA, 12 bp, Unknown
  misc_feature (1)..( 12): Result.005 file - promoters50/3409165
tgtttgattgaa

SEQ ID NO: 182523 - DNA, 12 bp, Unknown
  misc_feature (1)..( 12): Result.005 file - promoters50/3409165
agatttatttcg

SEQ ID NO: 182524 - DNA, 12 bp, Unknown
  misc_feature (1)..( 12): Result.005 file - promoters50/3409165
atttttaccata

SEQ ID NO: 182525 - DNA, 12 bp, Unknown
  misc_feature (1)..( 12): Result.005 file - promoters50/3409165
caattaatctca

SEQ ID NO: 182526 - DNA, 12 bp, Unknown
  misc_feature (1)..( 12): Result.005 file - promoters50/3409165
acagaaatgtca

SEQ ID NO: 182527 - DNA, 12 bp, Unknown
  misc_feature (1)..( 12): Result.005 file - promoters50/3409191
gtttgtatgcag

SEQ ID NO: 182528 - DNA, 12 bp, Unknown
  misc_feature (1)..( 12): Result.005 file - promoters50/3409191
gtttgaatggta

SEQ ID NO: 182529 - DNA, 12 bp, Unknown
  misc_feature (1)..( 12): Result.005 file - promoters50/3409191
ctttctattcag

SEQ ID NO: 182530 - DNA, 14 bp, Unknown
  misc_feature (1)..( 14): Result.005 file - promoters50/3409214
ctgttgacaattag

SEQ ID NO: 182531 - DNA, 14 bp, Unknown
  misc_feature (1)..( 14): Result.005 file - promoters50/3409214
cctccgtcaagtag

SEQ ID NO: 182532 - DNA, 14 bp, Unknown
  misc_feature (1)..( 14): Result.005 file - promoters50/3409214
ttttctacaattta

SEQ ID NO: 182533 - DNA, 14 bp, Unknown
  misc_feature (1)..( 14): Result.005 file - promoters50/3409214
ttttctaaaataat

SEQ ID NO: 182534 - DNA, 14 bp, Unknown
  misc_feature (1)..( 14): Result.005 file - promoters50/3409214
atgtttaaaataaa

SEQ ID NO: 182535 - DNA, 9 bp, Unknown
  misc_feature (1)..( 9): Result.005 file - promoters50/3409390
agtatttac

SEQ ID NO: 182536 - DNA, 7 bp, Unknown
  misc_feature (1)..( 7): Result.005 file - promoters50/3409390
tatttaa

SEQ ID NO: 182537 - DNA, 9 bp, Unknown
  misc_feature (1)..( 9): Result.005 file - promoters50/3409390
agtttttga

SEQ ID NO: 182538 - DNA, 9 bp, Unknown
  misc_feature (1)..( 9): Result.005 file - promoters50/3409390
aatatttac

SEQ ID NO: 182539 - DNA, 9 bp, Unknown
  misc_feature (1)..( 9): Result.005 file - promoters50/3409390
cgttttttt

SEQ ID NO: 182540 - DNA, 7 bp, Unknown
  misc_feature (1)..( 7): Result.005 file - promoters50/3409390
ttttttt

SEQ ID NO: 182541 - DNA, 11 bp, Unknown
  misc_feature (1)..( 11): Result.005 file - promoters50/3409390
gttttttaatt

SEQ ID NO: 182542 - DNA, 11 bp, Unknown
  misc_feature (1)..( 11): Result.005 file - promoters50/3409390
aaagtttaata

SEQ ID NO: 182543 - DNA, 12 bp, Unknown
  misc_feature (1)..( 12): Result.005 file - promoters50/3409390
gattttataata

SEQ ID NO: 182544 - DNA, 12 bp, Unknown
  misc_feature (1)..( 12): Result.005 file - promoters50/3409390
ttctttttaatt

SEQ ID NO: 182545 - DNA, 12 bp, Unknown
  misc_feature (1)..( 12): Result.005 file - promoters50/3409390
tattttataggt

SEQ ID NO: 182546 - DNA, 12 bp, Unknown
  misc_feature (1)..( 12): Result.005 file - promoters50/3409390
ctcattttaaca

SEQ ID NO: 182547 - DNA, 12 bp, Unknown
  misc_feature (1)..( 12): Result.005 file - promoters50/3409390
tatattataaca

SEQ ID NO: 182548 - DNA, 13 bp, Unknown
  misc_feature (1)..( 13): Result.005 file - promoters50/3409390
gcatgatataaat

SEQ ID NO: 182549 - DNA, 13 bp, Unknown
  misc_feature (1)..( 13): Result.005 file - promoters50/3409390
aaataatataaca

SEQ ID NO: 182550 - DNA, 13 bp, Unknown
  misc_feature (1)..( 13): Result.005 file - promoters50/3409390
aataattataaag

SEQ ID NO: 182551 - DNA, 13 bp, Unknown
  misc_feature (1)..( 13): Result.005 file - promoters50/3409390
atgttatatatta

SEQ ID NO: 182552 - DNA, 13 bp, Unknown
  misc_feature (1)..( 13): Result.005 file - promoters50/3409390
caattatataggt

SEQ ID NO: 182553 - DNA, 13 bp, Unknown
  misc_feature (1)..( 13): Result.005 file - promoters50/3409390
ttattttataggt

SEQ ID NO: 182554 - DNA, 13 bp, Unknown
  misc_feature (1)..( 13): Result.005 file - promoters50/3409390
tcattttaacatc

SEQ ID NO: 182555 - DNA, 11 bp, Unknown
  misc_feature (1)..( 11): Result.005 file - promoters50/3409390
tttttattttt

SEQ ID NO: 182556 - DNA, 11 bp, Unknown
  misc_feature (1)..( 11): Result.005 file - promoters50/3409390
actttatttta

SEQ ID NO: 182557 - DNA, 11 bp, Unknown
  misc_feature (1)..( 11): Result.005 file - promoters50/3409390
tcaacattttt

SEQ ID NO: 182558 - DNA, 11 bp, Unknown
  misc_feature (1)..( 11): Result.005 file - promoters50/3409390
attttataata

SEQ ID NO: 182559 - DNA, 11 bp, Unknown
  misc_feature (1)..( 11): Result.005 file - promoters50/3409390
tttttaattct

SEQ ID NO: 182560 - DNA, 11 bp, Unknown
  misc_feature (1)..( 11): Result.005 file - promoters50/3409390
tctatattata

SEQ ID NO: 182561 - DNA, 11 bp, Unknown
  misc_feature (1)..( 11): Result.005 file - promoters50/3409390
gttttttaatt

SEQ ID NO: 182562 - DNA, 11 bp, Unknown
  misc_feature (1)..( 11): Result.005 file - promoters50/3409390
attttttagta

SEQ ID NO: 182563 - DNA, 11 bp, Unknown
  misc_feature (1)..( 11): Result.005 file - promoters50/3409390
ttattttatag

SEQ ID NO: 182564 - DNA, 11 bp, Unknown
  misc_feature (1)..( 11): Result.005 file - promoters50/3409390
ctatattataa

SEQ ID NO: 182565 - DNA, 11 bp, Unknown
  misc_feature (1)..( 11): Result.005 file - promoters50/3409390
atttttttcac

SEQ ID NO: 182566 - DNA, 11 bp, Unknown
  misc_feature (1)..( 11): Result.005 file - promoters50/3409390
aataattataa

SEQ ID NO: 182567 - DNA, 14 bp, Unknown
  misc_feature (1)..( 14): Result.005 file - promoters50/3409390
aataatataacatc

SEQ ID NO: 182568 - DNA, 14 bp, Unknown
  misc_feature (1)..( 14): Result.005 file - promoters50/3409390
ctcattttaacatc

SEQ ID NO: 182569 - DNA, 14 bp, Unknown
  misc_feature (1)..( 14): Result.005 file - promoters50/3409390
tatattataacatt

SEQ ID NO: 182570 - DNA, 14 bp, Unknown
  misc_feature (1)..( 14): Result.005 file - promoters50/3409390
tattttataggtcc

SEQ ID NO: 182571 - DNA, 14 bp, Unknown
  misc_feature (1)..( 14): Result.005 file - promoters50/3409390
ataattataaagta

SEQ ID NO: 182572 - DNA, 14 bp, Unknown
  misc_feature (1)..( 14): Result.005 file - promoters50/3409390
acaattatataggt

SEQ ID NO: 182573 - DNA, 11 bp, Unknown
  misc_feature (1)..( 11): Result.005 file - promoters50/3409390
attatatatta

SEQ ID NO: 182574 - DNA, 11 bp, Unknown
  misc_feature (1)..( 11): Result.005 file - promoters50/3409390
attataaagta

SEQ ID NO: 182575 - DNA, 11 bp, Unknown
  misc_feature (1)..( 11): Result.005 file - promoters50/3409390
attatataggt

SEQ ID NO: 182576 - DNA, 11 bp, Unknown
  misc_feature (1)..( 11): Result.005 file - promoters50/3409390
attataacatt

SEQ ID NO: 182577 - DNA, 11 bp, Unknown
  misc_feature (1)..( 11): Result.005 file - promoters50/3409390
attttataggt

SEQ ID NO: 182578 - DNA, 11 bp, Unknown
  misc_feature (1)..( 11): Result.005 file - promoters50/3409390
attttaacatc

SEQ ID NO: 182579 - DNA, 9 bp, Unknown
  misc_feature (1)..( 9): Result.005 file - promoters50/3409489
ctatggtta

SEQ ID NO: 182580 - DNA, 9 bp, Unknown
  misc_feature (1)..( 9): Result.005 file - promoters50/3409489
aaatgatta

SEQ ID NO: 182581 - DNA, 9 bp, Unknown
  misc_feature (1)..( 9): Result.005 file - promoters50/3409489
ttatggtaa

SEQ ID NO: 182582 - DNA, 9 bp, Unknown
  misc_feature (1)..( 9): Result.005 file - promoters50/3409489
aaaggatta

SEQ ID NO: 182583 - DNA, 9 bp, Unknown
  misc_feature (1)..( 9): Result.005 file - promoters50/3409489
aaaagatgg

SEQ ID NO: 182584 - DNA, 9 bp, Unknown
  misc_feature (1)..( 9): Result.005 file - promoters50/3409489
acaagctgg

SEQ ID NO: 182585 - DNA, 11 bp, Unknown
  misc_feature (1)..( 11): Result.005 file - promoters50/3409631
ttttcttataa

SEQ ID NO: 182586 - DNA, 11 bp, Unknown
  misc_feature (1)..( 11): Result.005 file - promoters50/3409631
ttttctgatat

SEQ ID NO: 182587 - DNA, 11 bp, Unknown
  misc_feature (1)..( 11): Result.005 file - promoters50/3409631
ctatattataa

SEQ ID NO: 182588 - DNA, 11 bp, Unknown
  misc_feature (1)..( 11): Result.005 file - promoters50/3409637
catggataaag

SEQ ID NO: 182589 - DNA, 11 bp, Unknown
  misc_feature (1)..( 11): Result.005 file - promoters50/3409637
catggatttat

SEQ ID NO: 182590 - DNA, 11 bp, Unknown
  misc_feature (1)..( 11): Result.005 file - promoters50/3409637
tatgaattgaa

SEQ ID NO: 182591 - DNA, 11 bp, Unknown
  misc_feature (1)..( 11): Result.005 file - promoters50/3409637
tttggattttg

SEQ ID NO: 182592 - DNA, 11 bp, Unknown
  misc_feature (1)..( 11): Result.005 file - promoters50/3409637
attggatttaa

SEQ ID NO: 182593 - DNA, 11 bp, Unknown
  misc_feature (1)..( 11): Result.005 file - promoters50/3409637
ttttcatttaa

SEQ ID NO: 182594 - DNA, 16 bp, Unknown
  misc_feature (1)..( 16): Result.005 file - promoters50/3409637
ttttgttagttgtttg

SEQ ID NO: 182595 - DNA, 16 bp, Unknown
  misc_feature (1)..( 16): Result.005 file - promoters50/3409637
gacatatgattgtttt

SEQ ID NO: 182596 - DNA, 16 bp, Unknown
  misc_feature (1)..( 16): Result.005 file - promoters50/3409637
tattaacaattttttt

SEQ ID NO: 182597 - DNA, 15 bp, Unknown
  misc_feature (1)..( 15): Result.005 file - promoters50/3409637
atgtcaaatttgtct

SEQ ID NO: 182598 - DNA, 15 bp, Unknown
  misc_feature (1)..( 15): Result.005 file - promoters50/3409637
atgttaaattaaata

SEQ ID NO: 182599 - DNA, 16 bp, Unknown
  misc_feature (1)..( 16): Result.005 file - promoters50/3409637
agaacttccatgtttt

SEQ ID NO: 182600 - DNA, 16 bp, Unknown
  misc_feature (1)..( 16): Result.005 file - promoters50/3409637
aaggcaaagttggccg

SEQ ID NO: 182601 - DNA, 12 bp, Unknown
  misc_feature (1)..( 12): Result.005 file - promoters50/3409637
acaatttttttc

SEQ ID NO: 182602 - DNA, 12 bp, Unknown
  misc_feature (1)..( 12): Result.005 file - promoters50/3409637
ttaattttttga

SEQ ID NO: 182603 - DNA, 13 bp, Unknown
  misc_feature (1)..( 13): Result.005 file - promoters50/3409637
atgattgttttgg

SEQ ID NO: 182604 - DNA, 13 bp, Unknown
  misc_feature (1)..( 13): Result.005 file - promoters50/3409637
caaatttgtctca

SEQ ID NO: 182605 - DNA, 13 bp, Unknown
  misc_feature (1)..( 13): Result.005 file - promoters50/3409637
ccagtttatgaat

SEQ ID NO: 182606 - DNA, 13 bp, Unknown
  misc_feature (1)..( 13): Result.005 file - promoters50/3409637
catgtttttgctg

SEQ ID NO: 182607 - DNA, 13 bp, Unknown
  misc_feature (1)..( 13): Result.005 file - promoters50/3409637
caaagttggccgc

SEQ ID NO: 182608 - DNA, 9 bp, Unknown
  misc_feature (1)..( 9): Result.005 file - promoters50/3409637
tttggtttt

SEQ ID NO: 182609 - DNA, 9 bp, Unknown
  misc_feature (1)..( 9): Result.005 file - promoters50/3409637
ttttgtttc

SEQ ID NO: 182610 - DNA, 9 bp, Unknown
  misc_feature (1)..( 9): Result.005 file - promoters50/3409637
cttggttgg

SEQ ID NO: 182611 - DNA, 9 bp, Unknown
  misc_feature (1)..( 9): Result.005 file - promoters50/3409637
gttgatttt

SEQ ID NO: 182612 - DNA, 9 bp, Unknown
  misc_feature (1)..( 9): Result.005 file - promoters50/3409637
gtttatttg

SEQ ID NO: 182613 - DNA, 9 bp, Unknown
  misc_feature (1)..( 9): Result.005 file - promoters50/3409637
tgtggttgg

SEQ ID NO: 182614 - DNA, 15 bp, Unknown
  misc_feature (1)..( 15): Result.005 file - promoters50/3409637
gcttgaatcaatatt

SEQ ID NO: 182615 - DNA, 15 bp, Unknown
  misc_feature (1)..( 15): Result.005 file - promoters50/3409637
aattgattcaaaatt

SEQ ID NO: 182616 - DNA, 15 bp, Unknown
  misc_feature (1)..( 15): Result.005 file - promoters50/3409637
tcttaaatatttttc

SEQ ID NO: 182617 - DNA, 15 bp, Unknown
  misc_feature (1)..( 15): Result.005 file - promoters50/3409637
tctaaaaaggcagaa

SEQ ID NO: 182618 - DNA, 15 bp, Unknown
  misc_feature (1)..( 15): Result.005 file - promoters50/3409637
gccagaagctaagaa

SEQ ID NO: 182619 - DNA, 15 bp, Unknown
  misc_feature (1)..( 15): Result.005 file - promoters50/3409637
gtaaaaattatacca

SEQ ID NO: 182620 - DNA, 11 bp, Unknown
  misc_feature (1)..( 11): Result.005 file - promoters50/3409712
gaaaaagttca

SEQ ID NO: 182621 - DNA, 11 bp, Unknown
  misc_feature (1)..( 11): Result.005 file - promoters50/3409712
caaatagttcg

SEQ ID NO: 182622 - DNA, 11 bp, Unknown
  misc_feature (1)..( 11): Result.005 file - promoters50/3409712
gaaaaagtatg

SEQ ID NO: 182623 - DNA, 11 bp, Unknown
  misc_feature (1)..( 11): Result.005 file - promoters50/3409712
caaatatatct

SEQ ID NO: 182624 - DNA, 11 bp, Unknown
  misc_feature (1)..( 11): Result.005 file - promoters50/3409712
aaactaatcaa

SEQ ID NO: 182625 - DNA, 11 bp, Unknown
  misc_feature (1)..( 11): Result.005 file - promoters50/3409712
caactaaacaa

SEQ ID NO: 182626 - DNA, 13 bp, Unknown
  misc_feature (1)..( 13): Result.005 file - promoters50/3433703
ataattttacaat

SEQ ID NO: 182627 - DNA, 13 bp, Unknown
  misc_feature (1)..( 13): Result.005 file - promoters50/3433703
atactttatcgtc

SEQ ID NO: 182628 - DNA, 13 bp, Unknown
  misc_feature (1)..( 13): Result.005 file - promoters50/3433703
ataattttagaga

SEQ ID NO: 182629 - DNA, 13 bp, Unknown
  misc_feature (1)..( 13): Result.005 file - promoters50/3433703
aaaattttaaaat

SEQ ID NO: 182630 - DNA, 13 bp, Unknown
  misc_feature (1)..( 13): Result.005 file - promoters50/3433703
ataattttagaga

SEQ ID NO: 182631 - DNA, 13 bp, Unknown
  misc_feature (1)..( 13): Result.005 file - promoters50/3433703
aaaattacaaaaa

SEQ ID NO: 182632 - DNA, 14 bp, Unknown
  misc_feature (1)..( 14): Result.005 file - promoters50/3433703
aagaaaaaacaatg

SEQ ID NO: 182633 - DNA, 14 bp, Unknown
  misc_feature (1)..( 14): Result.005 file - promoters50/3433703
ctcataaatcaatc

SEQ ID NO: 182634 - DNA, 14 bp, Unknown
  misc_feature (1)..( 14): Result.005 file - promoters50/3433703
aagctaaaacattt

SEQ ID NO: 182635 - DNA, 14 bp, Unknown
  misc_feature (1)..( 14): Result.005 file - promoters50/3433703
agagctaaacaaca

SEQ ID NO: 182636 - DNA, 15 bp, Unknown
  misc_feature (1)..( 15): Result.005 file - promoters50/3433703
aaagtaaacacaata

SEQ ID NO: 182637 - DNA, 15 bp, Unknown
  misc_feature (1)..( 15): Result.005 file - promoters50/3433703
taatgacaatcaaat

SEQ ID NO: 182638 - DNA, 12 bp, Unknown
  misc_feature (1)..( 12): Result.005 file - promoters50/3433703
catataaatctc

SEQ ID NO: 182639 - DNA, 12 bp, Unknown
  misc_feature (1)..( 12): Result.005 file - promoters50/3433703
tctataaaaaaa

SEQ ID NO: 182640 - DNA, 12 bp, Unknown
  misc_feature (1)..( 12): Result.005 file - promoters50/3433703
tatataaatagt

SEQ ID NO: 182641 - DNA, 12 bp, Unknown
  misc_feature (1)..( 12): Result.005 file - promoters50/3433703
tatatatatctc

SEQ ID NO: 182642 - DNA, 12 bp, Unknown
  misc_feature (1)..( 12): Result.005 file - promoters50/3433703
gctataaaagga

SEQ ID NO: 182643 - DNA, 12 bp, Unknown
  misc_feature (1)..( 12): Result.005 file - promoters50/3433703
gttataaaacca

SEQ ID NO: 182644 - DNA, 12 bp, Unknown
  misc_feature (1)..( 12): Result.005 file - promoters50/3433703
tatttatatgtt

SEQ ID NO: 182645 - DNA, 10 bp, Unknown
  misc_feature (1)..( 10): Result.005 file - promoters50/3433703
acttgttata

SEQ ID NO: 182646 - DNA, 10 bp, Unknown
  misc_feature (1)..( 10): Result.005 file - promoters50/3433703
ttttgctata

SEQ ID NO: 182647 - DNA, 10 bp, Unknown
  misc_feature (1)..( 10): Result.005 file - promoters50/3433703
atttactaat

SEQ ID NO: 182648 - DNA, 10 bp, Unknown
  misc_feature (1)..( 10): Result.005 file - promoters50/3433703
aattattaaa

SEQ ID NO: 182649 - DNA, 10 bp, Unknown
  misc_feature (1)..( 10): Result.005 file - promoters50/3433703
tcttattaaa

SEQ ID NO: 182650 - DNA, 10 bp, Unknown
  misc_feature (1)..( 10): Result.005 file - promoters50/3433703
atttacgaga

SEQ ID NO: 182651 - DNA, 10 bp, Unknown
  misc_feature (1)..( 10): Result.005 file - promoters50/3433703
aaattattac

SEQ ID NO: 182652 - DNA, 10 bp, Unknown
  misc_feature (1)..( 10): Result.005 file - promoters50/3433703
aaatgatttc

SEQ ID NO: 182653 - DNA, 10 bp, Unknown
  misc_feature (1)..( 10): Result.005 file - promoters50/3433703
acattattga

SEQ ID NO: 182654 - DNA, 10 bp, Unknown
  misc_feature (1)..( 10): Result.005 file - promoters50/3433703
caatcatttt

SEQ ID NO: 182655 - DNA, 10 bp, Unknown
  misc_feature (1)..( 10): Result.005 file - promoters50/3433703
ataagattca

SEQ ID NO: 182656 - DNA, 10 bp, Unknown
  misc_feature (1)..( 10): Result.005 file - promoters50/3433703
cttgaattct

SEQ ID NO: 182657 - DNA, 10 bp, Unknown
  misc_feature (1)..( 10): Result.005 file - promoters50/3433703
acggaattcc

SEQ ID NO: 182658 - DNA, 10 bp, Unknown
  misc_feature (1)..( 10): Result.005 file - promoters50/3433703
aaatttatta

SEQ ID NO: 182659 - DNA, 10 bp, Unknown
  misc_feature (1)..( 10): Result.005 file - promoters50/3433703
acttttgtta

SEQ ID NO: 182660 - DNA, 10 bp, Unknown
  misc_feature (1)..( 10): Result.005 file - promoters50/3433703
aaatatatct

SEQ ID NO: 182661 - DNA, 10 bp, Unknown
  misc_feature (1)..( 10): Result.005 file - promoters50/3433703
tactttatta

SEQ ID NO: 182662 - DNA, 10 bp, Unknown
  misc_feature (1)..( 10): Result.005 file - promoters50/3433703
gtatttcttt

SEQ ID NO: 182663 - DNA, 10 bp, Unknown
  misc_feature (1)..( 10): Result.005 file - promoters50/3433703
aaaaataatt

SEQ ID NO: 182664 - DNA, 14 bp, Unknown
  misc_feature (1)..( 14): Result.005 file - promoters50/3433703
caaagaatttctcc

SEQ ID NO: 182665 - DNA, 14 bp, Unknown
  misc_feature (1)..( 14): Result.005 file - promoters50/3433703
aaaataattgataa

SEQ ID NO: 182666 - DNA, 14 bp, Unknown
  misc_feature (1)..( 14): Result.005 file - promoters50/3433703
tacggaattcctcc

SEQ ID NO: 182667 - DNA, 14 bp, Unknown
  misc_feature (1)..( 14): Result.005 file - promoters50/3433703
caaacaatcatttt

SEQ ID NO: 182668 - DNA, 14 bp, Unknown
  misc_feature (1)..( 14): Result.005 file - promoters50/3433703
taaatatatcttga

SEQ ID NO: 182669 - DNA, 14 bp, Unknown
  misc_feature (1)..( 14): Result.005 file - promoters50/3433703
tcttgaattctcat

SEQ ID NO: 182670 - DNA, 10 bp, Unknown
  misc_feature (1)..( 10): Result.005 file - promoters50/3433743
ttgagatttt

SEQ ID NO: 182671 - DNA, 10 bp, Unknown
  misc_feature (1)..( 10): Result.005 file - promoters50/3433743
ctaggatttt

SEQ ID NO: 182672 - DNA, 10 bp, Unknown
  misc_feature (1)..( 10): Result.005 file - promoters50/3433743
ttgaaatttc

SEQ ID NO: 182673 - DNA, 8 bp, Unknown
  misc_feature (1)..( 8): Result.005 file - promoters50/3433743
aaatttca

SEQ ID NO: 182674 - DNA, 8 bp, Unknown
  misc_feature (1)..( 8): Result.005 file - promoters50/3433743
aaatttcg

SEQ ID NO: 182675 - DNA, 8 bp, Unknown
  misc_feature (1)..( 8): Result.005 file - promoters50/3433743
tgatttcg

SEQ ID NO: 182676 - DNA, 12 bp, Unknown
  misc_feature (1)..( 12): Result.005 file - promoters50/3433799
gattgataacag

SEQ ID NO: 182677 - DNA, 12 bp, Unknown
  misc_feature (1)..( 12): Result.005 file - promoters50/3433799
gattgttaacag

SEQ ID NO: 182678 - DNA, 12 bp, Unknown
  misc_feature (1)..( 12): Result.005 file - promoters50/3433799
tattaataatcg

SEQ ID NO: 182679 - DNA, 7 bp, Unknown
  misc_feature (1)..( 7): Result.005 file - promoters50/3433799
tggcaaa

SEQ ID NO: 182680 - DNA, 7 bp, Unknown
  misc_feature (1)..( 7): Result.005 file - promoters50/3433799
tggaaaa

SEQ ID NO: 182681 - DNA, 7 bp, Unknown
  misc_feature (1)..( 7): Result.005 file - promoters50/3433799
tggaaac

SEQ ID NO: 182682 - DNA, 9 bp, Unknown
  misc_feature (1)..( 9): Result.005 file - promoters50/3433799
aaatcattg

SEQ ID NO: 182683 - DNA, 9 bp, Unknown
  misc_feature (1)..( 9): Result.005 file - promoters50/3433799
aaaccattt

SEQ ID NO: 182684 - DNA, 9 bp, Unknown
  misc_feature (1)..( 9): Result.005 file - promoters50/3433799
tatccattt

SEQ ID NO: 182685 - DNA, 9 bp, Unknown
  misc_feature (1)..( 9): Result.005 file - promoters50/3433799
ctttataat

SEQ ID NO: 182686 - DNA, 9 bp, Unknown
  misc_feature (1)..( 9): Result.005 file - promoters50/3433799
cattaaaat

SEQ ID NO: 182687 - DNA, 10 bp, Unknown
  misc_feature (1)..( 10): Result.005 file - promoters50/3433799
acttcataga

SEQ ID NO: 182688 - DNA, 7 bp, Unknown
  misc_feature (1)..( 7): Result.005 file - promoters50/3433854
gataaag

SEQ ID NO: 182689 - DNA, 7 bp, Unknown
  misc_feature (1)..( 7): Result.005 file - promoters50/3433854
gataaac

SEQ ID NO: 182690 - DNA, 7 bp, Unknown
  misc_feature (1)..( 7): Result.005 file - promoters50/3433854
cataaac

SEQ ID NO: 182691 - DNA, 8 bp, Unknown
  misc_feature (1)..( 8): Result.005 file - promoters50/3433854
tgacaaaa

SEQ ID NO: 182692 - DNA, 8 bp, Unknown
  misc_feature (1)..( 8): Result.005 file - promoters50/3433854
tgacgaaa

SEQ ID NO: 182693 - DNA, 8 bp, Unknown
  misc_feature (1)..( 8): Result.005 file - promoters50/3433854
tgacaatg

SEQ ID NO: 182694 - DNA, 7 bp, Unknown
  misc_feature (1)..( 7): Result.005 file - promoters50/3433854
attttat

SEQ ID NO: 182695 - DNA, 7 bp, Unknown
  misc_feature (1)..( 7): Result.005 file - promoters50/3433854
attttaa

SEQ ID NO: 182696 - DNA, 7 bp, Unknown
  misc_feature (1)..( 7): Result.005 file - promoters50/3433854
attttat

SEQ ID NO: 182697 - DNA, 10 bp, Unknown
  misc_feature (1)..( 10): Result.005 file - promoters50/3433904
catataaatg

SEQ ID NO: 182698 - DNA, 10 bp, Unknown
  misc_feature (1)..( 10): Result.005 file - promoters50/3433904
tttatgaatc

SEQ ID NO: 182699 - DNA, 10 bp, Unknown
  misc_feature (1)..( 10): Result.005 file - promoters50/3433904
tttataaaac

SEQ ID NO: 182700 - DNA, 10 bp, Unknown
  misc_feature (1)..( 10): Result.005 file - promoters50/3433904
actataaatt

SEQ ID NO: 182701 - DNA, 10 bp, Unknown
  misc_feature (1)..( 10): Result.005 file - promoters50/3433904
agggtaaatt

SEQ ID NO: 182702 - DNA, 10 bp, Unknown
  misc_feature (1)..( 10): Result.005 file - promoters50/3433904
agggtaaata

SEQ ID NO: 182703 - DNA, 9 bp, Unknown
  misc_feature (1)..( 9): Result.005 file - promoters50/3433926
gaagaaaca

SEQ ID NO: 182704 - DNA, 9 bp, Unknown
  misc_feature (1)..( 9): Result.005 file - promoters50/3433926
caagagaca

SEQ ID NO: 182705 - DNA, 9 bp, Unknown
  misc_feature (1)..( 9): Result.005 file - promoters50/3433926
gaacaaaac

SEQ ID NO: 182706 - DNA, 9 bp, Unknown
  misc_feature (1)..( 9): Result.005 file - promoters50/3433926
gaaaaaaag

SEQ ID NO: 182707 - DNA, 9 bp, Unknown
  misc_feature (1)..( 9): Result.005 file - promoters50/3433926
aaacaaatc

SEQ ID NO: 182708 - DNA, 9 bp, Unknown
  misc_feature (1)..( 9): Result.005 file - promoters50/3433926
aaataaata

SEQ ID NO: 182709 - DNA, 10 bp, Unknown
  misc_feature (1)..( 10): Result.005 file - promoters50/3433933
atgtttcttg

SEQ ID NO: 182710 - DNA, 10 bp, Unknown
  misc_feature (1)..( 10): Result.005 file - promoters50/3433933
atgttgcttg

SEQ ID NO: 182711 - DNA, 10 bp, Unknown
  misc_feature (1)..( 10): Result.005 file - promoters50/3433933
atgtttggtc

SEQ ID NO: 182712 - DNA, 11 bp, Unknown
  misc_feature (1)..( 11): Result.005 file - promoters50/3433944
aaatatgaatc

SEQ ID NO: 182713 - DNA, 11 bp, Unknown
  misc_feature (1)..( 11): Result.005 file - promoters50/3433944
tattatcaatg

SEQ ID NO: 182714 - DNA, 11 bp, Unknown
  misc_feature (1)..( 11): Result.005 file - promoters50/3433944
aaaaatgatga

SEQ ID NO: 182715 - DNA, 11 bp, Unknown
  misc_feature (1)..( 11): Result.005 file - promoters50/3433944
aaatctgaaaa

SEQ ID NO: 182716 - DNA, 11 bp, Unknown
  misc_feature (1)..( 11): Result.005 file - promoters50/3433944
caatttgaatg

SEQ ID NO: 182717 - DNA, 11 bp, Unknown
  misc_feature (1)..( 11): Result.005 file - promoters50/3433944
aaaattcaatg

SEQ ID NO: 182718 - DNA, 11 bp, Unknown
  misc_feature (1)..( 11): Result.005 file - promoters50/3433944
gaatatcaaag

SEQ ID NO: 182719 - DNA, 11 bp, Unknown
  misc_feature (1)..( 11): Result.005 file - promoters50/3433944
aacgatattaa

SEQ ID NO: 182720 - DNA, 11 bp, Unknown
  misc_feature (1)..( 11): Result.005 file - promoters50/3433944
tgtaataataa

SEQ ID NO: 182721 - DNA, 11 bp, Unknown
  misc_feature (1)..( 11): Result.005 file - promoters50/3433944
acagatattac

SEQ ID NO: 182722 - DNA, 11 bp, Unknown
  misc_feature (1)..( 11): Result.005 file - promoters50/3433944
tacgaaattgt

SEQ ID NO: 182723 - DNA, 11 bp, Unknown
  misc_feature (1)..( 11): Result.005 file - promoters50/3433944
taagacatttt

SEQ ID NO: 182724 - DNA, 11 bp, Unknown
  misc_feature (1)..( 11): Result.005 file - promoters50/3433944
taaaaaagtgt

SEQ ID NO: 182725 - DNA, 11 bp, Unknown
  misc_feature (1)..( 11): Result.005 file - promoters50/3433944
taccaaactga

SEQ ID NO: 182726 - DNA, 11 bp, Unknown
  misc_feature (1)..( 11): Result.005 file - promoters50/3433944
cgaaaaaaaag

SEQ ID NO: 182727 - DNA, 11 bp, Unknown
  misc_feature (1)..( 11): Result.005 file - promoters50/3433944
agaaagaaaat

SEQ ID NO: 182728 - DNA, 11 bp, Unknown
  misc_feature (1)..( 11): Result.005 file - promoters50/3433944
acaaaaaagat

SEQ ID NO: 182729 - DNA, 11 bp, Unknown
  misc_feature (1)..( 11): Result.005 file - promoters50/3433944
tcaaaaatact

SEQ ID NO: 182730 - DNA, 11 bp, Unknown
  misc_feature (1)..( 11): Result.005 file - promoters50/3433944
tcaaaagtgat

SEQ ID NO: 182731 - DNA, 11 bp, Unknown
  misc_feature (1)..( 11): Result.005 file - promoters50/3433944
tgaacgaagag

SEQ ID NO: 182732 - DNA, 11 bp, Unknown
  misc_feature (1)..( 11): Result.005 file - promoters50/3433944
agcaagagaga

SEQ ID NO: 182733 - DNA, 12 bp, Unknown
  misc_feature (1)..( 12): Result.005 file - promoters50/3433944
ataaaagtttta

SEQ ID NO: 182734 - DNA, 12 bp, Unknown
  misc_feature (1)..( 12): Result.005 file - promoters50/3433944
ttcaaatttttc

SEQ ID NO: 182735 - DNA, 12 bp, Unknown
  misc_feature (1)..( 12): Result.005 file - promoters50/3433944
tcaaaatttcac

SEQ ID NO: 182736 - DNA, 12 bp, Unknown
  misc_feature (1)..( 12): Result.005 file - promoters50/3433944
aaaaaagtacat

SEQ ID NO: 182737 - DNA, 12 bp, Unknown
  misc_feature (1)..( 12): Result.005 file - promoters50/3433944
ttcatattactt

SEQ ID NO: 182738 - DNA, 12 bp, Unknown
  misc_feature (1)..( 12): Result.005 file - promoters50/3433944
ctaaaaatacat

SEQ ID NO: 182739 - DNA, 9 bp, Unknown
  misc_feature (1)..( 9): Result.005 file - promoters50/3433958
agaaacact

SEQ ID NO: 182740 - DNA, 9 bp, Unknown
  misc_feature (1)..( 9): Result.005 file - promoters50/3433958
agaaacact

SEQ ID NO: 182741 - DNA, 9 bp, Unknown
  misc_feature (1)..( 9): Result.005 file - promoters50/3433958
taaaaaact

SEQ ID NO: 182742 - DNA, 9 bp, Unknown
  misc_feature (1)..( 9): Result.005 file - promoters50/3433978
ctaacttac

SEQ ID NO: 182743 - DNA, 9 bp, Unknown
  misc_feature (1)..( 9): Result.005 file - promoters50/3433978
agaacttaa

SEQ ID NO: 182744 - DNA, 9 bp, Unknown
  misc_feature (1)..( 9): Result.005 file - promoters50/3433978
gtaatttat

SEQ ID NO: 182745 - DNA, 9 bp, Unknown
  misc_feature (1)..( 9): Result.005 file - promoters50/3433978
taaacatac

SEQ ID NO: 182746 - DNA, 9 bp, Unknown
  misc_feature (1)..( 9): Result.005 file - promoters50/3433978
agaaattaa

SEQ ID NO: 182747 - DNA, 9 bp, Unknown
  misc_feature (1)..( 9): Result.005 file - promoters50/3433978
tgaaaaaaa

SEQ ID NO: 182748 - DNA, 9 bp, Unknown
  misc_feature (1)..( 9): Result.005 file - promoters50/3433978
ttgattaaa

SEQ ID NO: 182749 - DNA, 15 bp, Unknown
  misc_feature (1)..( 15): Result.005 file - promoters50/3433978
ttcacaaactttcat

SEQ ID NO: 182750 - DNA, 15 bp, Unknown
  misc_feature (1)..( 15): Result.005 file - promoters50/3433978
gacataaatttttta

SEQ ID NO: 182751 - DNA, 15 bp, Unknown
  misc_feature (1)..( 15): Result.005 file - promoters50/3433978
atagttaactttgaa

SEQ ID NO: 182752 - DNA, 15 bp, Unknown
  misc_feature (1)..( 15): Result.005 file - promoters50/3433978
gacagaaactttttt

SEQ ID NO: 182753 - DNA, 15 bp, Unknown
  misc_feature (1)..( 15): Result.005 file - promoters50/3433978
ttatttaacttacat

SEQ ID NO: 182754 - DNA, 15 bp, Unknown
  misc_feature (1)..( 15): Result.005 file - promoters50/3433978
gacatcaattttgct

SEQ ID NO: 182755 - DNA, 9 bp, Unknown
  misc_feature (1)..( 9): Result.005 file - promoters50/3433978
aaaatttgt

SEQ ID NO: 182756 - DNA, 9 bp, Unknown
  misc_feature (1)..( 9): Result.005 file - promoters50/3433978
caaattttt

SEQ ID NO: 182757 - DNA, 10 bp, Unknown
  misc_feature (1)..( 10): Result.005 file - promoters50/3433978
tttattatta

SEQ ID NO: 182758 - DNA, 10 bp, Unknown
  misc_feature (1)..( 10): Result.005 file - promoters50/3433978
tagcttatta

SEQ ID NO: 182759 - DNA, 10 bp, Unknown
  misc_feature (1)..( 10): Result.005 file - promoters50/3433978
tgtatcattc

SEQ ID NO: 182760 - DNA, 10 bp, Unknown
  misc_feature (1)..( 10): Result.005 file - promoters50/3433978
ccaattttta

SEQ ID NO: 182761 - DNA, 10 bp, Unknown
  misc_feature (1)..( 10): Result.005 file - promoters50/3433978
taaataaagt

SEQ ID NO: 182762 - DNA, 10 bp, Unknown
  misc_feature (1)..( 10): Result.005 file - promoters50/3433978
ccaatagagt

SEQ ID NO: 182763 - DNA, 10 bp, Unknown
  misc_feature (1)..( 10): Result.005 file - promoters50/3433978
aaaataaaaa

SEQ ID NO: 182764 - DNA, 10 bp, Unknown
  misc_feature (1)..( 10): Result.005 file - promoters50/3433978
taaataatta

SEQ ID NO: 182765 - DNA, 11 bp, Unknown
  misc_feature (1)..( 11): Result.005 file - promoters50/3433978
ccaatgaaacc

SEQ ID NO: 182766 - DNA, 11 bp, Unknown
  misc_feature (1)..( 11): Result.005 file - promoters50/3433978
aacataaaacg

SEQ ID NO: 182767 - DNA, 8 bp, Unknown
  misc_feature (1)..( 8): Result.005 file - promoters50/3433989
gagatgag

SEQ ID NO: 182768 - DNA, 8 bp, Unknown
  misc_feature (1)..( 8): Result.005 file - promoters50/3433989
aagacgag

SEQ ID NO: 182769 - DNA, 8 bp, Unknown
  misc_feature (1)..( 8): Result.005 file - promoters50/3433989
gagatggt

SEQ ID NO: 182770 - DNA, 9 bp, Unknown
  misc_feature (1)..( 9): Result.005 file - promoters50/3433989
gtggagatg

SEQ ID NO: 182771 - DNA, 9 bp, Unknown
  misc_feature (1)..( 9): Result.005 file - promoters50/3433989
gtgaagatc

SEQ ID NO: 182772 - DNA, 9 bp, Unknown
  misc_feature (1)..( 9): Result.005 file - promoters50/3433989
tcagagatg

SEQ ID NO: 182773 - DNA, 9 bp, Unknown
  misc_feature (1)..( 9): Result.005 file - promoters50/3433989
ttgaagagt

SEQ ID NO: 182774 - DNA, 9 bp, Unknown
  misc_feature (1)..( 9): Result.005 file - promoters50/3433989
tcgagattg

SEQ ID NO: 182775 - DNA, 9 bp, Unknown
  misc_feature (1)..( 9): Result.005 file - promoters50/3433989
acgagtttg

SEQ ID NO: 182776 - DNA, 9 bp, Unknown
  misc_feature (1)..( 9): Result.005 file - promoters50/3433989
acgagtgaa

SEQ ID NO: 182777 - DNA, 15 bp, Unknown
  misc_feature (1)..( 15): Result.005 file - promoters50/3433998
tccatctctctctct

SEQ ID NO: 182778 - DNA, 15 bp, Unknown
  misc_feature (1)..( 15): Result.005 file - promoters50/3433998
tacatatcttgattc

SEQ ID NO: 182779 - DNA, 15 bp, Unknown
  misc_feature (1)..( 15): Result.005 file - promoters50/3433998
aacatatctatggct

SEQ ID NO: 182780 - DNA, 15 bp, Unknown
  misc_feature (1)..( 15): Result.005 file - promoters50/3433998
tacacatccaatcaa

SEQ ID NO: 182781 - DNA, 15 bp, Unknown
  misc_feature (1)..( 15): Result.005 file - promoters50/3433998
cgattataaacacta

SEQ ID NO: 182782 - DNA, 15 bp, Unknown
  misc_feature (1)..( 15): Result.005 file - promoters50/3433998
ttcaaataaaccatt

SEQ ID NO: 182783 - DNA, 15 bp, Unknown
  misc_feature (1)..( 15): Result.005 file - promoters50/3433998
accttatcaaaaaaa

SEQ ID NO: 182784 - DNA, 14 bp, Unknown
  misc_feature (1)..( 14): Result.005 file - promoters50/3433998
atcgaaacaaaaaa

SEQ ID NO: 182785 - DNA, 14 bp, Unknown
  misc_feature (1)..( 14): Result.005 file - promoters50/3433998
atccaaacatgcct

SEQ ID NO: 182786 - DNA, 14 bp, Unknown
  misc_feature (1)..( 14): Result.005 file - promoters50/3433998
ttataaataaaaga

SEQ ID NO: 182787 - DNA, 14 bp, Unknown
  misc_feature (1)..( 14): Result.005 file - promoters50/3433998
aaaaaaagaaaaaa

SEQ ID NO: 182788 - DNA, 14 bp, Unknown
  misc_feature (1)..( 14): Result.005 file - promoters50/3433998
ctgatcataaaaag

SEQ ID NO: 182789 - DNA, 14 bp, Unknown
  misc_feature (1)..( 14): Result.005 file - promoters50/3433998
cgttgaagaaaaag

SEQ ID NO: 182790 - DNA, 12 bp, Unknown
  misc_feature (1)..( 12): Result.005 file - promoters50/3433998
agagaaaaaaac

SEQ ID NO: 182791 - DNA, 12 bp, Unknown
  misc_feature (1)..( 12): Result.005 file - promoters50/3433998
ttttaaaaaaaa

SEQ ID NO: 182792 - DNA, 12 bp, Unknown
  misc_feature (1)..( 12): Result.005 file - promoters50/3433998
atgaagaaaaat

SEQ ID NO: 182793 - DNA, 12 bp, Unknown
  misc_feature (1)..( 12): Result.005 file - promoters50/3433998
tagtaaaaaaat

SEQ ID NO: 182794 - DNA, 12 bp, Unknown
  misc_feature (1)..( 12): Result.005 file - promoters50/3433998
gattataaacac

SEQ ID NO: 182795 - DNA, 12 bp, Unknown
  misc_feature (1)..( 12): Result.005 file - promoters50/3433998
gattctaatttc

SEQ ID NO: 182796 - DNA, 12 bp, Unknown
  misc_feature (1)..( 12): Result.005 file - promoters50/3433998
aattatatacac

SEQ ID NO: 182797 - DNA, 14 bp, Unknown
  misc_feature (1)..( 14): Result.005 file - promoters50/3433998
aaacaaaaaataat

SEQ ID NO: 182798 - DNA, 14 bp, Unknown
  misc_feature (1)..( 14): Result.005 file - promoters50/3433998
aagaaaaaaaaatc

SEQ ID NO: 182799 - DNA, 14 bp, Unknown
  misc_feature (1)..( 14): Result.005 file - promoters50/3433998
aaagaaaaaacttt

SEQ ID NO: 182800 - DNA, 14 bp, Unknown
  misc_feature (1)..( 14): Result.005 file - promoters50/3433998
taataaaaacatgt

SEQ ID NO: 182801 - DNA, 14 bp, Unknown
  misc_feature (1)..( 14): Result.005 file - promoters50/3433998
tcataaaaagtctt

SEQ ID NO: 182802 - DNA, 14 bp, Unknown
  misc_feature (1)..( 14): Result.005 file - promoters50/3433998
tagtaaaaaaatct

SEQ ID NO: 182803 - DNA, 11 bp, Unknown
  misc_feature (1)..( 11): Result.005 file - promoters50/3433998
atgtttaaaat

SEQ ID NO: 182804 - DNA, 11 bp, Unknown
  misc_feature (1)..( 11): Result.005 file - promoters50/3433998
gattttaaaaa

SEQ ID NO: 182805 - DNA, 11 bp, Unknown
  misc_feature (1)..( 11): Result.005 file - promoters50/3433998
gcttttaaaga

SEQ ID NO: 182806 - DNA, 11 bp, Unknown
  misc_feature (1)..( 11): Result.005 file - promoters50/3433998
caaattaaaat

SEQ ID NO: 182807 - DNA, 11 bp, Unknown
  misc_feature (1)..( 11): Result.005 file - promoters50/3433998
gattctaattt

SEQ ID NO: 182808 - DNA, 12 bp, Unknown
  misc_feature (1)..( 12): Result.005 file - promoters50/3433998
atttttataaat

SEQ ID NO: 182809 - DNA, 12 bp, Unknown
  misc_feature (1)..( 12): Result.005 file - promoters50/3433998
ttcattcaaata

SEQ ID NO: 182810 - DNA, 12 bp, Unknown
  misc_feature (1)..( 12): Result.005 file - promoters50/3433998
ttcttatctcaa

SEQ ID NO: 182811 - DNA, 12 bp, Unknown
  misc_feature (1)..( 12): Result.005 file - promoters50/3433998
tgcttctctatg

SEQ ID NO: 182812 - DNA, 12 bp, Unknown
  misc_feature (1)..( 12): Result.005 file - promoters50/3433998
atcttatgattc

SEQ ID NO: 182813 - DNA, 12 bp, Unknown
  misc_feature (1)..( 12): Result.005 file - promoters50/3433998
aagttccctaac

SEQ ID NO: 182814 - DNA, 12 bp, Unknown
  misc_feature (1)..( 12): Result.005 file - promoters50/3433998
agcttaggattc

SEQ ID NO: 182815 - DNA, 12 bp, Unknown
  misc_feature (1)..( 12): Result.005 file - promoters50/3433998
atcttaatttca

SEQ ID NO: 182816 - DNA, 11 bp, Unknown
  misc_feature (1)..( 11): Result.005 file - promoters50/3433998
gattccaatct

SEQ ID NO: 182817 - DNA, 11 bp, Unknown
  misc_feature (1)..( 11): Result.005 file - promoters50/3433998
gattctaattt

SEQ ID NO: 182818 - DNA, 11 bp, Unknown
  misc_feature (1)..( 11): Result.005 file - promoters50/3433998
acatccaatca

SEQ ID NO: 182819 - DNA, 11 bp, Unknown
  misc_feature (1)..( 11): Result.005 file - promoters50/3433998
cattcaaataa

SEQ ID NO: 182820 - DNA, 11 bp, Unknown
  misc_feature (1)..( 11): Result.005 file - promoters50/3433998
gattttaaaaa

SEQ ID NO: 182821 - DNA, 11 bp, Unknown
  misc_feature (1)..( 11): Result.005 file - promoters50/3433998
atttttataaa

SEQ ID NO: 182822 - DNA, 11 bp, Unknown
  misc_feature (1)..( 11): Result.005 file - promoters50/3433998
gattataaaca

SEQ ID NO: 182823 - DNA, 10 bp, Unknown
  misc_feature (1)..( 10): Result.005 file - promoters50/3434028
gtaaatcatt

SEQ ID NO: 182824 - DNA, 10 bp, Unknown
  misc_feature (1)..( 10): Result.005 file - promoters50/3434028
tgaaatcaaa

SEQ ID NO: 182825 - DNA, 10 bp, Unknown
  misc_feature (1)..( 10): Result.005 file - promoters50/3434028
gtaattcaaa

SEQ ID NO: 182826 - DNA, 10 bp, Unknown
  misc_feature (1)..( 10): Result.005 file - promoters50/3434028
ttaaatcttg

SEQ ID NO: 182827 - DNA, 10 bp, Unknown
  misc_feature (1)..( 10): Result.005 file - promoters50/3434028
aaaaatccaa

SEQ ID NO: 182828 - DNA, 10 bp, Unknown
  misc_feature (1)..( 10): Result.005 file - promoters50/3434028
ttaaattaga

SEQ ID NO: 182829 - DNA, 10 bp, Unknown
  misc_feature (1)..( 10): Result.005 file - promoters50/3434028
acaaatctat

SEQ ID NO: 182830 - DNA, 11 bp, Unknown
  misc_feature (1)..( 11): Result.005 file - promoters50/3434028
acttttgtagt

SEQ ID NO: 182831 - DNA, 11 bp, Unknown
  misc_feature (1)..( 11): Result.005 file - promoters50/3434028
aattttgtttt

SEQ ID NO: 182832 - DNA, 11 bp, Unknown
  misc_feature (1)..( 11): Result.005 file - promoters50/3434028
tattttgtaaa

SEQ ID NO: 182833 - DNA, 11 bp, Unknown
  misc_feature (1)..( 11): Result.005 file - promoters50/3434028
aattatgttat

SEQ ID NO: 182834 - DNA, 11 bp, Unknown
  misc_feature (1)..( 11): Result.005 file - promoters50/3434028
cctttagtttt

SEQ ID NO: 182835 - DNA, 11 bp, Unknown
  misc_feature (1)..( 11): Result.005 file - promoters50/3434028
tatctagttta

SEQ ID NO: 182836 - DNA, 9 bp, Unknown
  misc_feature (1)..( 9): Result.005 file - promoters50/3434028
tgtaaatca

SEQ ID NO: 182837 - DNA, 9 bp, Unknown
  misc_feature (1)..( 9): Result.005 file - promoters50/3434028
tgtaaatta

SEQ ID NO: 182838 - DNA, 9 bp, Unknown
  misc_feature (1)..( 9): Result.005 file - promoters50/3434028
cttaaatct

SEQ ID NO: 182839 - DNA, 9 bp, Unknown
  misc_feature (1)..( 9): Result.005 file - promoters50/3434028
gctaaatta

SEQ ID NO: 182840 - DNA, 9 bp, Unknown
  misc_feature (1)..( 9): Result.005 file - promoters50/3434028
tttaaatta

SEQ ID NO: 182841 - DNA, 9 bp, Unknown
  misc_feature (1)..( 9): Result.005 file - promoters50/3434028
tacaaatct

SEQ ID NO: 182842 - DNA, 9 bp, Unknown
  misc_feature (1)..( 9): Result.005 file - promoters50/3434028
atttgaaat

SEQ ID NO: 182843 - DNA, 9 bp, Unknown
  misc_feature (1)..( 9): Result.005 file - promoters50/3434028
atttgatca

SEQ ID NO: 182844 - DNA, 9 bp, Unknown
  misc_feature (1)..( 9): Result.005 file - promoters50/3434028
ttttcaaaa

SEQ ID NO: 182845 - DNA, 9 bp, Unknown
  misc_feature (1)..( 9): Result.005 file - promoters50/3434028
gtttgttca

SEQ ID NO: 182846 - DNA, 9 bp, Unknown
  misc_feature (1)..( 9): Result.005 file - promoters50/3434028
aattcaaat

SEQ ID NO: 182847 - DNA, 9 bp, Unknown
  misc_feature (1)..( 9): Result.005 file - promoters50/3434028
ttttcaatt

SEQ ID NO: 182848 - DNA, 14 bp, Unknown
  misc_feature (1)..( 14): Result.005 file - promoters50/3434044
gaaaaaaaaacttg

SEQ ID NO: 182849 - DNA, 14 bp, Unknown
  misc_feature (1)..( 14): Result.005 file - promoters50/3434044
gaagaaaaaaattg

SEQ ID NO: 182850 - DNA, 14 bp, Unknown
  misc_feature (1)..( 14): Result.005 file - promoters50/3434044
aaaaaaaaaatcat

SEQ ID NO: 182851 - DNA, 15 bp, Unknown
  misc_feature (1)..( 15): Result.005 file - promoters50/3434044
tttaaccaaaacttc

SEQ ID NO: 182852 - DNA, 14 bp, Unknown
  misc_feature (1)..( 14): Result.005 file - promoters50/3434044
aaaacaaaaagaag

SEQ ID NO: 182853 - DNA, 15 bp, Unknown
  misc_feature (1)..( 15): Result.005 file - promoters50/3434044
aaagaaataaatatt

SEQ ID NO: 182854 - DNA, 15 bp, Unknown
  misc_feature (1)..( 15): Result.005 file - promoters50/3434044
gaaaaaaaaagtttg

SEQ ID NO: 182855 - DNA, 14 bp, Unknown
  misc_feature (1)..( 14): Result.005 file - promoters50/3434044
ataagcccaataga

SEQ ID NO: 182856 - DNA, 14 bp, Unknown
  misc_feature (1)..( 14): Result.005 file - promoters50/3434044
tatttgccaagaga

SEQ ID NO: 182857 - DNA, 14 bp, Unknown
  misc_feature (1)..( 14): Result.005 file - promoters50/3434044
ctcagcccattaga

SEQ ID NO: 182858 - DNA, 14 bp, Unknown
  misc_feature (1)..( 14): Result.005 file - promoters50/3434044
ttaggcccgttaaa

SEQ ID NO: 182859 - DNA, 14 bp, Unknown
  misc_feature (1)..( 14): Result.005 file - promoters50/3434044
taaagcccaaaaat

SEQ ID NO: 182860 - DNA, 14 bp, Unknown
  misc_feature (1)..( 14): Result.005 file - promoters50/3434044
taaaaccctaatat

SEQ ID NO: 182861 - DNA, 10 bp, Unknown
  misc_feature (1)..( 10): Result.005 file - promoters50/3434105
tttttgaaaa

SEQ ID NO: 182862 - DNA, 10 bp, Unknown
  misc_feature (1)..( 10): Result.005 file - promoters50/3434105
gtttcgaaat

SEQ ID NO: 182863 - DNA, 10 bp, Unknown
  misc_feature (1)..( 10): Result.005 file - promoters50/3434105
gtttcgaaga

SEQ ID NO: 182864 - DNA, 10 bp, Unknown
  misc_feature (1)..( 10): Result.005 file - promoters50/3434105
ttttttaaaa

SEQ ID NO: 182865 - DNA, 11 bp, Unknown
  misc_feature (1)..( 11): Result.005 file - promoters50/3434105
gatatgacaat

SEQ ID NO: 182866 - DNA, 11 bp, Unknown
  misc_feature (1)..( 11): Result.005 file - promoters50/3434105
tttttgaattt

SEQ ID NO: 182867 - DNA, 11 bp, Unknown
  misc_feature (1)..( 11): Result.005 file - promoters50/3434105
atttcttatat

SEQ ID NO: 182868 - DNA, 14 bp, Unknown
  misc_feature (1)..( 14): Result.005 file - promoters50/3434105
ctcaatttttaccc

SEQ ID NO: 182869 - DNA, 14 bp, Unknown
  misc_feature (1)..( 14): Result.005 file - promoters50/3434105
gtcagttttcatgt

SEQ ID NO: 182870 - DNA, 14 bp, Unknown
  misc_feature (1)..( 14): Result.005 file - promoters50/3434105
tcttgttttcttaa

SEQ ID NO: 182871 - DNA, 14 bp, Unknown
  misc_feature (1)..( 14): Result.005 file - promoters50/3434105
cgttgttttgtgta

SEQ ID NO: 182872 - DNA, 14 bp, Unknown
  misc_feature (1)..( 14): Result.005 file - promoters50/3434105
acaaattttattaa

SEQ ID NO: 182873 - DNA, 14 bp, Unknown
  misc_feature (1)..( 14): Result.005 file - promoters50/3434105
tttaattgatcgct

SEQ ID NO: 182874 - DNA, 10 bp, Unknown
  misc_feature (1)..( 10): Result.005 file - promoters50/3434105
atgtatattt

SEQ ID NO: 182875 - DNA, 10 bp, Unknown
  misc_feature (1)..( 10): Result.005 file - promoters50/3434105
tgttatattg

SEQ ID NO: 182876 - DNA, 10 bp, Unknown
  misc_feature (1)..( 10): Result.005 file - promoters50/3434105
aagtaaattt

SEQ ID NO: 182877 - DNA, 10 bp, Unknown
  misc_feature (1)..( 10): Result.005 file - promoters50/3434105
ctttatatat

SEQ ID NO: 182878 - DNA, 10 bp, Unknown
  misc_feature (1)..( 10): Result.005 file - promoters50/3434105
aagaaaaatc

SEQ ID NO: 182879 - DNA, 10 bp, Unknown
  misc_feature (1)..( 10): Result.005 file - promoters50/3434105
tcttatatat

SEQ ID NO: 182880 - DNA, 10 bp, Unknown
  misc_feature (1)..( 10): Result.005 file - promoters50/3434105
ctatatatga

SEQ ID NO: 182881 - DNA, 10 bp, Unknown
  misc_feature (1)..( 10): Result.005 file - promoters50/3434105
ctatatatac

SEQ ID NO: 182882 - DNA, 10 bp, Unknown
  misc_feature (1)..( 10): Result.005 file - promoters50/3434105
atatataaag

SEQ ID NO: 182883 - DNA, 10 bp, Unknown
  misc_feature (1)..( 10): Result.005 file - promoters50/3434105
ctatataaag

SEQ ID NO: 182884 - DNA, 10 bp, Unknown
  misc_feature (1)..( 10): Result.005 file - promoters50/3434105
ctatataagc

SEQ ID NO: 182885 - DNA, 10 bp, Unknown
  misc_feature (1)..( 10): Result.005 file - promoters50/3434105
ctatatataa

SEQ ID NO: 182886 - DNA, 10 bp, Unknown
  misc_feature (1)..( 10): Result.005 file - promoters50/3434105
taataaaagg

SEQ ID NO: 182887 - DNA, 10 bp, Unknown
  misc_feature (1)..( 10): Result.005 file - promoters50/3434105
ctttccttag

SEQ ID NO: 182888 - DNA, 10 bp, Unknown
  misc_feature (1)..( 10): Result.005 file - promoters50/3434105
cgttccttaa

SEQ ID NO: 182889 - DNA, 10 bp, Unknown
  misc_feature (1)..( 10): Result.005 file - promoters50/3434105
gttttcttaa

SEQ ID NO: 182890 - DNA, 10 bp, Unknown
  misc_feature (1)..( 10): Result.005 file - promoters50/3434105
gttttcatgt

SEQ ID NO: 182891 - DNA, 10 bp, Unknown
  misc_feature (1)..( 10): Result.005 file - promoters50/3434105
attttattaa

SEQ ID NO: 182892 - DNA, 10 bp, Unknown
  misc_feature (1)..( 10): Result.005 file - promoters50/3434105
gtttaattga

SEQ ID NO: 182893 - DNA, 12 bp, Unknown
  misc_feature (1)..( 12): Result.005 file - promoters50/3434108
gttattttggat

SEQ ID NO: 182894 - DNA, 12 bp, Unknown
  misc_feature (1)..( 12): Result.005 file - promoters50/3434108
ccaattttgccg

SEQ ID NO: 182895 - DNA, 12 bp, Unknown
  misc_feature (1)..( 12): Result.005 file - promoters50/3434108
tttactttggaa

SEQ ID NO: 182896 - DNA, 12 bp, Unknown
  misc_feature (1)..( 12): Result.005 file - promoters50/3434108
tgaatattgaac

SEQ ID NO: 182897 - DNA, 12 bp, Unknown
  misc_feature (1)..( 12): Result.005 file - promoters50/3434108
taatgtttgctt

SEQ ID NO: 182898 - DNA, 12 bp, Unknown
  misc_feature (1)..( 12): Result.005 file - promoters50/3434108
tttactttaaaa

SEQ ID NO: 182899 - DNA, 14 bp, Unknown
  misc_feature (1)..( 14): Result.005 file - promoters50/3434108
tttggatgaattta

SEQ ID NO: 182900 - DNA, 14 bp, Unknown
  misc_feature (1)..( 14): Result.005 file - promoters50/3434108
ccttgattaatttc

SEQ ID NO: 182901 - DNA, 14 bp, Unknown
  misc_feature (1)..( 14): Result.005 file - promoters50/3434108
tttggattaatgtc

SEQ ID NO: 182902 - DNA, 14 bp, Unknown
  misc_feature (1)..( 14): Result.005 file - promoters50/3434108
tcgatttcaattta

SEQ ID NO: 182903 - DNA, 14 bp, Unknown
  misc_feature (1)..( 14): Result.005 file - promoters50/3434108
atgctcataattta

SEQ ID NO: 182904 - DNA, 14 bp, Unknown
  misc_feature (1)..( 14): Result.005 file - promoters50/3434108
tctgtaataattta

SEQ ID NO: 182905 - DNA, 20 bp, Unknown
  misc_feature (1)..( 20): Result.005 file - promoters50/3434108
atttaaattttttgttgtta

SEQ ID NO: 182906 - DNA, 20 bp, Unknown
  misc_feature (1)..( 20): Result.005 file - promoters50/3434108
aaataaattgaatgtgtttt

SEQ ID NO: 182907 - DNA, 20 bp, Unknown
  misc_feature (1)..( 20): Result.005 file - promoters50/3434108
acttaaatttacgctcactt

SEQ ID NO: 182908 - DNA, 20 bp, Unknown
  misc_feature (1)..( 20): Result.005 file - promoters50/3434108
aaaaaaattgtaatcctttt

SEQ ID NO: 182909 - DNA, 20 bp, Unknown
  misc_feature (1)..( 20): Result.005 file - promoters50/3434108
tcccaaattgaatcgaattt

SEQ ID NO: 182910 - DNA, 20 bp, Unknown
  misc_feature (1)..( 20): Result.005 file - promoters50/3434108
actttaattgaaccgacttt

SEQ ID NO: 182911 - DNA, 12 bp, Unknown
  misc_feature (1)..( 12): Result.005 file - promoters50/3434108
tcaaaataaaaa

SEQ ID NO: 182912 - DNA, 12 bp, Unknown
  misc_feature (1)..( 12): Result.005 file - promoters50/3434108
acaacatacaaa

SEQ ID NO: 182913 - DNA, 12 bp, Unknown
  misc_feature (1)..( 12): Result.005 file - promoters50/3434108
atcaaataattc

SEQ ID NO: 182914 - DNA, 12 bp, Unknown
  misc_feature (1)..( 12): Result.005 file - promoters50/3434108
tcaaaaatttgt

SEQ ID NO: 182915 - DNA, 12 bp, Unknown
  misc_feature (1)..( 12): Result.005 file - promoters50/3434108
acaaaacaattc

SEQ ID NO: 182916 - DNA, 12 bp, Unknown
  misc_feature (1)..( 12): Result.005 file - promoters50/3434108
ccaaaagaatca

SEQ ID NO: 182917 - DNA, 14 bp, Unknown
  misc_feature (1)..( 14): Result.005 file - promoters50/3434108
ttaaaaaatcaaaa

SEQ ID NO: 182918 - DNA, 14 bp, Unknown
  misc_feature (1)..( 14): Result.005 file - promoters50/3434108
atttgaaatcaaat

SEQ ID NO: 182919 - DNA, 14 bp, Unknown
  misc_feature (1)..( 14): Result.005 file - promoters50/3434108
ttaacaaaacaatt

SEQ ID NO: 182920 - DNA, 14 bp, Unknown
  misc_feature (1)..( 14): Result.005 file - promoters50/3434108
ttaatgtttcaaaa

SEQ ID NO: 182921 - DNA, 14 bp, Unknown
  misc_feature (1)..( 14): Result.005 file - promoters50/3434108
tgtggttatcaaat

SEQ ID NO: 182922 - DNA, 14 bp, Unknown
  misc_feature (1)..( 14): Result.005 file - promoters50/3434108
caaaagaatcagtg

SEQ ID NO: 182923 - DNA, 9 bp, Unknown
  misc_feature (1)..( 9): Result.005 file - promoters50/3434108
tgaatttat

SEQ ID NO: 182924 - DNA, 9 bp, Unknown
  misc_feature (1)..( 9): Result.005 file - promoters50/3434108
aagatttat

SEQ ID NO: 182925 - DNA, 9 bp, Unknown
  misc_feature (1)..( 9): Result.005 file - promoters50/3434108
tcaatttaa

SEQ ID NO: 182926 - DNA, 9 bp, Unknown
  misc_feature (1)..( 9): Result.005 file - promoters50/3434108
ccaattttg

SEQ ID NO: 182927 - DNA, 9 bp, Unknown
  misc_feature (1)..( 9): Result.005 file - promoters50/3434108
ataatttag

SEQ ID NO: 182928 - DNA, 9 bp, Unknown
  misc_feature (1)..( 9): Result.005 file - promoters50/3434108
ataatttac

SEQ ID NO: 182929 - DNA, 10 bp, Unknown
  misc_feature (1)..( 10): Result.005 file - promoters50/3434108
aatttatttt

SEQ ID NO: 182930 - DNA, 10 bp, Unknown
  misc_feature (1)..( 10): Result.005 file - promoters50/3434108
aatttagtct

SEQ ID NO: 182931 - DNA, 10 bp, Unknown
  misc_feature (1)..( 10): Result.005 file - promoters50/3434108
aatttacttt

SEQ ID NO: 182932 - DNA, 10 bp, Unknown
  misc_feature (1)..( 10): Result.005 file - promoters50/3434108
aatttaatca

SEQ ID NO: 182933 - DNA, 10 bp, Unknown
  misc_feature (1)..( 10): Result.005 file - promoters50/3434108
tgtttgcttc

SEQ ID NO: 182934 - DNA, 10 bp, Unknown
  misc_feature (1)..( 10): Result.005 file - promoters50/3434108
tttttacttt

SEQ ID NO: 182935 - DNA, 10 bp, Unknown
  misc_feature (1)..( 10): Result.005 file - promoters50/3434120
caaaaaccaa

SEQ ID NO: 182936 - DNA, 10 bp, Unknown
  misc_feature (1)..( 10): Result.005 file - promoters50/3434120
gaaaaacttt

SEQ ID NO: 182937 - DNA, 10 bp, Unknown
  misc_feature (1)..( 10): Result.005 file - promoters50/3434120
taaaatcttt

SEQ ID NO: 182938 - DNA, 10 bp, Unknown
  misc_feature (1)..( 10): Result.005 file - promoters50/3434120
taaaatatct

SEQ ID NO: 182939 - DNA, 10 bp, Unknown
  misc_feature (1)..( 10): Result.005 file - promoters50/3434120
caaaatcaca

SEQ ID NO: 182940 - DNA, 10 bp, Unknown
  misc_feature (1)..( 10): Result.005 file - promoters50/3434145
aaatttaatt

SEQ ID NO: 182941 - DNA, 10 bp, Unknown
  misc_feature (1)..( 10): Result.005 file - promoters50/3434145
aaagttaatt

SEQ ID NO: 182942 - DNA, 10 bp, Unknown
  misc_feature (1)..( 10): Result.005 file - promoters50/3434145
caatctaact

SEQ ID NO: 182943 - DNA, 10 bp, Unknown
  misc_feature (1)..( 10): Result.005 file - promoters50/3434145
gaatataatt

SEQ ID NO: 182944 - DNA, 10 bp, Unknown
  misc_feature (1)..( 10): Result.005 file - promoters50/3434145
gaatctaata

SEQ ID NO: 182945 - DNA, 12 bp, Unknown
  misc_feature (1)..( 12): Result.005 file - promoters50/3434145
tttttatttatt

SEQ ID NO: 182946 - DNA, 12 bp, Unknown
  misc_feature (1)..( 12): Result.005 file - promoters50/3434145
aacttatttaaa

SEQ ID NO: 182947 - DNA, 12 bp, Unknown
  misc_feature (1)..( 12): Result.005 file - promoters50/3434145
actttatttttg

SEQ ID NO: 182948 - DNA, 12 bp, Unknown
  misc_feature (1)..( 12): Result.005 file - promoters50/3434145
taagaattaaaa

SEQ ID NO: 182949 - DNA, 12 bp, Unknown
  misc_feature (1)..( 12): Result.005 file - promoters50/3434145
aacatattcttg

SEQ ID NO: 182950 - DNA, 7 bp, Unknown
  misc_feature (1)..( 7): Result.005 file - promoters50/3434147
attatgt

SEQ ID NO: 182951 - DNA, 7 bp, Unknown
  misc_feature (1)..( 7): Result.005 file - promoters50/3434147
tttatgt

SEQ ID NO: 182952 - DNA, 7 bp, Unknown
  misc_feature (1)..( 7): Result.005 file - promoters50/3434147
attatgt

SEQ ID NO: 182953 - DNA, 11 bp, Unknown
  misc_feature (1)..( 11): Result.005 file - promoters50/3434147
acattaatatt

SEQ ID NO: 182954 - DNA, 11 bp, Unknown
  misc_feature (1)..( 11): Result.005 file - promoters50/3434147
aaattaaaatt

SEQ ID NO: 182955 - DNA, 11 bp, Unknown
  misc_feature (1)..( 11): Result.005 file - promoters50/3434147
acattaaaatc

SEQ ID NO: 182956 - DNA, 9 bp, Unknown
  misc_feature (1)..( 9): Result.005 file - promoters50/3434147
ttccataaa

SEQ ID NO: 182957 - DNA, 9 bp, Unknown
  misc_feature (1)..( 9): Result.005 file - promoters50/3434147
ttcaatatt

SEQ ID NO: 182958 - DNA, 9 bp, Unknown
  misc_feature (1)..( 9): Result.005 file - promoters50/3434147
caccaaaaa

SEQ ID NO: 182959 - DNA, 8 bp, Unknown
  misc_feature (1)..( 8): Result.005 file - promoters50/3434147
attttaca

SEQ ID NO: 182960 - DNA, 8 bp, Unknown
  misc_feature (1)..( 8): Result.005 file - promoters50/3434147
atttcaca

SEQ ID NO: 182961 - DNA, 8 bp, Unknown
  misc_feature (1)..( 8): Result.005 file - promoters50/3434147
atttcaca

SEQ ID NO: 182962 - DNA, 9 bp, Unknown
  misc_feature (1)..( 9): Result.005 file - promoters50/3434147
cccaatgtc

SEQ ID NO: 182963 - DNA, 9 bp, Unknown
  misc_feature (1)..( 9): Result.005 file - promoters50/3434147
cccaataga

SEQ ID NO: 182964 - DNA, 9 bp, Unknown
  misc_feature (1)..( 9): Result.005 file - promoters50/3434147
accaaagtc

SEQ ID NO: 182965 - DNA, 7 bp, Unknown
  misc_feature (1)..( 7): Result.005 file - promoters50/3434231
tgtgtgt

SEQ ID NO: 182966 - DNA, 7 bp, Unknown
  misc_feature (1)..( 7): Result.005 file - promoters50/3434231
tgtctgt

SEQ ID NO: 182967 - DNA, 7 bp, Unknown
  misc_feature (1)..( 7): Result.005 file - promoters50/3434231
tctatgc

SEQ ID NO: 182968 - DNA, 12 bp, Unknown
  misc_feature (1)..( 12): Result.005 file - promoters50/3434233
taagctcaaagc

SEQ ID NO: 182969 - DNA, 12 bp, Unknown
  misc_feature (1)..( 12): Result.005 file - promoters50/3434233
aaagcccaacac

SEQ ID NO: 182970 - DNA, 12 bp, Unknown
  misc_feature (1)..( 12): Result.005 file - promoters50/3434233
ccttctcagagc

SEQ ID NO: 182971 - DNA, 12 bp, Unknown
  misc_feature (1)..( 12): Result.005 file - promoters50/3434233
aaagccattatt

SEQ ID NO: 182972 - DNA, 12 bp, Unknown
  misc_feature (1)..( 12): Result.005 file - promoters50/3434233
atagttcacagc

SEQ ID NO: 182973 - DNA, 12 bp, Unknown
  misc_feature (1)..( 12): Result.005 file - promoters50/3434233
taagccacataa

SEQ ID NO: 182974 - DNA, 16 bp, Unknown
  misc_feature (1)..( 16): Result.005 file - promoters50/3434233
tattgaaaaagaaaaa

SEQ ID NO: 182975 - DNA, 16 bp, Unknown
  misc_feature (1)..( 16): Result.005 file - promoters50/3434233
aaaagaaaaagaaaaa

SEQ ID NO: 182976 - DNA, 16 bp, Unknown
  misc_feature (1)..( 16): Result.005 file - promoters50/3434233
gagggaaagagatgaa

SEQ ID NO: 182977 - DNA, 16 bp, Unknown
  misc_feature (1)..( 16): Result.005 file - promoters50/3434233
tatttaaaacgttgac

SEQ ID NO: 182978 - DNA, 16 bp, Unknown
  misc_feature (1)..( 16): Result.005 file - promoters50/3434233
tactaaaatagatgga

SEQ ID NO: 182979 - DNA, 16 bp, Unknown
  misc_feature (1)..( 16): Result.005 file - promoters50/3434233
agcaaaaacagaataa

SEQ ID NO: 182980 - DNA, 10 bp, Unknown
  misc_feature (1)..( 10): Result.005 file - promoters50/3434233
ctcaaagccc

SEQ ID NO: 182981 - DNA, 10 bp, Unknown
  misc_feature (1)..( 10): Result.005 file - promoters50/3434233
ttcacagcaa

SEQ ID NO: 182982 - DNA, 10 bp, Unknown
  misc_feature (1)..( 10): Result.005 file - promoters50/3434233
agaaaagcca

SEQ ID NO: 182983 - DNA, 10 bp, Unknown
  misc_feature (1)..( 10): Result.005 file - promoters50/3434233
ctcagagcga

SEQ ID NO: 182984 - DNA, 10 bp, Unknown
  misc_feature (1)..( 10): Result.005 file - promoters50/3434233
ctcaaagccc

SEQ ID NO: 182985 - DNA, 10 bp, Unknown
  misc_feature (1)..( 10): Result.005 file - promoters50/3434233
caataagcca

SEQ ID NO: 182986 - DNA, 11 bp, Unknown
  misc_feature (1)..( 11): Result.005 file - promoters50/3434233
gaattgatatt

SEQ ID NO: 182987 - DNA, 11 bp, Unknown
  misc_feature (1)..( 11): Result.005 file - promoters50/3434233
aaatagatgga

SEQ ID NO: 182988 - DNA, 11 bp, Unknown
  misc_feature (1)..( 11): Result.005 file - promoters50/3434233
tgtttgagatt

SEQ ID NO: 182989 - DNA, 11 bp, Unknown
  misc_feature (1)..( 11): Result.005 file - promoters50/3434233
aaaaagaaaaa

SEQ ID NO: 182990 - DNA, 11 bp, Unknown
  misc_feature (1)..( 11): Result.005 file - promoters50/3434233
aaaaagattgt

SEQ ID NO: 182991 - DNA, 11 bp, Unknown
  misc_feature (1)..( 11): Result.005 file - promoters50/3434233
gtaaagatttt

SEQ ID NO: 182992 - DNA, 14 bp, Unknown
  misc_feature (1)..( 14): Result.005 file - promoters50/3434256
ttaatttatttatt

SEQ ID NO: 182993 - DNA, 14 bp, Unknown
  misc_feature (1)..( 14): Result.005 file - promoters50/3434256
aagatttgtttttt

SEQ ID NO: 182994 - DNA, 14 bp, Unknown
  misc_feature (1)..( 14): Result.005 file - promoters50/3434256
ttaatttattccta

SEQ ID NO: 182995 - DNA, 14 bp, Unknown
  misc_feature (1)..( 14): Result.005 file - promoters50/3434256
tttatttctttaaa

SEQ ID NO: 182996 - DNA, 14 bp, Unknown
  misc_feature (1)..( 14): Result.005 file - promoters50/3434256
gagaattatgccta

SEQ ID NO: 182997 - DNA, 14 bp, Unknown
  misc_feature (1)..( 14): Result.005 file - promoters50/3434256
ttaaattaacaaaa

SEQ ID NO: 182998 - DNA, 12 bp, Unknown
  misc_feature (1)..( 12): Result.005 file - promoters50/3434256
attaaaaaaaaa

SEQ ID NO: 182999 - DNA, 12 bp, Unknown
  misc_feature (1)..( 12): Result.005 file - promoters50/3434256
gttaataaattt

SEQ ID NO: 183000 - DNA, 12 bp, Unknown
  misc_feature (1)..( 12): Result.005 file - promoters50/3434256
attaaattaaca

SEQ ID NO: 183001 - DNA, 12 bp, Unknown
  misc_feature (1)..( 12): Result.005 file - promoters50/3434256
gttgataataaa

SEQ ID NO: 183002 - DNA, 12 bp, Unknown
  misc_feature (1)..( 12): Result.005 file - promoters50/3434256
tttaataaacca

SEQ ID NO: 183003 - DNA, 12 bp, Unknown
  misc_feature (1)..( 12): Result.005 file - promoters50/3434256
attaaaaaaact

SEQ ID NO: 183004 - DNA, 13 bp, Unknown
  misc_feature (1)..( 13): Result.005 file - promoters50/3434256
aattcctttcttc

SEQ ID NO: 183005 - DNA, 13 bp, Unknown
  misc_feature (1)..( 13): Result.005 file - promoters50/3434256
atttcatttccaa

SEQ ID NO: 183006 - DNA, 13 bp, Unknown
  misc_feature (1)..( 13): Result.005 file - promoters50/3434256
tcttctttttttc

SEQ ID NO: 183007 - DNA, 13 bp, Unknown
  misc_feature (1)..( 13): Result.005 file - promoters50/3434256
attttattttatt

SEQ ID NO: 183008 - DNA, 13 bp, Unknown
  misc_feature (1)..( 13): Result.005 file - promoters50/3434256
attacatacctaa

SEQ ID NO: 183009 - DNA, 13 bp, Unknown
  misc_feature (1)..( 13): Result.005 file - promoters50/3434256
gatttatcctaag

SEQ ID NO: 183010 - DNA, 17 bp, Unknown
  misc_feature (1)..( 17): Result.005 file - promoters50/3434256
tagatatagttctttaa

SEQ ID NO: 183011 - DNA, 17 bp, Unknown
  misc_feature (1)..( 17): Result.005 file - promoters50/3434256
agataatatttcatttc

SEQ ID NO: 183012 - DNA, 17 bp, Unknown
  misc_feature (1)..( 17): Result.005 file - promoters50/3434256
attaagtactttttaga

SEQ ID NO: 183013 - DNA, 17 bp, Unknown
  misc_feature (1)..( 17): Result.005 file - promoters50/3434256
atagagttttttctata

SEQ ID NO: 183014 - DNA, 17 bp, Unknown
  misc_feature (1)..( 17): Result.005 file - promoters50/3434256
ttaaattacatacctaa

SEQ ID NO: 183015 - DNA, 17 bp, Unknown
  misc_feature (1)..( 17): Result.005 file - promoters50/3434256
cttctggactttataga

SEQ ID NO: 183016 - DNA, 11 bp, Unknown
  misc_feature (1)..( 11): Result.005 file - promoters50/3434256
tctttaactag

SEQ ID NO: 183017 - DNA, 11 bp, Unknown
  misc_feature (1)..( 11): Result.005 file - promoters50/3434256
attttaattag

SEQ ID NO: 183018 - DNA, 11 bp, Unknown
  misc_feature (1)..( 11): Result.005 file - promoters50/3434256
tctttaatgtc

SEQ ID NO: 183019 - DNA, 11 bp, Unknown
  misc_feature (1)..( 11): Result.005 file - promoters50/3434256
aagttacctag

SEQ ID NO: 183020 - DNA, 11 bp, Unknown
  misc_feature (1)..( 11): Result.005 file - promoters50/3434256
tatttcatttc

SEQ ID NO: 183021 - DNA, 11 bp, Unknown
  misc_feature (1)..( 11): Result.005 file - promoters50/3434256
aaattacatac

SEQ ID NO: 183022 - DNA, 14 bp, Unknown
  misc_feature (1)..( 14): Result.005 file - promoters50/3434279
tgagacctaagttt

SEQ ID NO: 183023 - DNA, 14 bp, Unknown
  misc_feature (1)..( 14): Result.005 file - promoters50/3434279
aatgacataaattt

SEQ ID NO: 183024 - DNA, 14 bp, Unknown
  misc_feature (1)..( 14): Result.005 file - promoters50/3434279
tccttctgaagttt

SEQ ID NO: 183025 - DNA, 14 bp, Unknown
  misc_feature (1)..( 14): Result.005 file - promoters50/3434279
aataacatatgact

SEQ ID NO: 183026 - DNA, 14 bp, Unknown
  misc_feature (1)..( 14): Result.005 file - promoters50/3434279
actaatatatattc

SEQ ID NO: 183027 - DNA, 14 bp, Unknown
  misc_feature (1)..( 14): Result.005 file - promoters50/3434279
tgtgatatattgtt

SEQ ID NO: 183028 - DNA, 14 bp, Unknown
  misc_feature (1)..( 14): Result.005 file - promoters50/3434279
aataatctaataaa

SEQ ID NO: 183029 - DNA, 12 bp, Unknown
  misc_feature (1)..( 12): Result.005 file - promoters50/3434279
ccaaacaaaaca

SEQ ID NO: 183030 - DNA, 12 bp, Unknown
  misc_feature (1)..( 12): Result.005 file - promoters50/3434279
agaaacaaagta

SEQ ID NO: 183031 - DNA, 12 bp, Unknown
  misc_feature (1)..( 12): Result.005 file - promoters50/3434279
gtcgacaaaatg

SEQ ID NO: 183032 - DNA, 12 bp, Unknown
  misc_feature (1)..( 12): Result.005 file - promoters50/3434279
ccaaacaacatt

SEQ ID NO: 183033 - DNA, 12 bp, Unknown
  misc_feature (1)..( 12): Result.005 file - promoters50/3434279
taaaaccaagac

SEQ ID NO: 183034 - DNA, 12 bp, Unknown
  misc_feature (1)..( 12): Result.005 file - promoters50/3434279
agacaccaagac

SEQ ID NO: 183035 - DNA, 15 bp, Unknown
  misc_feature (1)..( 15): Result.005 file - promoters50/3434303
ttttcatgtgtttgg

SEQ ID NO: 183036 - DNA, 15 bp, Unknown
  misc_feature (1)..( 15): Result.005 file - promoters50/3434303
gtggcatttgttttt

SEQ ID NO: 183037 - DNA, 15 bp, Unknown
  misc_feature (1)..( 15): Result.005 file - promoters50/3434303
tgaatctttattttt

SEQ ID NO: 183038 - DNA, 15 bp, Unknown
  misc_feature (1)..( 15): Result.005 file - promoters50/3434303
aataaatgtttcttt

SEQ ID NO: 183039 - DNA, 11 bp, Unknown
  misc_feature (1)..( 11): Result.005 file - promoters50/3434303
cagagagaacg

SEQ ID NO: 183040 - DNA, 11 bp, Unknown
  misc_feature (1)..( 11): Result.005 file - promoters50/3434303
tgaagataacg

SEQ ID NO: 183041 - DNA, 11 bp, Unknown
  misc_feature (1)..( 11): Result.005 file - promoters50/3434303
ggaagatatcc

SEQ ID NO: 183042 - DNA, 11 bp, Unknown
  misc_feature (1)..( 11): Result.005 file - promoters50/3434303
ggaagaaggaa

SEQ ID NO: 183043 - DNA, 14 bp, Unknown
  misc_feature (1)..( 14): Result.005 file - promoters50/3434303
tgaaggaagaagaa

SEQ ID NO: 183044 - DNA, 14 bp, Unknown
  misc_feature (1)..( 14): Result.005 file - promoters50/3434303
tgaacgaaaataat

SEQ ID NO: 183045 - DNA, 14 bp, Unknown
  misc_feature (1)..( 14): Result.005 file - promoters50/3434303
aaaacgaatataat

SEQ ID NO: 183046 - DNA, 14 bp, Unknown
  misc_feature (1)..( 14): Result.005 file - promoters50/3434303
tgtacgaatttgcg

SEQ ID NO: 183047 - DNA, 10 bp, Unknown
  misc_feature (1)..( 10): Result.005 file - promoters50/3434303
aaaaacaaac

SEQ ID NO: 183048 - DNA, 10 bp, Unknown
  misc_feature (1)..( 10): Result.005 file - promoters50/3434303
aaaaataaaa

SEQ ID NO: 183049 - DNA, 10 bp, Unknown
  misc_feature (1)..( 10): Result.005 file - promoters50/3434303
ataaagaaaa

SEQ ID NO: 183050 - DNA, 10 bp, Unknown
  misc_feature (1)..( 10): Result.005 file - promoters50/3434303
taaactaaaa

SEQ ID NO: 183051 - DNA, 8 bp, Unknown
  misc_feature (1)..( 8): Result.005 file - promoters50/3434328
tgtttttt

SEQ ID NO: 183052 - DNA, 8 bp, Unknown
  misc_feature (1)..( 8): Result.005 file - promoters50/3434328
tgtttttt

SEQ ID NO: 183053 - DNA, 8 bp, Unknown
  misc_feature (1)..( 8): Result.005 file - promoters50/3434328
cctttttt

SEQ ID NO: 183054 - DNA, 9 bp, Unknown
  misc_feature (1)..( 9): Result.005 file - promoters50/3434350
tatgacaat

SEQ ID NO: 183055 - DNA, 9 bp, Unknown
  misc_feature (1)..( 9): Result.005 file - promoters50/3434350
tataacaac

SEQ ID NO: 183056 - DNA, 9 bp, Unknown
  misc_feature (1)..( 9): Result.005 file - promoters50/3434350
tatgacaat

SEQ ID NO: 183057 - DNA, 9 bp, Unknown
  misc_feature (1)..( 9): Result.005 file - promoters50/3434350
gttgataat

SEQ ID NO: 183058 - DNA, 9 bp, Unknown
  misc_feature (1)..( 9): Result.005 file - promoters50/3434350
ctatatata

SEQ ID NO: 183059 - DNA, 9 bp, Unknown
  misc_feature (1)..( 9): Result.005 file - promoters50/3434350
atatatata

SEQ ID NO: 183060 - DNA, 9 bp, Unknown
  misc_feature (1)..( 9): Result.005 file - promoters50/3434350
ttatttatc

SEQ ID NO: 183061 - DNA, 9 bp, Unknown
  misc_feature (1)..( 9): Result.005 file - promoters50/3434350
ttaattatg

SEQ ID NO: 183062 - DNA, 8 bp, Unknown
  misc_feature (1)..( 8): Result.005 file - promoters50/3434350
tatataag

SEQ ID NO: 183063 - DNA, 8 bp, Unknown
  misc_feature (1)..( 8): Result.005 file - promoters50/3434350
aatataaa

SEQ ID NO: 183064 - DNA, 8 bp, Unknown
  misc_feature (1)..( 8): Result.005 file - promoters50/3434350
tttataag

SEQ ID NO: 183065 - DNA, 8 bp, Unknown
  misc_feature (1)..( 8): Result.005 file - promoters50/3434350
aatataat

SEQ ID NO: 183066 - DNA, 8 bp, Unknown
  misc_feature (1)..( 8): Result.005 file - promoters50/3434350
tttataac

SEQ ID NO: 183067 - DNA, 8 bp, Unknown
  misc_feature (1)..( 8): Result.005 file - promoters50/3434355
aatttttg

SEQ ID NO: 183068 - DNA, 8 bp, Unknown
  misc_feature (1)..( 8): Result.005 file - promoters50/3434355
aatttttt

SEQ ID NO: 183069 - DNA, 8 bp, Unknown
  misc_feature (1)..( 8): Result.005 file - promoters50/3434355
aatgtttg

SEQ ID NO: 183070 - DNA, 11 bp, Unknown
  misc_feature (1)..( 11): Result.005 file - promoters50/3434355
ttttttacatg

SEQ ID NO: 183071 - DNA, 11 bp, Unknown
  misc_feature (1)..( 11): Result.005 file - promoters50/3434355
atttttaaatg

SEQ ID NO: 183072 - DNA, 11 bp, Unknown
  misc_feature (1)..( 11): Result.005 file - promoters50/3434355
attgttaacga

SEQ ID NO: 183073 - DNA, 8 bp, Unknown
  misc_feature (1)..( 8): Result.005 file - promoters50/3434355
taaatttg

SEQ ID NO: 183074 - DNA, 8 bp, Unknown
  misc_feature (1)..( 8): Result.005 file - promoters50/3434355
taatttta

SEQ ID NO: 183075 - DNA, 8 bp, Unknown
  misc_feature (1)..( 8): Result.005 file - promoters50/3434355
aaaattgt

SEQ ID NO: 183076 - DNA, 15 bp, Unknown
  misc_feature (1)..( 15): Result.005 file - promoters50/3434355
cttttatttacttat

SEQ ID NO: 183077 - DNA, 15 bp, Unknown
  misc_feature (1)..( 15): Result.005 file - promoters50/3434355
gatttttttagttat

SEQ ID NO: 183078 - DNA, 15 bp, Unknown
  misc_feature (1)..( 15): Result.005 file - promoters50/3434355
cttttattatttcaa

SEQ ID NO: 183079 - DNA, 9 bp, Unknown
  misc_feature (1)..( 9): Result.005 file - promoters50/3434355
gagaaaaaa

SEQ ID NO: 183080 - DNA, 9 bp, Unknown
  misc_feature (1)..( 9): Result.005 file - promoters50/3434355
gagaaaaat

SEQ ID NO: 183081 - DNA, 10 bp, Unknown
  misc_feature (1)..( 10): Result.005 file - promoters50/3434355
aagaaacaaa

SEQ ID NO: 183082 - DNA, 9 bp, Unknown
  misc_feature (1)..( 9): Result.005 file - promoters50/3434355
tgtgttttg

SEQ ID NO: 183083 - DNA, 9 bp, Unknown
  misc_feature (1)..( 9): Result.005 file - promoters50/3434355
agagttttg

SEQ ID NO: 183084 - DNA, 9 bp, Unknown
  misc_feature (1)..( 9): Result.005 file - promoters50/3434355
agaattttt

SEQ ID NO: 183085 - DNA, 12 bp, Unknown
  misc_feature (1)..( 12): Result.005 file - promoters50/3434381
ttgaaatgaaaa

SEQ ID NO: 183086 - DNA, 12 bp, Unknown
  misc_feature (1)..( 12): Result.005 file - promoters50/3434381
tacaaatgagtg

SEQ ID NO: 183087 - DNA, 12 bp, Unknown
  misc_feature (1)..( 12): Result.005 file - promoters50/3434381
ttgaagtgaaaa

SEQ ID NO: 183088 - DNA, 12 bp, Unknown
  misc_feature (1)..( 12): Result.005 file - promoters50/3434381
cttgaatgaatt

SEQ ID NO: 183089 - DNA, 7 bp, Unknown
  misc_feature (1)..( 7): Result.005 file - promoters50/3434381
gatattg

SEQ ID NO: 183090 - DNA, 7 bp, Unknown
  misc_feature (1)..( 7): Result.005 file - promoters50/3434381
aatattg

SEQ ID NO: 183091 - DNA, 7 bp, Unknown
  misc_feature (1)..( 7): Result.005 file - promoters50/3434381
aatatta

SEQ ID NO: 183092 - DNA, 7 bp, Unknown
  misc_feature (1)..( 7): Result.005 file - promoters50/3434392
ttatatg

SEQ ID NO: 183093 - DNA, 7 bp, Unknown
  misc_feature (1)..( 7): Result.005 file - promoters50/3434392
ttatatt

SEQ ID NO: 183094 - DNA, 7 bp, Unknown
  misc_feature (1)..( 7): Result.005 file - promoters50/3434392
ttacatt

SEQ ID NO: 183095 - DNA, 9 bp, Unknown
  misc_feature (1)..( 9): Result.005 file - promoters50/3434400
gcatagaac

SEQ ID NO: 183096 - DNA, 11 bp, Unknown
  misc_feature (1)..( 11): Result.005 file - promoters50/3434400
ctgcaaagaaa

SEQ ID NO: 183097 - DNA, 11 bp, Unknown
  misc_feature (1)..( 11): Result.005 file - promoters50/3434400
ttagatagaat

SEQ ID NO: 183098 - DNA, 11 bp, Unknown
  misc_feature (1)..( 11): Result.005 file - promoters50/3434400
ttttgaagaaa

SEQ ID NO: 183099 - DNA, 11 bp, Unknown
  misc_feature (1)..( 11): Result.005 file - promoters50/3434400
ccagaaaaaaa

SEQ ID NO: 183100 - DNA, 11 bp, Unknown
  misc_feature (1)..( 11): Result.005 file - promoters50/3434400
tttcgaagaat

SEQ ID NO: 183101 - DNA, 12 bp, Unknown
  misc_feature (1)..( 12): Result.005 file - promoters50/3434400
aatgaacataca

SEQ ID NO: 183102 - DNA, 12 bp, Unknown
  misc_feature (1)..( 12): Result.005 file - promoters50/3434400
aatgaagatagt

SEQ ID NO: 183103 - DNA, 12 bp, Unknown
  misc_feature (1)..( 12): Result.005 file - promoters50/3434400
ggagaacattgt

SEQ ID NO: 183104 - DNA, 12 bp, Unknown
  misc_feature (1)..( 12): Result.005 file - promoters50/3434400
tgcaaagaaagt

SEQ ID NO: 183105 - DNA, 12 bp, Unknown
  misc_feature (1)..( 12): Result.005 file - promoters50/3434400
ccagaaaaaaaa

SEQ ID NO: 183106 - DNA, 12 bp, Unknown
  misc_feature (1)..( 12): Result.005 file - promoters50/3434400
aatgaataacgt

SEQ ID NO: 183107 - DNA, 10 bp, Unknown
  misc_feature (1)..( 10): Result.005 file - promoters50/3434400
ctttataatg

SEQ ID NO: 183108 - DNA, 10 bp, Unknown
  misc_feature (1)..( 10): Result.005 file - promoters50/3434400
cattaaaatc

SEQ ID NO: 183109 - DNA, 11 bp, Unknown
  misc_feature (1)..( 11): Result.005 file - promoters50/3434400
acttcatagag

SEQ ID NO: 183110 - DNA, 11 bp, Unknown
  misc_feature (1)..( 11): Result.005 file - promoters50/3434400
gttttttaatt

SEQ ID NO: 183111 - DNA, 11 bp, Unknown
  misc_feature (1)..( 11): Result.005 file - promoters50/3434400
gtattaaacaa

SEQ ID NO: 183112 - DNA, 11 bp, Unknown
  misc_feature (1)..( 11): Result.005 file - promoters50/3434400
atggtttaatt

SEQ ID NO: 183113 - DNA, 8 bp, Unknown
  misc_feature (1)..( 8): Result.005 file - promoters50/3434408
aaaggaag

SEQ ID NO: 183114 - DNA, 8 bp, Unknown
  misc_feature (1)..( 8): Result.005 file - promoters50/3434408
gaagtaag

SEQ ID NO: 183115 - DNA, 8 bp, Unknown
  misc_feature (1)..( 8): Result.005 file - promoters50/3434408
gaagtagc

SEQ ID NO: 183116 - DNA, 7 bp, Unknown
  misc_feature (1)..( 7): Result.005 file - promoters50/3434408
tcatttt

SEQ ID NO: 183117 - DNA, 7 bp, Unknown
  misc_feature (1)..( 7): Result.005 file - promoters50/3434408
tcaattt

SEQ ID NO: 183118 - DNA, 7 bp, Unknown
  misc_feature (1)..( 7): Result.005 file - promoters50/3434408
tcattta

SEQ ID NO: 183119 - DNA, 8 bp, Unknown
  misc_feature (1)..( 8): Result.005 file - promoters50/3434424
caaaagaa

SEQ ID NO: 183120 - DNA, 8 bp, Unknown
  misc_feature (1)..( 8): Result.005 file - promoters50/3434424
caaaagtt

SEQ ID NO: 183121 - DNA, 8 bp, Unknown
  misc_feature (1)..( 8): Result.005 file - promoters50/3434424
caaaagaa

SEQ ID NO: 183122 - DNA, 9 bp, Unknown
  misc_feature (1)..( 9): Result.005 file - promoters50/3434488
aagcaaaaa

SEQ ID NO: 183123 - DNA, 9 bp, Unknown
  misc_feature (1)..( 9): Result.005 file - promoters50/3434488
aagcaaaaa

SEQ ID NO: 183124 - DNA, 9 bp, Unknown
  misc_feature (1)..( 9): Result.005 file - promoters50/3434488
aagtaaaaa

SEQ ID NO: 183125 - DNA, 7 bp, Unknown
  misc_feature (1)..( 7): Result.005 file - promoters50/3434488
atttata

SEQ ID NO: 183126 - DNA, 7 bp, Unknown
  misc_feature (1)..( 7): Result.005 file - promoters50/3434488
ctttata

SEQ ID NO: 183127 - DNA, 7 bp, Unknown
  misc_feature (1)..( 7): Result.005 file - promoters50/3434488
ctttatt

SEQ ID NO: 183128 - DNA, 11 bp, Unknown
  misc_feature (1)..( 11): Result.005 file - promoters50/3434488
ttattgtaaac

SEQ ID NO: 183129 - DNA, 11 bp, Unknown
  misc_feature (1)..( 11): Result.005 file - promoters50/3434488
acattataaat

SEQ ID NO: 183130 - DNA, 11 bp, Unknown
  misc_feature (1)..( 11): Result.005 file - promoters50/3434488
ttattgtaaac

SEQ ID NO: 183131 - DNA, 7 bp, Unknown
  misc_feature (1)..( 7): Result.005 file - promoters50/3434488
atttttt

SEQ ID NO: 183132 - DNA, 7 bp, Unknown
  misc_feature (1)..( 7): Result.005 file - promoters50/3434488
atttttt

SEQ ID NO: 183133 - DNA, 7 bp, Unknown
  misc_feature (1)..( 7): Result.005 file - promoters50/3434488
atttttt

SEQ ID NO: 183134 - DNA, 8 bp, Unknown
  misc_feature (1)..( 8): Result.005 file - promoters50/3434488
ttttattt

SEQ ID NO: 183135 - DNA, 8 bp, Unknown
  misc_feature (1)..( 8): Result.005 file - promoters50/3434488
ctttattt

SEQ ID NO: 183136 - DNA, 8 bp, Unknown
  misc_feature (1)..( 8): Result.005 file - promoters50/3434488
ctttatag

SEQ ID NO: 183137 - DNA, 10 bp, Unknown
  misc_feature (1)..( 10): Result.005 file - promoters50/3434488
taaaatataa

SEQ ID NO: 183138 - DNA, 10 bp, Unknown
  misc_feature (1)..( 10): Result.005 file - promoters50/3434488
taaaaaataa

SEQ ID NO: 183139 - DNA, 11 bp, Unknown
  misc_feature (1)..( 11): Result.005 file - promoters50/3434488
atagaaattaa

SEQ ID NO: 183140 - DNA, 10 bp, Unknown
  misc_feature (1)..( 10): Result.005 file - promoters50/3434488
atatttagta

SEQ ID NO: 183141 - DNA, 10 bp, Unknown
  misc_feature (1)..( 10): Result.005 file - promoters50/3434488
atatttagtt

SEQ ID NO: 183142 - DNA, 10 bp, Unknown
  misc_feature (1)..( 10): Result.005 file - promoters50/3434488
taattttgtt

SEQ ID NO: 183143 - DNA, 12 bp, Unknown
  misc_feature (1)..( 12): Result.005 file - promoters50/3434563
acaataaataca

SEQ ID NO: 183144 - DNA, 12 bp, Unknown
  misc_feature (1)..( 12): Result.005 file - promoters50/3434563
gcaattaataat

SEQ ID NO: 183145 - DNA, 12 bp, Unknown
  misc_feature (1)..( 12): Result.005 file - promoters50/3434563
aaaataaactag

SEQ ID NO: 183146 - DNA, 12 bp, Unknown
  misc_feature (1)..( 12): Result.005 file - promoters50/3434563
gatgtaaaaatt

SEQ ID NO: 183147 - DNA, 12 bp, Unknown
  misc_feature (1)..( 12): Result.005 file - promoters50/3434563
aagctaagaatt

SEQ ID NO: 183148 - DNA, 12 bp, Unknown
  misc_feature (1)..( 12): Result.005 file - promoters50/3434563
gcaatttcacaa

SEQ ID NO: 183149 - DNA, 12 bp, Unknown
  misc_feature (1)..( 12): Result.005 file - promoters50/3434563
tctatgaaaagc

SEQ ID NO: 183150 - DNA, 14 bp, Unknown
  misc_feature (1)..( 14): Result.005 file - promoters50/3434563
aattttaatatttt

SEQ ID NO: 183151 - DNA, 14 bp, Unknown
  misc_feature (1)..( 14): Result.005 file - promoters50/3434563
caaacttttatttt

SEQ ID NO: 183152 - DNA, 14 bp, Unknown
  misc_feature (1)..( 14): Result.005 file - promoters50/3434563
tattattatatttg

SEQ ID NO: 183153 - DNA, 15 bp, Unknown
  misc_feature (1)..( 15): Result.005 file - promoters50/3434563
cttttaagtatcttt

SEQ ID NO: 183154 - DNA, 15 bp, Unknown
  misc_feature (1)..( 15): Result.005 file - promoters50/3434563
ttccaaaatatcttg

SEQ ID NO: 183155 - DNA, 15 bp, Unknown
  misc_feature (1)..( 15): Result.005 file - promoters50/3434563
caaatttttactttt

SEQ ID NO: 183156 - DNA, 9 bp, Unknown
  misc_feature (1)..( 9): Result.005 file - promoters50/3434648
cttgtcata

SEQ ID NO: 183157 - DNA, 9 bp, Unknown
  misc_feature (1)..( 9): Result.005 file - promoters50/3434648
cttgtctga

SEQ ID NO: 183158 - DNA, 9 bp, Unknown
  misc_feature (1)..( 9): Result.005 file - promoters50/3434648
attgttata

SEQ ID NO: 183159 - DNA, 8 bp, Unknown
  misc_feature (1)..( 8): Result.005 file - promoters50/3434648
tgtatcag

SEQ ID NO: 183160 - DNA, 8 bp, Unknown
  misc_feature (1)..( 8): Result.005 file - promoters50/3434648
tgtctcag

SEQ ID NO: 183161 - DNA, 8 bp, Unknown
  misc_feature (1)..( 8): Result.005 file - promoters50/3434648
tgtttcaa

SEQ ID NO: 183162 - DNA, 10 bp, Unknown
  misc_feature (1)..( 10): Result.005 file - promoters50/3434648
taataagttg

SEQ ID NO: 183163 - DNA, 10 bp, Unknown
  misc_feature (1)..( 10): Result.005 file - promoters50/3434648
atatatgttt

SEQ ID NO: 183164 - DNA, 10 bp, Unknown
  misc_feature (1)..( 10): Result.005 file - promoters50/3434648
atatatattt

SEQ ID NO: 183165 - DNA, 8 bp, Unknown
  misc_feature (1)..( 8): Result.005 file - promoters50/3434652
gataaaaa

SEQ ID NO: 183166 - DNA, 8 bp, Unknown
  misc_feature (1)..( 8): Result.005 file - promoters50/3434652
gatcaaaa

SEQ ID NO: 183167 - DNA, 8 bp, Unknown
  misc_feature (1)..( 8): Result.005 file - promoters50/3434652
gatcaaat

SEQ ID NO: 183168 - DNA, 11 bp, Unknown
  misc_feature (1)..( 11): Result.005 file - promoters50/3434652
attttttcagc

SEQ ID NO: 183169 - DNA, 11 bp, Unknown
  misc_feature (1)..( 11): Result.005 file - promoters50/3434652
attttttaagc

SEQ ID NO: 183170 - DNA, 11 bp, Unknown
  misc_feature (1)..( 11): Result.005 file - promoters50/3434652
ttttattctca

SEQ ID NO: 183171 - DNA, 9 bp, Unknown
  misc_feature (1)..( 9): Result.005 file - promoters50/3434652
taaagttgt

SEQ ID NO: 183172 - DNA, 9 bp, Unknown
  misc_feature (1)..( 9): Result.005 file - promoters50/3434652
taaggttgt

SEQ ID NO: 183173 - DNA, 9 bp, Unknown
  misc_feature (1)..( 9): Result.005 file - promoters50/3434652
aaaaattgt

SEQ ID NO: 183174 - DNA, 11 bp, Unknown
  misc_feature (1)..( 11): Result.005 file - promoters50/3434652
ataaatctaaa

SEQ ID NO: 183175 - DNA, 11 bp, Unknown
  misc_feature (1)..( 11): Result.005 file - promoters50/3434652
ttgtatctaaa

SEQ ID NO: 183176 - DNA, 11 bp, Unknown
  misc_feature (1)..( 11): Result.005 file - promoters50/3434652
ttgtaactatt

SEQ ID NO: 183177 - DNA, 8 bp, Unknown
  misc_feature (1)..( 8): Result.005 file - promoters50/3434652
tgtattat

SEQ ID NO: 183178 - DNA, 8 bp, Unknown
  misc_feature (1)..( 8): Result.005 file - promoters50/3434652
tgttttat

SEQ ID NO: 183179 - DNA, 8 bp, Unknown
  misc_feature (1)..( 8): Result.005 file - promoters50/3434652
tttttttt

SEQ ID NO: 183180 - DNA, 10 bp, Unknown
  misc_feature (1)..( 10): Result.005 file - promoters50/3434652
tttaattata

SEQ ID NO: 183181 - DNA, 10 bp, Unknown
  misc_feature (1)..( 10): Result.005 file - promoters50/3434652
tttaactata

SEQ ID NO: 183182 - DNA, 10 bp, Unknown
  misc_feature (1)..( 10): Result.005 file - promoters50/3434652
aacaactatt

SEQ ID NO: 183183 - DNA, 10 bp, Unknown
  misc_feature (1)..( 10): Result.005 file - promoters50/3434652
ttgcactatt

SEQ ID NO: 183184 - DNA, 9 bp, Unknown
  misc_feature (1)..( 9): Result.005 file - promoters50/3434652
taaagtcaa

SEQ ID NO: 183185 - DNA, 9 bp, Unknown
  misc_feature (1)..( 9): Result.005 file - promoters50/3434652
catagtcaa

SEQ ID NO: 183186 - DNA, 9 bp, Unknown
  misc_feature (1)..( 9): Result.005 file - promoters50/3434652
catattcac

SEQ ID NO: 183187 - DNA, 9 bp, Unknown
  misc_feature (1)..( 9): Result.005 file - promoters50/3434652
catatttat

SEQ ID NO: 183188 - DNA, 6 bp, Unknown
  misc_feature (1)..( 6): Result.005 file - promoters50/3434652
attaaa

SEQ ID NO: 183189 - DNA, 6 bp, Unknown
  misc_feature (1)..( 6): Result.005 file - promoters50/3434652
attaaa

SEQ ID NO: 183190 - DNA, 6 bp, Unknown
  misc_feature (1)..( 6): Result.005 file - promoters50/3434652
attaaa

SEQ ID NO: 183191 - DNA, 7 bp, Unknown
  misc_feature (1)..( 7): Result.005 file - promoters50/3434652
cctattc

SEQ ID NO: 183192 - DNA, 7 bp, Unknown
  misc_feature (1)..( 7): Result.005 file - promoters50/3434652
actattc

SEQ ID NO: 183193 - DNA, 7 bp, Unknown
  misc_feature (1)..( 7): Result.005 file - promoters50/3434652
actattg

SEQ ID NO: 183194 - DNA, 8 bp, Unknown
  misc_feature (1)..( 8): Result.005 file - promoters50/3434652
ctaatatt

SEQ ID NO: 183195 - DNA, 8 bp, Unknown
  misc_feature (1)..( 8): Result.005 file - promoters50/3434652
ctaaaatt

SEQ ID NO: 183196 - DNA, 8 bp, Unknown
  misc_feature (1)..( 8): Result.005 file - promoters50/3434652
ttaaaatg

SEQ ID NO: 183197 - DNA, 9 bp, Unknown
  misc_feature (1)..( 9): Result.005 file - promoters50/3434652
acactttag

SEQ ID NO: 183198 - DNA, 9 bp, Unknown
  misc_feature (1)..( 9): Result.005 file - promoters50/3434652
ttactatag

SEQ ID NO: 183199 - DNA, 9 bp, Unknown
  misc_feature (1)..( 9): Result.005 file - promoters50/3434652
ttattatac

SEQ ID NO: 183200 - DNA, 9 bp, Unknown
  misc_feature (1)..( 9): Result.005 file - promoters50/3434652
agttttgtt

SEQ ID NO: 183201 - DNA, 9 bp, Unknown
  misc_feature (1)..( 9): Result.005 file - promoters50/3434652
aattttgta

SEQ ID NO: 183202 - DNA, 9 bp, Unknown
  misc_feature (1)..( 9): Result.005 file - promoters50/3434652
aattatgta

SEQ ID NO: 183203 - DNA, 10 bp, Unknown
  misc_feature (1)..( 10): Result.005 file - promoters50/3434652
ttagttacaa

SEQ ID NO: 183204 - DNA, 10 bp, Unknown
  misc_feature (1)..( 10): Result.005 file - promoters50/3434652
caggtttcaa

SEQ ID NO: 183205 - DNA, 10 bp, Unknown
  misc_feature (1)..( 10): Result.005 file - promoters50/3434652
cagctttctt

SEQ ID NO: 183206 - DNA, 7 bp, Unknown
  misc_feature (1)..( 7): Result.005 file - promoters50/3434652
taaaaca

SEQ ID NO: 183207 - DNA, 7 bp, Unknown
  misc_feature (1)..( 7): Result.005 file - promoters50/3434652
aaaaaca

SEQ ID NO: 183208 - DNA, 8 bp, Unknown
  misc_feature (1)..( 8): Result.005 file - promoters50/3434652
gaacaact

SEQ ID NO: 183209 - DNA, 12 bp, Unknown
  misc_feature (1)..( 12): Result.005 file - promoters50/3434765
gtatataaatcc

SEQ ID NO: 183210 - DNA, 12 bp, Unknown
  misc_feature (1)..( 12): Result.005 file - promoters50/3434765
atatataagtat

SEQ ID NO: 183211 - DNA, 12 bp, Unknown
  misc_feature (1)..( 12): Result.005 file - promoters50/3434765
tactataaatct

SEQ ID NO: 183212 - DNA, 12 bp, Unknown
  misc_feature (1)..( 12): Result.005 file - promoters50/3434765
atttatgaatcc

SEQ ID NO: 183213 - DNA, 12 bp, Unknown
  misc_feature (1)..( 12): Result.005 file - promoters50/3434765
tcttataaataa

SEQ ID NO: 183214 - DNA, 12 bp, Unknown
  misc_feature (1)..( 12): Result.005 file - promoters50/3434765
gaaaaaaaatat

SEQ ID NO: 183215 - DNA, 11 bp, Unknown
  misc_feature (1)..( 11): Result.005 file - promoters50/3434796
tctcctataaa

SEQ ID NO: 183216 - DNA, 11 bp, Unknown
  misc_feature (1)..( 11): Result.005 file - promoters50/3434796
aagactaaaaa

SEQ ID NO: 183217 - DNA, 11 bp, Unknown
  misc_feature (1)..( 11): Result.005 file - promoters50/3434796
gtcactaaaaa

SEQ ID NO: 183218 - DNA, 11 bp, Unknown
  misc_feature (1)..( 11): Result.005 file - promoters50/3434796
aagaataaaaa

SEQ ID NO: 183219 - DNA, 11 bp, Unknown
  misc_feature (1)..( 11): Result.005 file - promoters50/3434796
cagaataacga

SEQ ID NO: 183220 - DNA, 9 bp, Unknown
  misc_feature (1)..( 9): Result.005 file - promoters50/3434876
ctaacaaga

SEQ ID NO: 183221 - DNA, 9 bp, Unknown
  misc_feature (1)..( 9): Result.005 file - promoters50/3434876
ttaacaaac

SEQ ID NO: 183222 - DNA, 9 bp, Unknown
  misc_feature (1)..( 9): Result.005 file - promoters50/3434876
ttatcaaac

SEQ ID NO: 183223 - DNA, 11 bp, Unknown
  misc_feature (1)..( 11): Result.005 file - promoters50/3434880
aagaaacaaag

SEQ ID NO: 183224 - DNA, 11 bp, Unknown
  misc_feature (1)..( 11): Result.005 file - promoters50/3434880
aagaaaaaaaa

SEQ ID NO: 183225 - DNA, 11 bp, Unknown
  misc_feature (1)..( 11): Result.005 file - promoters50/3434880
aagaaaagaca

SEQ ID NO: 183226 - DNA, 11 bp, Unknown
  misc_feature (1)..( 11): Result.005 file - promoters50/3434880
gggaaacaaag

SEQ ID NO: 183227 - DNA, 11 bp, Unknown
  misc_feature (1)..( 11): Result.005 file - promoters50/3434880
gccaaacaaca

SEQ ID NO: 183228 - DNA, 11 bp, Unknown
  misc_feature (1)..( 11): Result.005 file - promoters50/3434880
tccaaacaaaa

SEQ ID NO: 183229 - DNA, 11 bp, Unknown
  misc_feature (1)..( 11): Result.005 file - promoters50/3434880
tgtcgacaaaa

SEQ ID NO: 183230 - DNA, 15 bp, Unknown
  misc_feature (1)..( 15): Result.005 file - promoters50/3434880
aagccatattgatta

SEQ ID NO: 183231 - DNA, 15 bp, Unknown
  misc_feature (1)..( 15): Result.005 file - promoters50/3434880
ttcctatattgtcaa

SEQ ID NO: 183232 - DNA, 15 bp, Unknown
  misc_feature (1)..( 15): Result.005 file - promoters50/3434880
aagtcatatttggat

SEQ ID NO: 183233 - DNA, 15 bp, Unknown
  misc_feature (1)..( 15): Result.005 file - promoters50/3434880
attttttatttatta

SEQ ID NO: 183234 - DNA, 15 bp, Unknown
  misc_feature (1)..( 15): Result.005 file - promoters50/3434880
tataaatattttagg

SEQ ID NO: 183235 - DNA, 15 bp, Unknown
  misc_feature (1)..( 15): Result.005 file - promoters50/3434880
actgtcaattcactg

SEQ ID NO: 183236 - DNA, 9 bp, Unknown
  misc_feature (1)..( 9): Result.005 file - promoters50/3434912
ggtttctag

SEQ ID NO: 183237 - DNA, 9 bp, Unknown
  misc_feature (1)..( 9): Result.005 file - promoters50/3434912
tgtttcttc

SEQ ID NO: 183238 - DNA, 9 bp, Unknown
  misc_feature (1)..( 9): Result.005 file - promoters50/3434912
ggtttcttg

SEQ ID NO: 183239 - DNA, 9 bp, Unknown
  misc_feature (1)..( 9): Result.005 file - promoters50/3434912
ggtttgttg

SEQ ID NO: 183240 - DNA, 9 bp, Unknown
  misc_feature (1)..( 9): Result.005 file - promoters50/3434912
atttttttc

SEQ ID NO: 183241 - DNA, 9 bp, Unknown
  misc_feature (1)..( 9): Result.005 file - promoters50/3434912
catttctcc

SEQ ID NO: 183242 - DNA, 9 bp, Unknown
  misc_feature (1)..( 9): Result.005 file - promoters50/3434936
tctaaagaa

SEQ ID NO: 183243 - DNA, 9 bp, Unknown
  misc_feature (1)..( 9): Result.005 file - promoters50/3434936
tataaagaa

SEQ ID NO: 183244 - DNA, 9 bp, Unknown
  misc_feature (1)..( 9): Result.005 file - promoters50/3434936
tattaagca

SEQ ID NO: 183245 - DNA, 9 bp, Unknown
  misc_feature (1)..( 9): Result.005 file - promoters50/3434952
ttttgttga

SEQ ID NO: 183246 - DNA, 9 bp, Unknown
  misc_feature (1)..( 9): Result.005 file - promoters50/3434952
gagtgttga

SEQ ID NO: 183247 - DNA, 9 bp, Unknown
  misc_feature (1)..( 9): Result.005 file - promoters50/3434952
ttttattgt

SEQ ID NO: 183248 - DNA, 9 bp, Unknown
  misc_feature (1)..( 9): Result.005 file - promoters50/3434952
tatgtagaa

SEQ ID NO: 183249 - DNA, 9 bp, Unknown
  misc_feature (1)..( 9): Result.005 file - promoters50/3434952
aatgttgaa

SEQ ID NO: 183250 - DNA, 9 bp, Unknown
  misc_feature (1)..( 9): Result.005 file - promoters50/3434952
aatggtgac

SEQ ID NO: 183251 - DNA, 8 bp, Unknown
  misc_feature (1)..( 8): Result.005 file - promoters50/3435031
catatttc

SEQ ID NO: 183252 - DNA, 8 bp, Unknown
  misc_feature (1)..( 8): Result.005 file - promoters50/3435031
tatatttt

SEQ ID NO: 183253 - DNA, 9 bp, Unknown
  misc_feature (1)..( 9): Result.005 file - promoters50/3435031
aatatgttt

SEQ ID NO: 183254 - DNA, 10 bp, Unknown
  misc_feature (1)..( 10): Result.005 file - promoters50/3435057
gttataatat

SEQ ID NO: 183255 - DNA, 10 bp, Unknown
  misc_feature (1)..( 10): Result.005 file - promoters50/3435057
gttatcataa

SEQ ID NO: 183256 - DNA, 10 bp, Unknown
  misc_feature (1)..( 10): Result.005 file - promoters50/3435057
taaatcatac

SEQ ID NO: 183257 - DNA, 10 bp, Unknown
  misc_feature (1)..( 10): Result.005 file - promoters50/3435057
caattcataa

SEQ ID NO: 183258 - DNA, 7 bp, Unknown
  misc_feature (1)..( 7): Result.005 file - promoters50/3435057
tcataaa

SEQ ID NO: 183259 - DNA, 7 bp, Unknown
  misc_feature (1)..( 7): Result.005 file - promoters50/3435057
ccataaa

SEQ ID NO: 183260 - DNA, 7 bp, Unknown
  misc_feature (1)..( 7): Result.005 file - promoters50/3435057
tcataac

SEQ ID NO: 183261 - DNA, 8 bp, Unknown
  misc_feature (1)..( 8): Result.005 file - promoters50/3435057
gcattaaa

SEQ ID NO: 183262 - DNA, 11 bp, Unknown
  misc_feature (1)..( 11): Result.005 file - promoters50/3435057
acattatagat

SEQ ID NO: 183263 - DNA, 11 bp, Unknown
  misc_feature (1)..( 11): Result.005 file - promoters50/3435057
tttttattgat

SEQ ID NO: 183264 - DNA, 11 bp, Unknown
  misc_feature (1)..( 11): Result.005 file - promoters50/3435057
ttttaatttct

SEQ ID NO: 183265 - DNA, 12 bp, Unknown
  misc_feature (1)..( 12): Result.005 file - promoters50/3435057
tttgttattaat

SEQ ID NO: 183266 - DNA, 9 bp, Unknown
  misc_feature (1)..( 9): Result.005 file - promoters50/3435091
ttacaaaaa

SEQ ID NO: 183267 - DNA, 9 bp, Unknown
  misc_feature (1)..( 9): Result.005 file - promoters50/3435091
ttactaaaa

SEQ ID NO: 183268 - DNA, 9 bp, Unknown
  misc_feature (1)..( 9): Result.005 file - promoters50/3435091
agaaaaaaa

SEQ ID NO: 183269 - DNA, 9 bp, Unknown
  misc_feature (1)..( 9): Result.005 file - promoters50/3435091
ttataaagt

SEQ ID NO: 183270 - DNA, 9 bp, Unknown
  misc_feature (1)..( 9): Result.005 file - promoters50/3435091
ttactaagg

SEQ ID NO: 183271 - DNA, 9 bp, Unknown
  misc_feature (1)..( 9): Result.005 file - promoters50/3435091
ttataagtc

SEQ ID NO: 183272 - DNA, 9 bp, Unknown
  misc_feature (1)..( 9): Result.005 file - promoters50/3435091
atatatagt

SEQ ID NO: 183273 - DNA, 9 bp, Unknown
  misc_feature (1)..( 9): Result.005 file - promoters50/3435091
tatatttga

SEQ ID NO: 183274 - DNA, 9 bp, Unknown
  misc_feature (1)..( 9): Result.005 file - promoters50/3435091
tattttttt

SEQ ID NO: 183275 - DNA, 9 bp, Unknown
  misc_feature (1)..( 9): Result.005 file - promoters50/3435091
tatttttga

SEQ ID NO: 183276 - DNA, 9 bp, Unknown
  misc_feature (1)..( 9): Result.005 file - promoters50/3435091
ggttttttc

SEQ ID NO: 183277 - DNA, 9 bp, Unknown
  misc_feature (1)..( 9): Result.005 file - promoters50/3435091
catatttgg

SEQ ID NO: 183278 - DNA, 9 bp, Unknown
  misc_feature (1)..( 9): Result.005 file - promoters50/3435091
gctttttga

SEQ ID NO: 183279 - DNA, 9 bp, Unknown
  misc_feature (1)..( 9): Result.005 file - promoters50/3435091
agttataaa

SEQ ID NO: 183280 - DNA, 9 bp, Unknown
  misc_feature (1)..( 9): Result.005 file - promoters50/3435091
ccttataat

SEQ ID NO: 183281 - DNA, 9 bp, Unknown
  misc_feature (1)..( 9): Result.005 file - promoters50/3435091
ttttagaaa

SEQ ID NO: 183282 - DNA, 9 bp, Unknown
  misc_feature (1)..( 9): Result.005 file - promoters50/3435091
ccttatact

SEQ ID NO: 183283 - DNA, 9 bp, Unknown
  misc_feature (1)..( 9): Result.005 file - promoters50/3435091
gattataaa

SEQ ID NO: 183284 - DNA, 9 bp, Unknown
  misc_feature (1)..( 9): Result.005 file - promoters50/3435091
gattaaaat

SEQ ID NO: 183285 - DNA, 9 bp, Unknown
  misc_feature (1)..( 9): Result.005 file - promoters50/3435125
aaaatcaaa

SEQ ID NO: 183286 - DNA, 9 bp, Unknown
  misc_feature (1)..( 9): Result.005 file - promoters50/3435125
ttaataaaa

SEQ ID NO: 183287 - DNA, 10 bp, Unknown
  misc_feature (1)..( 10): Result.005 file - promoters50/3435125
aaaactcaaa

SEQ ID NO: 183288 - DNA, 10 bp, Unknown
  misc_feature (1)..( 10): Result.005 file - promoters50/3435125
agaaaacaac

SEQ ID NO: 183289 - DNA, 12 bp, Unknown
  misc_feature (1)..( 12): Result.005 file - promoters50/3435133
gaaatagattga

SEQ ID NO: 183290 - DNA, 12 bp, Unknown
  misc_feature (1)..( 12): Result.005 file - promoters50/3435133
ttagtagattca

SEQ ID NO: 183291 - DNA, 12 bp, Unknown
  misc_feature (1)..( 12): Result.005 file - promoters50/3435133
tatataaattaa

SEQ ID NO: 183292 - DNA, 12 bp, Unknown
  misc_feature (1)..( 12): Result.005 file - promoters50/3435133
gaaaaagatagc

SEQ ID NO: 183293 - DNA, 12 bp, Unknown
  misc_feature (1)..( 12): Result.005 file - promoters50/3435133
gaaatatataaa

SEQ ID NO: 183294 - DNA, 13 bp, Unknown
  misc_feature (1)..( 13): Result.005 file - promoters50/3435133
tcatatttgtata

SEQ ID NO: 183295 - DNA, 13 bp, Unknown
  misc_feature (1)..( 13): Result.005 file - promoters50/3435133
aaataattgtata

SEQ ID NO: 183296 - DNA, 13 bp, Unknown
  misc_feature (1)..( 13): Result.005 file - promoters50/3435133
aaaatcttgtata

SEQ ID NO: 183297 - DNA, 13 bp, Unknown
  misc_feature (1)..( 13): Result.005 file - promoters50/3435133
ctaaaatagtaaa

SEQ ID NO: 183298 - DNA, 13 bp, Unknown
  misc_feature (1)..( 13): Result.005 file - promoters50/3435133
aaagaattgaaca

SEQ ID NO: 183299 - DNA, 9 bp, Unknown
  misc_feature (1)..( 9): Result.005 file - promoters50/3435133
gtataaatt

SEQ ID NO: 183300 - DNA, 9 bp, Unknown
  misc_feature (1)..( 9): Result.005 file - promoters50/3435133
ttattaatt

SEQ ID NO: 183301 - DNA, 9 bp, Unknown
  misc_feature (1)..( 9): Result.005 file - promoters50/3435133
ttactaaaa

SEQ ID NO: 183302 - DNA, 10 bp, Unknown
  misc_feature (1)..( 10): Result.005 file - promoters50/3435133
gaactgaaag

SEQ ID NO: 183303 - DNA, 10 bp, Unknown
  misc_feature (1)..( 10): Result.005 file - promoters50/3435133
taactgaaaa

SEQ ID NO: 183304 - DNA, 7 bp, Unknown
  misc_feature (1)..( 7): Result.005 file - promoters50/3435151
atacttt

SEQ ID NO: 183305 - DNA, 7 bp, Unknown
  misc_feature (1)..( 7): Result.005 file - promoters50/3435151
atatttt

SEQ ID NO: 183306 - DNA, 7 bp, Unknown
  misc_feature (1)..( 7): Result.005 file - promoters50/3435151
ataaatt

SEQ ID NO: 183307 - DNA, 9 bp, Unknown
  misc_feature (1)..( 9): Result.005 file - promoters50/3435151
ctaaaaaaa

SEQ ID NO: 183308 - DNA, 9 bp, Unknown
  misc_feature (1)..( 9): Result.005 file - promoters50/3435151
ccaaaaaaa

SEQ ID NO: 183309 - DNA, 9 bp, Unknown
  misc_feature (1)..( 9): Result.005 file - promoters50/3435151
ctaaaaagt

SEQ ID NO: 183310 - DNA, 9 bp, Unknown
  misc_feature (1)..( 9): Result.005 file - promoters50/3435151
taaaatgtt

SEQ ID NO: 183311 - DNA, 9 bp, Unknown
  misc_feature (1)..( 9): Result.005 file - promoters50/3435151
gcaaatgtt

SEQ ID NO: 183312 - DNA, 9 bp, Unknown
  misc_feature (1)..( 9): Result.005 file - promoters50/3435151
taaaaagtt

SEQ ID NO: 183313 - DNA, 9 bp, Unknown
  misc_feature (1)..( 9): Result.005 file - promoters50/3435169
aaaaatttc

SEQ ID NO: 183314 - DNA, 9 bp, Unknown
  misc_feature (1)..( 9): Result.005 file - promoters50/3435169
aaaaatgaa

SEQ ID NO: 183315 - DNA, 9 bp, Unknown
  misc_feature (1)..( 9): Result.005 file - promoters50/3435169
caaagtttc

SEQ ID NO: 183316 - DNA, 9 bp, Unknown
  misc_feature (1)..( 9): Result.005 file - promoters50/3435169
aacatctca

SEQ ID NO: 183317 - DNA, 9 bp, Unknown
  misc_feature (1)..( 9): Result.005 file - promoters50/3435169
atcatttca

SEQ ID NO: 183318 - DNA, 9 bp, Unknown
  misc_feature (1)..( 9): Result.005 file - promoters50/3435169
aacttctac

SEQ ID NO: 183319 - DNA, 10 bp, Unknown
  misc_feature (1)..( 10): Result.005 file - promoters50/3435185
ttgtaaatta

SEQ ID NO: 183320 - DNA, 10 bp, Unknown
  misc_feature (1)..( 10): Result.005 file - promoters50/3435185
gagtaaataa

SEQ ID NO: 183321 - DNA, 10 bp, Unknown
  misc_feature (1)..( 10): Result.005 file - promoters50/3435185
ttgtaaaaaa

SEQ ID NO: 183322 - DNA, 10 bp, Unknown
  misc_feature (1)..( 10): Result.005 file - promoters50/3435185
gagtaacaaa

SEQ ID NO: 183323 - DNA, 10 bp, Unknown
  misc_feature (1)..( 10): Result.005 file - promoters50/3435185
ccaaaacaaa

SEQ ID NO: 183324 - DNA, 8 bp, Unknown
  misc_feature (1)..( 8): Result.005 file - promoters50/3435185
gaaaaaaa

SEQ ID NO: 183325 - DNA, 8 bp, Unknown
  misc_feature (1)..( 8): Result.005 file - promoters50/3435185
aaaacaaa

SEQ ID NO: 183326 - DNA, 8 bp, Unknown
  misc_feature (1)..( 8): Result.005 file - promoters50/3435185
aaaacaaa

SEQ ID NO: 183327 - DNA, 9 bp, Unknown
  misc_feature (1)..( 9): Result.005 file - promoters50/3435185
agtaacaaa

SEQ ID NO: 183328 - DNA, 9 bp, Unknown
  misc_feature (1)..( 9): Result.005 file - promoters50/3435185
aaatacaat

SEQ ID NO: 183329 - DNA, 14 bp, Unknown
  misc_feature (1)..( 14): Result.005 file - promoters50/3435227
cttctataaatcaa

SEQ ID NO: 183330 - DNA, 14 bp, Unknown
  misc_feature (1)..( 14): Result.005 file - promoters50/3435227
cttctataaaacaa

SEQ ID NO: 183331 - DNA, 14 bp, Unknown
  misc_feature (1)..( 14): Result.005 file - promoters50/3435227
ttgccggaaaacaa

SEQ ID NO: 183332 - DNA, 8 bp, Unknown
  misc_feature (1)..( 8): Result.005 file - promoters50/3435239
tctcgttt

SEQ ID NO: 183333 - DNA, 8 bp, Unknown
  misc_feature (1)..( 8): Result.005 file - promoters50/3435239
tcttgttt

SEQ ID NO: 183334 - DNA, 8 bp, Unknown
  misc_feature (1)..( 8): Result.005 file - promoters50/3435239
tctttttt

SEQ ID NO: 183335 - DNA, 8 bp, Unknown
  misc_feature (1)..( 8): Result.005 file - promoters50/3435239
aattgttt

SEQ ID NO: 183336 - DNA, 12 bp, Unknown
  misc_feature (1)..( 12): Result.005 file - promoters50/3435239
ttttattggcca

SEQ ID NO: 183337 - DNA, 12 bp, Unknown
  misc_feature (1)..( 12): Result.005 file - promoters50/3435239
ttttcttgagag

SEQ ID NO: 183338 - DNA, 12 bp, Unknown
  misc_feature (1)..( 12): Result.005 file - promoters50/3435239
agttattgtttt

SEQ ID NO: 183339 - DNA, 12 bp, Unknown
  misc_feature (1)..( 12): Result.005 file - promoters50/3435239
gtttattactgg

SEQ ID NO: 183340 - DNA, 9 bp, Unknown
  misc_feature (1)..( 9): Result.005 file - promoters50/3435239
aaaagaaga

SEQ ID NO: 183341 - DNA, 9 bp, Unknown
  misc_feature (1)..( 9): Result.005 file - promoters50/3435239
aaaagtaga

SEQ ID NO: 183342 - DNA, 9 bp, Unknown
  misc_feature (1)..( 9): Result.005 file - promoters50/3435239
tgaagtagt

SEQ ID NO: 183343 - DNA, 11 bp, Unknown
  misc_feature (1)..( 11): Result.005 file - promoters50/3435239
gacgattttgt

SEQ ID NO: 183344 - DNA, 11 bp, Unknown
  misc_feature (1)..( 11): Result.005 file - promoters50/3435239
gacaattagat

SEQ ID NO: 183345 - DNA, 11 bp, Unknown
  misc_feature (1)..( 11): Result.005 file - promoters50/3435239
gacgattttgt

SEQ ID NO: 183346 - DNA, 9 bp, Unknown
  misc_feature (1)..( 9): Result.005 file - promoters50/3435239
ttttatttt

SEQ ID NO: 183347 - DNA, 9 bp, Unknown
  misc_feature (1)..( 9): Result.005 file - promoters50/3435239
ctttctttt

SEQ ID NO: 183348 - DNA, 9 bp, Unknown
  misc_feature (1)..( 9): Result.005 file - promoters50/3435239
tcttgtttc

SEQ ID NO: 183349 - DNA, 9 bp, Unknown
  misc_feature (1)..( 9): Result.005 file - promoters50/3435239
aattgttta

SEQ ID NO: 183350 - DNA, 13 bp, Unknown
  misc_feature (1)..( 13): Result.005 file - promoters50/3435239
cgttttttattgg

SEQ ID NO: 183351 - DNA, 13 bp, Unknown
  misc_feature (1)..( 13): Result.005 file - promoters50/3435239
tcttttttttgtt

SEQ ID NO: 183352 - DNA, 13 bp, Unknown
  misc_feature (1)..( 13): Result.005 file - promoters50/3435239
tgtttattactgg

SEQ ID NO: 183353 - DNA, 13 bp, Unknown
  misc_feature (1)..( 13): Result.005 file - promoters50/3435239
tcttgtttcttct

SEQ ID NO: 183354 - DNA, 8 bp, Unknown
  misc_feature (1)..( 8): Result.005 file - promoters50/3435239
atttgtat

SEQ ID NO: 183355 - DNA, 8 bp, Unknown
  misc_feature (1)..( 8): Result.005 file - promoters50/3435239
attcgtat

SEQ ID NO: 183356 - DNA, 8 bp, Unknown
  misc_feature (1)..( 8): Result.005 file - promoters50/3435239
gttcttat

SEQ ID NO: 183357 - DNA, 6 bp, Unknown
  misc_feature (1)..( 6): Result.005 file - promoters50/3435239
ttgttt

SEQ ID NO: 183358 - DNA, 6 bp, Unknown
  misc_feature (1)..( 6): Result.005 file - promoters50/3435239
ttgttt

SEQ ID NO: 183359 - DNA, 6 bp, Unknown
  misc_feature (1)..( 6): Result.005 file - promoters50/3435239
ttgttt

SEQ ID NO: 183360 - DNA, 8 bp, Unknown
  misc_feature (1)..( 8): Result.005 file - promoters50/3435239
gtttcttt

SEQ ID NO: 183361 - DNA, 8 bp, Unknown
  misc_feature (1)..( 8): Result.005 file - promoters50/3435239
atttgttt

SEQ ID NO: 183362 - DNA, 8 bp, Unknown
  misc_feature (1)..( 8): Result.005 file - promoters50/3435239
atttgtta

SEQ ID NO: 183363 - DNA, 7 bp, Unknown
  misc_feature (1)..( 7): Result.005 file - promoters50/3435258
taaatta

SEQ ID NO: 183364 - DNA, 7 bp, Unknown
  misc_feature (1)..( 7): Result.005 file - promoters50/3435258
taaattt

SEQ ID NO: 183365 - DNA, 7 bp, Unknown
  misc_feature (1)..( 7): Result.005 file - promoters50/3435258
caaattt

SEQ ID NO: 183366 - DNA, 8 bp, Unknown
  misc_feature (1)..( 8): Result.005 file - promoters50/3435258
aaattaat

SEQ ID NO: 183367 - DNA, 8 bp, Unknown
  misc_feature (1)..( 8): Result.005 file - promoters50/3435258
aaattaaa

SEQ ID NO: 183368 - DNA, 8 bp, Unknown
  misc_feature (1)..( 8): Result.005 file - promoters50/3435258
caatcaaa

SEQ ID NO: 183369 - DNA, 11 bp, Unknown
  misc_feature (1)..( 11): Result.005 file - promoters50/3435258
attattaattt

SEQ ID NO: 183370 - DNA, 11 bp, Unknown
  misc_feature (1)..( 11): Result.005 file - promoters50/3435258
attaataaata

SEQ ID NO: 183371 - DNA, 11 bp, Unknown
  misc_feature (1)..( 11): Result.005 file - promoters50/3435258
attattcattt

SEQ ID NO: 183372 - DNA, 12 bp, Unknown
  misc_feature (1)..( 12): Result.005 file - promoters50/3435258
attattaattta

SEQ ID NO: 183373 - DNA, 12 bp, Unknown
  misc_feature (1)..( 12): Result.005 file - promoters50/3435258
ctctgtaaatta

SEQ ID NO: 183374 - DNA, 12 bp, Unknown
  misc_feature (1)..( 12): Result.005 file - promoters50/3435258
attattcatttt

SEQ ID NO: 183375 - DNA, 8 bp, Unknown
  misc_feature (1)..( 8): Result.005 file - promoters50/3435258
tattaaat

SEQ ID NO: 183376 - DNA, 8 bp, Unknown
  misc_feature (1)..( 8): Result.005 file - promoters50/3435258
tattaatt

SEQ ID NO: 183377 - DNA, 8 bp, Unknown
  misc_feature (1)..( 8): Result.005 file - promoters50/3435258
tatgaaat

SEQ ID NO: 183378 - DNA, 9 bp, Unknown
  misc_feature (1)..( 9): Result.005 file - promoters50/3435258
tttatggat

SEQ ID NO: 183379 - DNA, 9 bp, Unknown
  misc_feature (1)..( 9): Result.005 file - promoters50/3435258
tttatcgat

SEQ ID NO: 183380 - DNA, 9 bp, Unknown
  misc_feature (1)..( 9): Result.005 file - promoters50/3435258
tttatgaaa

SEQ ID NO: 183381 - DNA, 9 bp, Unknown
  misc_feature (1)..( 9): Result.005 file - promoters50/3435258
tattaaatt

SEQ ID NO: 183382 - DNA, 9 bp, Unknown
  misc_feature (1)..( 9): Result.005 file - promoters50/3435258
cgataaatt

SEQ ID NO: 183383 - DNA, 9 bp, Unknown
  misc_feature (1)..( 9): Result.005 file - promoters50/3435258
tatgaaatg

SEQ ID NO: 183384 - DNA, 8 bp, Unknown
  misc_feature (1)..( 8): Result.005 file - promoters50/3435258
caaattaa

SEQ ID NO: 183385 - DNA, 8 bp, Unknown
  misc_feature (1)..( 8): Result.005 file - promoters50/3435258
taaattaa

SEQ ID NO: 183386 - DNA, 8 bp, Unknown
  misc_feature (1)..( 8): Result.005 file - promoters50/3435258
caatttag

SEQ ID NO: 183387 - DNA, 12 bp, Unknown
  misc_feature (1)..( 12): Result.005 file - promoters50/3435258
tttatatataag

SEQ ID NO: 183388 - DNA, 12 bp, Unknown
  misc_feature (1)..( 12): Result.005 file - promoters50/3435258
tttatagagatt

SEQ ID NO: 183389 - DNA, 13 bp, Unknown
  misc_feature (1)..( 13): Result.005 file - promoters50/3435258
ttctatatatata

SEQ ID NO: 183390 - DNA, 9 bp, Unknown
  misc_feature (1)..( 9): Result.005 file - promoters50/3435258
ttttggaaa

SEQ ID NO: 183391 - DNA, 9 bp, Unknown
  misc_feature (1)..( 9): Result.005 file - promoters50/3435258
atttggaat

SEQ ID NO: 183392 - DNA, 9 bp, Unknown
  misc_feature (1)..( 9): Result.005 file - promoters50/3435258
atttgtaat

SEQ ID NO: 183393 - DNA, 12 bp, Unknown
  misc_feature (1)..( 12): Result.005 file - promoters50/3435274
caggattgattt

SEQ ID NO: 183394 - DNA, 12 bp, Unknown
  misc_feature (1)..( 12): Result.005 file - promoters50/3435274
caggatttatta

SEQ ID NO: 183395 - DNA, 12 bp, Unknown
  misc_feature (1)..( 12): Result.005 file - promoters50/3435274
agttgtttttta

SEQ ID NO: 183396 - DNA, 9 bp, Unknown
  misc_feature (1)..( 9): Result.005 file - promoters50/3435282
tttatgtat

SEQ ID NO: 183397 - DNA, 9 bp, Unknown
  misc_feature (1)..( 9): Result.005 file - promoters50/3435282
gttatgttt

SEQ ID NO: 183398 - DNA, 9 bp, Unknown
  misc_feature (1)..( 9): Result.005 file - promoters50/3435282
aatatattt

SEQ ID NO: 183399 - DNA, 9 bp, Unknown
  misc_feature (1)..( 9): Result.005 file - promoters50/3435282
attattttt

SEQ ID NO: 183400 - DNA, 9 bp, Unknown
  misc_feature (1)..( 9): Result.005 file - promoters50/3435282
cttttttaa

SEQ ID NO: 183401 - DNA, 9 bp, Unknown
  misc_feature (1)..( 9): Result.005 file - promoters50/3435282
tttattgct

SEQ ID NO: 183402 - DNA, 9 bp, Unknown
  misc_feature (1)..( 9): Result.005 file - promoters50/3435282
ataattata

SEQ ID NO: 183403 - DNA, 14 bp, Unknown
  misc_feature (1)..( 14): Result.005 file - promoters50/3435282
ttcaaatattaaaa

SEQ ID NO: 183404 - DNA, 14 bp, Unknown
  misc_feature (1)..( 14): Result.005 file - promoters50/3435282
aaaaaagattttat

SEQ ID NO: 183405 - DNA, 14 bp, Unknown
  misc_feature (1)..( 14): Result.005 file - promoters50/3435282
tgcaaattttattg

SEQ ID NO: 183406 - DNA, 14 bp, Unknown
  misc_feature (1)..( 14): Result.005 file - promoters50/3435282
atgaaaaattaaaa

SEQ ID NO: 183407 - DNA, 14 bp, Unknown
  misc_feature (1)..( 14): Result.005 file - promoters50/3435282
ttctaataattata

SEQ ID NO: 183408 - DNA, 14 bp, Unknown
  misc_feature (1)..( 14): Result.005 file - promoters50/3435282
gttgtattttattc

SEQ ID NO: 183409 - DNA, 14 bp, Unknown
  misc_feature (1)..( 14): Result.005 file - promoters50/3435282
tgattattttttgg

SEQ ID NO: 183410 - DNA, 9 bp, Unknown
  misc_feature (1)..( 9): Result.005 file - promoters50/3435282
ataatatct

SEQ ID NO: 183411 - DNA, 9 bp, Unknown
  misc_feature (1)..( 9): Result.005 file - promoters50/3435282
atattataa

SEQ ID NO: 183412 - DNA, 9 bp, Unknown
  misc_feature (1)..( 9): Result.005 file - promoters50/3435282
gtaaaatcc

SEQ ID NO: 183413 - DNA, 9 bp, Unknown
  misc_feature (1)..( 9): Result.005 file - promoters50/3435282
atattatca

SEQ ID NO: 183414 - DNA, 9 bp, Unknown
  misc_feature (1)..( 9): Result.005 file - promoters50/3435282
ttaatttct

SEQ ID NO: 183415 - DNA, 9 bp, Unknown
  misc_feature (1)..( 9): Result.005 file - promoters50/3435282
atagattca

SEQ ID NO: 183416 - DNA, 14 bp, Unknown
  misc_feature (1)..( 14): Result.005 file - promoters50/3435282
aattttaaaattta

SEQ ID NO: 183417 - DNA, 14 bp, Unknown
  misc_feature (1)..( 14): Result.005 file - promoters50/3435282
aattgaaaacttta

SEQ ID NO: 183418 - DNA, 14 bp, Unknown
  misc_feature (1)..( 14): Result.005 file - promoters50/3435282
aatattaaaatttg

SEQ ID NO: 183419 - DNA, 14 bp, Unknown
  misc_feature (1)..( 14): Result.005 file - promoters50/3435282
tctgtagaactttc

SEQ ID NO: 183420 - DNA, 15 bp, Unknown
  misc_feature (1)..( 15): Result.005 file - promoters50/3435282
acggatgagatctta

SEQ ID NO: 183421 - DNA, 15 bp, Unknown
  misc_feature (1)..( 15): Result.005 file - promoters50/3435282
atcactgtcatatta

SEQ ID NO: 183422 - DNA, 15 bp, Unknown
  misc_feature (1)..( 15): Result.005 file - promoters50/3435282
tctgctttaatctta

SEQ ID NO: 183423 - DNA, 11 bp, Unknown
  misc_feature (1)..( 11): Result.005 file - promoters50/3435282
ccaagaaatag

SEQ ID NO: 183424 - DNA, 11 bp, Unknown
  misc_feature (1)..( 11): Result.005 file - promoters50/3435282
gttagaaataa

SEQ ID NO: 183425 - DNA, 11 bp, Unknown
  misc_feature (1)..( 11): Result.005 file - promoters50/3435282
ccaataaatcc

SEQ ID NO: 183426 - DNA, 11 bp, Unknown
  misc_feature (1)..( 11): Result.005 file - promoters50/3435282
tgaagatatat

SEQ ID NO: 183427 - DNA, 11 bp, Unknown
  misc_feature (1)..( 11): Result.005 file - promoters50/3435282
aactaaaataa

SEQ ID NO: 183428 - DNA, 12 bp, Unknown
  misc_feature (1)..( 12): Result.005 file - promoters50/3435282
cgaagaagattg

SEQ ID NO: 183429 - DNA, 8 bp, Unknown
  misc_feature (1)..( 8): Result.005 file - promoters50/3435341
attggttt

SEQ ID NO: 183430 - DNA, 8 bp, Unknown
  misc_feature (1)..( 8): Result.005 file - promoters50/3435341
attggtaa

SEQ ID NO: 183431 - DNA, 8 bp, Unknown
  misc_feature (1)..( 8): Result.005 file - promoters50/3435341
tttggttt

SEQ ID NO: 183432 - DNA, 6 bp, Unknown
  misc_feature (1)..( 6): Result.005 file - promoters50/3435372
acatac

SEQ ID NO: 183433 - DNA, 6 bp, Unknown
  misc_feature (1)..( 6): Result.005 file - promoters50/3435372
acatac

SEQ ID NO: 183434 - DNA, 6 bp, Unknown
  misc_feature (1)..( 6): Result.005 file - promoters50/3435372
acatac

SEQ ID NO: 183435 - DNA, 7 bp, Unknown
  misc_feature (1)..( 7): Result.005 file - promoters50/3435424
tttaaaa

SEQ ID NO: 183436 - DNA, 7 bp, Unknown
  misc_feature (1)..( 7): Result.005 file - promoters50/3435424
tttgaaa

SEQ ID NO: 183437 - DNA, 7 bp, Unknown
  misc_feature (1)..( 7): Result.005 file - promoters50/3435424
tttaaat

SEQ ID NO: 183438 - DNA, 8 bp, Unknown
  misc_feature (1)..( 8): Result.005 file - promoters50/3435424
tacttttt

SEQ ID NO: 183439 - DNA, 8 bp, Unknown
  misc_feature (1)..( 8): Result.005 file - promoters50/3435424
tactgttt

SEQ ID NO: 183440 - DNA, 8 bp, Unknown
  misc_feature (1)..( 8): Result.005 file - promoters50/3435424
gacttttt

SEQ ID NO: 183441 - DNA, 8 bp, Unknown
  misc_feature (1)..( 8): Result.005 file - promoters50/3435424
ttaattta

SEQ ID NO: 183442 - DNA, 8 bp, Unknown
  misc_feature (1)..( 8): Result.005 file - promoters50/3435424
ttactttt

SEQ ID NO: 183443 - DNA, 8 bp, Unknown
  misc_feature (1)..( 8): Result.005 file - promoters50/3435424
gtaattta

SEQ ID NO: 183444 - DNA, 14 bp, Unknown
  misc_feature (1)..( 14): Result.005 file - promoters50/3435452
attttgaccgagtc

SEQ ID NO: 183445 - DNA, 14 bp, Unknown
  misc_feature (1)..( 14): Result.005 file - promoters50/3435452
aatttaacccggga

SEQ ID NO: 183446 - DNA, 14 bp, Unknown
  misc_feature (1)..( 14): Result.005 file - promoters50/3435452
tatttatcccttta

SEQ ID NO: 183447 - DNA, 14 bp, Unknown
  misc_feature (1)..( 14): Result.005 file - promoters50/3435452
aaataatcccctta

SEQ ID NO: 183448 - DNA, 14 bp, Unknown
  misc_feature (1)..( 14): Result.005 file - promoters50/3435452
tatttaagtttata

SEQ ID NO: 183449 - DNA, 14 bp, Unknown
  misc_feature (1)..( 14): Result.005 file - promoters50/3435452
gggaaggcccataa

SEQ ID NO: 183450 - DNA, 10 bp, Unknown
  misc_feature (1)..( 10): Result.005 file - promoters50/3435452
aaaaacaatt

SEQ ID NO: 183451 - DNA, 10 bp, Unknown
  misc_feature (1)..( 10): Result.005 file - promoters50/3435452
ggaaacaaat

SEQ ID NO: 183452 - DNA, 10 bp, Unknown
  misc_feature (1)..( 10): Result.005 file - promoters50/3435452
ctaaaaaatc

SEQ ID NO: 183453 - DNA, 10 bp, Unknown
  misc_feature (1)..( 10): Result.005 file - promoters50/3435452
ttaaccaata

SEQ ID NO: 183454 - DNA, 10 bp, Unknown
  misc_feature (1)..( 10): Result.005 file - promoters50/3435452
ggaaccaaat

SEQ ID NO: 183455 - DNA, 10 bp, Unknown
  misc_feature (1)..( 10): Result.005 file - promoters50/3435452
ataataaata

SEQ ID NO: 183456 - DNA, 13 bp, Unknown
  misc_feature (1)..( 13): Result.005 file - promoters50/3435463
ttttggaaactat

SEQ ID NO: 183457 - DNA, 13 bp, Unknown
  misc_feature (1)..( 13): Result.005 file - promoters50/3435463
aattgaaaacttt

SEQ ID NO: 183458 - DNA, 13 bp, Unknown
  misc_feature (1)..( 13): Result.005 file - promoters50/3435463
aggattaaactaa

SEQ ID NO: 183459 - DNA, 13 bp, Unknown
  misc_feature (1)..( 13): Result.005 file - promoters50/3435463
aatagaatagtat

SEQ ID NO: 183460 - DNA, 13 bp, Unknown
  misc_feature (1)..( 13): Result.005 file - promoters50/3435463
aattaaaataaat

SEQ ID NO: 183461 - DNA, 13 bp, Unknown
  misc_feature (1)..( 13): Result.005 file - promoters50/3435463
tttcacaaacaaa

SEQ ID NO: 183462 - DNA, 11 bp, Unknown
  misc_feature (1)..( 11): Result.005 file - promoters50/3435463
atataaacgac

SEQ ID NO: 183463 - DNA, 11 bp, Unknown
  misc_feature (1)..( 11): Result.005 file - promoters50/3435463
atataaagact

SEQ ID NO: 183464 - DNA, 11 bp, Unknown
  misc_feature (1)..( 11): Result.005 file - promoters50/3435463
atataaataag

SEQ ID NO: 183465 - DNA, 11 bp, Unknown
  misc_feature (1)..( 11): Result.005 file - promoters50/3435463
ataaaaaggac

SEQ ID NO: 183466 - DNA, 11 bp, Unknown
  misc_feature (1)..( 11): Result.005 file - promoters50/3435463
atataaactcc

SEQ ID NO: 183467 - DNA, 11 bp, Unknown
  misc_feature (1)..( 11): Result.005 file - promoters50/3435463
atataaaccat

SEQ ID NO: 183468 - DNA, 12 bp, Unknown
  misc_feature (1)..( 12): Result.005 file - promoters50/3435463
accaaatatgat

SEQ ID NO: 183469 - DNA, 12 bp, Unknown
  misc_feature (1)..( 12): Result.005 file - promoters50/3435463
tttaaatttgat

SEQ ID NO: 183470 - DNA, 12 bp, Unknown
  misc_feature (1)..( 12): Result.005 file - promoters50/3435463
tttaaattaatt

SEQ ID NO: 183471 - DNA, 12 bp, Unknown
  misc_feature (1)..( 12): Result.005 file - promoters50/3435463
agaaaataataa

SEQ ID NO: 183472 - DNA, 12 bp, Unknown
  misc_feature (1)..( 12): Result.005 file - promoters50/3435463
aaaaaaaaatac

SEQ ID NO: 183473 - DNA, 12 bp, Unknown
  misc_feature (1)..( 12): Result.005 file - promoters50/3435463
ataaaaaaatct

SEQ ID NO: 183474 - DNA, 16 bp, Unknown
  misc_feature (1)..( 16): Result.005 file - promoters50/3435463
aaaattaacataattt

SEQ ID NO: 183475 - DNA, 16 bp, Unknown
  misc_feature (1)..( 16): Result.005 file - promoters50/3435463
ccctgtcgcataatat

SEQ ID NO: 183476 - DNA, 16 bp, Unknown
  misc_feature (1)..( 16): Result.005 file - promoters50/3435463
aaaattaaaataaatc

SEQ ID NO: 183477 - DNA, 16 bp, Unknown
  misc_feature (1)..( 16): Result.005 file - promoters50/3435463
aggattaaactaatgt

SEQ ID NO: 183478 - DNA, 16 bp, Unknown
  misc_feature (1)..( 16): Result.005 file - promoters50/3435463
ataaatagaatagtat

SEQ ID NO: 183479 - DNA, 16 bp, Unknown
  misc_feature (1)..( 16): Result.005 file - promoters50/3435463
ctttcacaaacaaaca

SEQ ID NO: 183480 - DNA, 11 bp, Unknown
  misc_feature (1)..( 11): Result.005 file - promoters50/3435463
tttgcaaaatt

SEQ ID NO: 183481 - DNA, 11 bp, Unknown
  misc_feature (1)..( 11): Result.005 file - promoters50/3435463
gaagcaagatt

SEQ ID NO: 183482 - DNA, 11 bp, Unknown
  misc_feature (1)..( 11): Result.005 file - promoters50/3435463
tttggaaatat

SEQ ID NO: 183483 - DNA, 11 bp, Unknown
  misc_feature (1)..( 11): Result.005 file - promoters50/3435463
ttttcaaactt

SEQ ID NO: 183484 - DNA, 11 bp, Unknown
  misc_feature (1)..( 11): Result.005 file - promoters50/3435463
aattcaaaacc

SEQ ID NO: 183485 - DNA, 11 bp, Unknown
  misc_feature (1)..( 11): Result.005 file - promoters50/3435463
tttagaatgcg

SEQ ID NO: 183486 - DNA, 14 bp, Unknown
  misc_feature (1)..( 14): Result.005 file - promoters50/3435463
ataatacaaatatc

SEQ ID NO: 183487 - DNA, 14 bp, Unknown
  misc_feature (1)..( 14): Result.005 file - promoters50/3435463
aaaatacattagga

SEQ ID NO: 183488 - DNA, 14 bp, Unknown
  misc_feature (1)..( 14): Result.005 file - promoters50/3435463
ttcataaaaaaatc

SEQ ID NO: 183489 - DNA, 14 bp, Unknown
  misc_feature (1)..( 14): Result.005 file - promoters50/3435463
aaaatccttgtagc

SEQ ID NO: 183490 - DNA, 14 bp, Unknown
  misc_feature (1)..( 14): Result.005 file - promoters50/3435463
taaatcctagaatc

SEQ ID NO: 183491 - DNA, 14 bp, Unknown
  misc_feature (1)..( 14): Result.005 file - promoters50/3435463
aaaataataatcta

SEQ ID NO: 183492 - DNA, 10 bp, Unknown
  misc_feature (1)..( 10): Result.005 file - promoters50/3435469
gtactttttt

SEQ ID NO: 183493 - DNA, 10 bp, Unknown
  misc_feature (1)..( 10): Result.005 file - promoters50/3435469
tgacttttct

SEQ ID NO: 183494 - DNA, 10 bp, Unknown
  misc_feature (1)..( 10): Result.005 file - promoters50/3435469
gtaatttcaa

SEQ ID NO: 183495 - DNA, 10 bp, Unknown
  misc_feature (1)..( 10): Result.005 file - promoters50/3435469
aaactttttt

SEQ ID NO: 183496 - DNA, 10 bp, Unknown
  misc_feature (1)..( 10): Result.005 file - promoters50/3435469
aaagttttga

SEQ ID NO: 183497 - DNA, 10 bp, Unknown
  misc_feature (1)..( 10): Result.005 file - promoters50/3435469
aaaatatcaa

SEQ ID NO: 183498 - DNA, 9 bp, Unknown
  misc_feature (1)..( 9): Result.005 file - promoters50/3435469
tttttctta

SEQ ID NO: 183499 - DNA, 9 bp, Unknown
  misc_feature (1)..( 9): Result.005 file - promoters50/3435469
cttttcttt

SEQ ID NO: 183500 - DNA, 9 bp, Unknown
  misc_feature (1)..( 9): Result.005 file - promoters50/3435469
aatttatta

SEQ ID NO: 183501 - DNA, 9 bp, Unknown
  misc_feature (1)..( 9): Result.005 file - promoters50/3435469
tttttctaa

SEQ ID NO: 183502 - DNA, 9 bp, Unknown
  misc_feature (1)..( 9): Result.005 file - promoters50/3435469
cttttttta

SEQ ID NO: 183503 - DNA, 9 bp, Unknown
  misc_feature (1)..( 9): Result.005 file - promoters50/3435469
catttatat

SEQ ID NO: 183504 - DNA, 9 bp, Unknown
  misc_feature (1)..( 9): Result.005 file - promoters50/3435469
tttttagtc

SEQ ID NO: 183505 - DNA, 11 bp, Unknown
  misc_feature (1)..( 11): Result.005 file - promoters50/3435469
ggatttacttg

SEQ ID NO: 183506 - DNA, 11 bp, Unknown
  misc_feature (1)..( 11): Result.005 file - promoters50/3435469
agatatacatt

SEQ ID NO: 183507 - DNA, 11 bp, Unknown
  misc_feature (1)..( 11): Result.005 file - promoters50/3435469
cggttttgata

SEQ ID NO: 183508 - DNA, 11 bp, Unknown
  misc_feature (1)..( 11): Result.005 file - promoters50/3435469
agaaatagaac

SEQ ID NO: 183509 - DNA, 11 bp, Unknown
  misc_feature (1)..( 11): Result.005 file - promoters50/3435469
ttctataaatt

SEQ ID NO: 183510 - DNA, 11 bp, Unknown
  misc_feature (1)..( 11): Result.005 file - promoters50/3435469
agagctaaaaa

SEQ ID NO: 183511 - DNA, 11 bp, Unknown
  misc_feature (1)..( 11): Result.005 file - promoters50/3435469
tgagatgtttg

SEQ ID NO: 183512 - DNA, 11 bp, Unknown
  misc_feature (1)..( 11): Result.005 file - promoters50/3435469
ctagattttta

SEQ ID NO: 183513 - DNA, 11 bp, Unknown
  misc_feature (1)..( 11): Result.005 file - promoters50/3435469
ctagagtttcc

SEQ ID NO: 183514 - DNA, 11 bp, Unknown
  misc_feature (1)..( 11): Result.005 file - promoters50/3435469
aacaatttttc

SEQ ID NO: 183515 - DNA, 11 bp, Unknown
  misc_feature (1)..( 11): Result.005 file - promoters50/3435469
acgttttttta

SEQ ID NO: 183516 - DNA, 11 bp, Unknown
  misc_feature (1)..( 11): Result.005 file - promoters50/3435469
gtagtgttcat

SEQ ID NO: 183517 - DNA, 11 bp, Unknown
  misc_feature (1)..( 11): Result.005 file - promoters50/3435469
ccatatttttt

SEQ ID NO: 183518 - DNA, 11 bp, Unknown
  misc_feature (1)..( 11): Result.005 file - promoters50/3435469
ttttgtttctc

SEQ ID NO: 183519 - DNA, 11 bp, Unknown
  misc_feature (1)..( 11): Result.005 file - promoters50/3435469
gattgttttcg

SEQ ID NO: 183520 - DNA, 11 bp, Unknown
  misc_feature (1)..( 11): Result.005 file - promoters50/3435469
tatttttttct

SEQ ID NO: 183521 - DNA, 11 bp, Unknown
  misc_feature (1)..( 11): Result.005 file - promoters50/3435469
aaatgtttctc

SEQ ID NO: 183522 - DNA, 11 bp, Unknown
  misc_feature (1)..( 11): Result.005 file - promoters50/3435469
aattgtttaag

SEQ ID NO: 183523 - DNA, 11 bp, Unknown
  misc_feature (1)..( 11): Result.005 file - promoters50/3435469
tattttttaaa

SEQ ID NO: 183524 - DNA, 12 bp, Unknown
  misc_feature (1)..( 12): Result.005 file - promoters50/3435469
acaatataaaca

SEQ ID NO: 183525 - DNA, 12 bp, Unknown
  misc_feature (1)..( 12): Result.005 file - promoters50/3435469
ctcatataaata

SEQ ID NO: 183526 - DNA, 12 bp, Unknown
  misc_feature (1)..( 12): Result.005 file - promoters50/3435469
tatatataaaga

SEQ ID NO: 183527 - DNA, 12 bp, Unknown
  misc_feature (1)..( 12): Result.005 file - promoters50/3435469
catatatataca

SEQ ID NO: 183528 - DNA, 12 bp, Unknown
  misc_feature (1)..( 12): Result.005 file - promoters50/3435469
ctcatatatatc

SEQ ID NO: 183529 - DNA, 12 bp, Unknown
  misc_feature (1)..( 12): Result.005 file - promoters50/3435469
tttatttaacgg

SEQ ID NO: 183530 - DNA, 11 bp, Unknown
  misc_feature (1)..( 11): Result.005 file - promoters50/3435469
tgacttgtttt

SEQ ID NO: 183531 - DNA, 11 bp, Unknown
  misc_feature (1)..( 11): Result.005 file - promoters50/3435469
ctacttgtata

SEQ ID NO: 183532 - DNA, 11 bp, Unknown
  misc_feature (1)..( 11): Result.005 file - promoters50/3435469
aaacttttttt

SEQ ID NO: 183533 - DNA, 11 bp, Unknown
  misc_feature (1)..( 11): Result.005 file - promoters50/3435469
aaagttttgag

SEQ ID NO: 183534 - DNA, 11 bp, Unknown
  misc_feature (1)..( 11): Result.005 file - promoters50/3435469
taacttgaata

SEQ ID NO: 183535 - DNA, 11 bp, Unknown
  misc_feature (1)..( 11): Result.005 file - promoters50/3435469
caaattttttt

SEQ ID NO: 183536 - DNA, 11 bp, Unknown
  misc_feature (1)..( 11): Result.005 file - promoters50/3435514
gaaataaaaat

SEQ ID NO: 183537 - DNA, 11 bp, Unknown
  misc_feature (1)..( 11): Result.005 file - promoters50/3435514
gaaaaaaaaaa

SEQ ID NO: 183538 - DNA, 11 bp, Unknown
  misc_feature (1)..( 11): Result.005 file - promoters50/3435514
catatcaaatt

SEQ ID NO: 183539 - DNA, 11 bp, Unknown
  misc_feature (1)..( 11): Result.005 file - promoters50/3435514
tcaatcaaatt

SEQ ID NO: 183540 - DNA, 11 bp, Unknown
  misc_feature (1)..( 11): Result.005 file - promoters50/3435514
tcaatcaatca

SEQ ID NO: 183541 - DNA, 10 bp, Unknown
  misc_feature (1)..( 10): Result.005 file - promoters50/3435514
tttattttct

SEQ ID NO: 183542 - DNA, 10 bp, Unknown
  misc_feature (1)..( 10): Result.005 file - promoters50/3435514
tttctttgct

SEQ ID NO: 183543 - DNA, 10 bp, Unknown
  misc_feature (1)..( 10): Result.005 file - promoters50/3435514
tttgttttct

SEQ ID NO: 183544 - DNA, 10 bp, Unknown
  misc_feature (1)..( 10): Result.005 file - promoters50/3435514
tttttttaaa

SEQ ID NO: 183545 - DNA, 10 bp, Unknown
  misc_feature (1)..( 10): Result.005 file - promoters50/3435514
catctttgtg

SEQ ID NO: 183546 - DNA, 13 bp, Unknown
  misc_feature (1)..( 13): Result.005 file - promoters50/3435514
gtctattttgtca

SEQ ID NO: 183547 - DNA, 13 bp, Unknown
  misc_feature (1)..( 13): Result.005 file - promoters50/3435514
gatggttttgtac

SEQ ID NO: 183548 - DNA, 13 bp, Unknown
  misc_feature (1)..( 13): Result.005 file - promoters50/3435514
aaaaattgtgtca

SEQ ID NO: 183549 - DNA, 13 bp, Unknown
  misc_feature (1)..( 13): Result.005 file - promoters50/3435514
gtcaatttagtcc

SEQ ID NO: 183550 - DNA, 13 bp, Unknown
  misc_feature (1)..( 13): Result.005 file - promoters50/3435514
aacaatttgactg

SEQ ID NO: 183551 - DNA, 9 bp, Unknown
  misc_feature (1)..( 9): Result.005 file - promoters50/3435518
ttgaggatc

SEQ ID NO: 183552 - DNA, 9 bp, Unknown
  misc_feature (1)..( 9): Result.005 file - promoters50/3435518
aagaggatc

SEQ ID NO: 183553 - DNA, 9 bp, Unknown
  misc_feature (1)..( 9): Result.005 file - promoters50/3435518
aagtggatt

SEQ ID NO: 183554 - DNA, 8 bp, Unknown
  misc_feature (1)..( 8): Result.005 file - promoters50/3435518
ttgctgac

SEQ ID NO: 183555 - DNA, 8 bp, Unknown
  misc_feature (1)..( 8): Result.005 file - promoters50/3435518
ttgctgat

SEQ ID NO: 183556 - DNA, 8 bp, Unknown
  misc_feature (1)..( 8): Result.005 file - promoters50/3435518
tagctgac

SEQ ID NO: 183557 - DNA, 10 bp, Unknown
  misc_feature (1)..( 10): Result.005 file - promoters50/3435518
gtaggcagta

SEQ ID NO: 183558 - DNA, 10 bp, Unknown
  misc_feature (1)..( 10): Result.005 file - promoters50/3435518
agaggaagta

SEQ ID NO: 183559 - DNA, 10 bp, Unknown
  misc_feature (1)..( 10): Result.005 file - promoters50/3435518
agacgaacac

SEQ ID NO: 183560 - DNA, 9 bp, Unknown
  misc_feature (1)..( 9): Result.005 file - promoters50/3435534
tttcgtttt

SEQ ID NO: 183561 - DNA, 9 bp, Unknown
  misc_feature (1)..( 9): Result.005 file - promoters50/3435534
aaacgtttt

SEQ ID NO: 183562 - DNA, 9 bp, Unknown
  misc_feature (1)..( 9): Result.005 file - promoters50/3435534
gttcttttt

SEQ ID NO: 183563 - DNA, 9 bp, Unknown
  misc_feature (1)..( 9): Result.005 file - promoters50/3435534
ttacttttt

SEQ ID NO: 183564 - DNA, 9 bp, Unknown
  misc_feature (1)..( 9): Result.005 file - promoters50/3435534
tttcttttg

SEQ ID NO: 183565 - DNA, 9 bp, Unknown
  misc_feature (1)..( 9): Result.005 file - promoters50/3435534
ttacatttg

SEQ ID NO: 183566 - DNA, 6 bp, Unknown
  misc_feature (1)..( 6): Result.005 file - promoters50/3435578
tatcaa

SEQ ID NO: 183567 - DNA, 6 bp, Unknown
  misc_feature (1)..( 6): Result.005 file - promoters50/3435578
tatcaa

SEQ ID NO: 183568 - DNA, 6 bp, Unknown
  misc_feature (1)..( 6): Result.005 file - promoters50/3435578
tatcaa

SEQ ID NO: 183569 - DNA, 12 bp, Unknown
  misc_feature (1)..( 12): Result.005 file - promoters50/3435578
aaaacatttgac

SEQ ID NO: 183570 - DNA, 12 bp, Unknown
  misc_feature (1)..( 12): Result.005 file - promoters50/3435578
tgcacattcgac

SEQ ID NO: 183571 - DNA, 12 bp, Unknown
  misc_feature (1)..( 12): Result.005 file - promoters50/3435578
ttgaaattacca

SEQ ID NO: 183572 - DNA, 8 bp, Unknown
  misc_feature (1)..( 8): Result.005 file - promoters50/3435578
ttcacaca

SEQ ID NO: 183573 - DNA, 8 bp, Unknown
  misc_feature (1)..( 8): Result.005 file - promoters50/3435578
ttcacaaa

SEQ ID NO: 183574 - DNA, 8 bp, Unknown
  misc_feature (1)..( 8): Result.005 file - promoters50/3435578
ttcaaaaa

SEQ ID NO: 183575 - DNA, 10 bp, Unknown
  misc_feature (1)..( 10): Result.005 file - promoters50/3435578
cacacacact

SEQ ID NO: 183576 - DNA, 10 bp, Unknown
  misc_feature (1)..( 10): Result.005 file - promoters50/3435578
ttcacaaact

SEQ ID NO: 183577 - DNA, 10 bp, Unknown
  misc_feature (1)..( 10): Result.005 file - promoters50/3435578
ttcaaaaaat

SEQ ID NO: 183578 - DNA, 10 bp, Unknown
  misc_feature (1)..( 10): Result.005 file - promoters50/3435605
tgtattctaa

SEQ ID NO: 183579 - DNA, 10 bp, Unknown
  misc_feature (1)..( 10): Result.005 file - promoters50/3435605
tttattctat

SEQ ID NO: 183580 - DNA, 10 bp, Unknown
  misc_feature (1)..( 10): Result.005 file - promoters50/3435605
tttcttcatc

SEQ ID NO: 183581 - DNA, 10 bp, Unknown
  misc_feature (1)..( 10): Result.005 file - promoters50/3435605
attaatctca

SEQ ID NO: 183582 - DNA, 10 bp, Unknown
  misc_feature (1)..( 10): Result.005 file - promoters50/3435605
taaaatatca

SEQ ID NO: 183583 - DNA, 10 bp, Unknown
  misc_feature (1)..( 10): Result.005 file - promoters50/3435605
tagtatatca

SEQ ID NO: 183584 - DNA, 10 bp, Unknown
  misc_feature (1)..( 10): Result.005 file - promoters50/3435605
tccaaaaaag

SEQ ID NO: 183585 - DNA, 10 bp, Unknown
  misc_feature (1)..( 10): Result.005 file - promoters50/3435605
atcaaaaata

SEQ ID NO: 183586 - DNA, 10 bp, Unknown
  misc_feature (1)..( 10): Result.005 file - promoters50/3435605
aataaaaaac

SEQ ID NO: 183587 - DNA, 10 bp, Unknown
  misc_feature (1)..( 10): Result.005 file - promoters50/3435605
tggaaacact

SEQ ID NO: 183588 - DNA, 10 bp, Unknown
  misc_feature (1)..( 10): Result.005 file - promoters50/3435605
atcaaaatta

SEQ ID NO: 183589 - DNA, 10 bp, Unknown
  misc_feature (1)..( 10): Result.005 file - promoters50/3435605
atcaaaccga

SEQ ID NO: 183590 - DNA, 12 bp, Unknown
  misc_feature (1)..( 12): Result.005 file - promoters50/3435605
cctttattaaat

SEQ ID NO: 183591 - DNA, 12 bp, Unknown
  misc_feature (1)..( 12): Result.005 file - promoters50/3435605
tatttatttcct

SEQ ID NO: 183592 - DNA, 12 bp, Unknown
  misc_feature (1)..( 12): Result.005 file - promoters50/3435605
agtttattggaa

SEQ ID NO: 183593 - DNA, 12 bp, Unknown
  misc_feature (1)..( 12): Result.005 file - promoters50/3435605
acattataaaat

SEQ ID NO: 183594 - DNA, 12 bp, Unknown
  misc_feature (1)..( 12): Result.005 file - promoters50/3435605
aaggtatcaaac

SEQ ID NO: 183595 - DNA, 12 bp, Unknown
  misc_feature (1)..( 12): Result.005 file - promoters50/3435605
aaaatatcaata

SEQ ID NO: 183596 - DNA, 12 bp, Unknown
  misc_feature (1)..( 12): Result.005 file - promoters50/3435605
acattaaaaaaa

SEQ ID NO: 183597 - DNA, 9 bp, Unknown
  misc_feature (1)..( 9): Result.005 file - promoters50/3435605
ttattaaat

SEQ ID NO: 183598 - DNA, 9 bp, Unknown
  misc_feature (1)..( 9): Result.005 file - promoters50/3435605
gtatcaaac

SEQ ID NO: 183599 - DNA, 9 bp, Unknown
  misc_feature (1)..( 9): Result.005 file - promoters50/3435605
acattaaaa

SEQ ID NO: 183600 - DNA, 9 bp, Unknown
  misc_feature (1)..( 9): Result.005 file - promoters50/3435605
ttataaaat

SEQ ID NO: 183601 - DNA, 9 bp, Unknown
  misc_feature (1)..( 9): Result.005 file - promoters50/3435605
ttataatca

SEQ ID NO: 183602 - DNA, 9 bp, Unknown
  misc_feature (1)..( 9): Result.005 file - promoters50/3435605
atatcaata

SEQ ID NO: 183603 - DNA, 14 bp, Unknown
  misc_feature (1)..( 14): Result.005 file - promoters50/3435632
aaaattactcttaa

SEQ ID NO: 183604 - DNA, 14 bp, Unknown
  misc_feature (1)..( 14): Result.005 file - promoters50/3435632
taaactacacatag

SEQ ID NO: 183605 - DNA, 14 bp, Unknown
  misc_feature (1)..( 14): Result.005 file - promoters50/3435632
aaaaatactttgca

SEQ ID NO: 183606 - DNA, 14 bp, Unknown
  misc_feature (1)..( 14): Result.005 file - promoters50/3435632
aataataaaacatt

SEQ ID NO: 183607 - DNA, 14 bp, Unknown
  misc_feature (1)..( 14): Result.005 file - promoters50/3435632
gaaaatacccggag

SEQ ID NO: 183608 - DNA, 14 bp, Unknown
  misc_feature (1)..( 14): Result.005 file - promoters50/3435632
ttcactagacatgt

SEQ ID NO: 183609 - DNA, 12 bp, Unknown
  misc_feature (1)..( 12): Result.005 file - promoters50/3435632
taacaaaaaatt

SEQ ID NO: 183610 - DNA, 12 bp, Unknown
  misc_feature (1)..( 12): Result.005 file - promoters50/3435632
aaaataaaaatg

SEQ ID NO: 183611 - DNA, 13 bp, Unknown
  misc_feature (1)..( 13): Result.005 file - promoters50/3435632
ataataaaacatt

SEQ ID NO: 183612 - DNA, 13 bp, Unknown
  misc_feature (1)..( 13): Result.005 file - promoters50/3435632
tggataaaatttt

SEQ ID NO: 183613 - DNA, 13 bp, Unknown
  misc_feature (1)..( 13): Result.005 file - promoters50/3435632
attataatatttc

SEQ ID NO: 183614 - DNA, 13 bp, Unknown
  misc_feature (1)..( 13): Result.005 file - promoters50/3435632
aaggtaaaccatg

SEQ ID NO: 183615 - DNA, 13 bp, Unknown
  misc_feature (1)..( 13): Result.005 file - promoters50/3435632
ataacaaaaaatt

SEQ ID NO: 183616 - DNA, 13 bp, Unknown
  misc_feature (1)..( 13): Result.005 file - promoters50/3435632
acctcaaaaatga

SEQ ID NO: 183617 - DNA, 13 bp, Unknown
  misc_feature (1)..( 13): Result.005 file - promoters50/3435632
ataataaaacatt

SEQ ID NO: 183618 - DNA, 13 bp, Unknown
  misc_feature (1)..( 13): Result.005 file - promoters50/3435632
atggataaacatg

SEQ ID NO: 183619 - DNA, 13 bp, Unknown
  misc_feature (1)..( 13): Result.005 file - promoters50/3435632
tggataaaatttt

SEQ ID NO: 183620 - DNA, 13 bp, Unknown
  misc_feature (1)..( 13): Result.005 file - promoters50/3435632
attataatatttc

SEQ ID NO: 183621 - DNA, 13 bp, Unknown
  misc_feature (1)..( 13): Result.005 file - promoters50/3435632
aaggtaaaccatg

SEQ ID NO: 183622 - DNA, 7 bp, Unknown
  misc_feature (1)..( 7): Result.005 file - promoters50/3435723
aaacagt

SEQ ID NO: 183623 - DNA, 7 bp, Unknown
  misc_feature (1)..( 7): Result.005 file - promoters50/3435723
aaacaga

SEQ ID NO: 183624 - DNA, 7 bp, Unknown
  misc_feature (1)..( 7): Result.005 file - promoters50/3435723
aaagaga

SEQ ID NO: 183625 - DNA, 12 bp, Unknown
  misc_feature (1)..( 12): Result.005 file - promoters50/3435761
tttgattttttc

SEQ ID NO: 183626 - DNA, 12 bp, Unknown
  misc_feature (1)..( 12): Result.005 file - promoters50/3435761
gatgatttgagg

SEQ ID NO: 183627 - DNA, 12 bp, Unknown
  misc_feature (1)..( 12): Result.005 file - promoters50/3435761
tttcattttatt

SEQ ID NO: 183628 - DNA, 13 bp, Unknown
  misc_feature (1)..( 13): Result.005 file - promoters50/3435761
cgtgagttttttt

SEQ ID NO: 183629 - DNA, 13 bp, Unknown
  misc_feature (1)..( 13): Result.005 file - promoters50/3435761
aaaccattttggg

SEQ ID NO: 183630 - DNA, 13 bp, Unknown
  misc_feature (1)..( 13): Result.005 file - promoters50/3435761
gcactatttcaaa

SEQ ID NO: 183631 - DNA, 10 bp, Unknown
  misc_feature (1)..( 10): Result.005 file - promoters50/3435761
ttctttggat

SEQ ID NO: 183632 - DNA, 10 bp, Unknown
  misc_feature (1)..( 10): Result.005 file - promoters50/3435761
gggtttcgat

SEQ ID NO: 183633 - DNA, 10 bp, Unknown
  misc_feature (1)..( 10): Result.005 file - promoters50/3435761
atctttagat

SEQ ID NO: 183634 - DNA, 10 bp, Unknown
  misc_feature (1)..( 10): Result.005 file - promoters50/3435761
agagttggat

SEQ ID NO: 183635 - DNA, 10 bp, Unknown
  misc_feature (1)..( 10): Result.005 file - promoters50/3435761
accgttggat

SEQ ID NO: 183636 - DNA, 10 bp, Unknown
  misc_feature (1)..( 10): Result.005 file - promoters50/3435761
atcttcagac

SEQ ID NO: 183637 - DNA, 11 bp, Unknown
  misc_feature (1)..( 11): Result.005 file - promoters50/3435765
ccattttaaac

SEQ ID NO: 183638 - DNA, 11 bp, Unknown
  misc_feature (1)..( 11): Result.005 file - promoters50/3435765
ccatttagttt

SEQ ID NO: 183639 - DNA, 11 bp, Unknown
  misc_feature (1)..( 11): Result.005 file - promoters50/3435765
ccatttaattt

SEQ ID NO: 183640 - DNA, 11 bp, Unknown
  misc_feature (1)..( 11): Result.005 file - promoters50/3435765
tcatttgaaac

SEQ ID NO: 183641 - DNA, 11 bp, Unknown
  misc_feature (1)..( 11): Result.005 file - promoters50/3435765
tgtttttaaat

SEQ ID NO: 183642 - DNA, 11 bp, Unknown
  misc_feature (1)..( 11): Result.005 file - promoters50/3435765
gcatataatta

SEQ ID NO: 183643 - DNA, 9 bp, Unknown
  misc_feature (1)..( 9): Result.005 file - promoters50/3435765
gttttataa

SEQ ID NO: 183644 - DNA, 9 bp, Unknown
  misc_feature (1)..( 9): Result.005 file - promoters50/3435765
tttttatga

SEQ ID NO: 183645 - DNA, 9 bp, Unknown
  misc_feature (1)..( 9): Result.005 file - promoters50/3435765
tttttaaat

SEQ ID NO: 183646 - DNA, 9 bp, Unknown
  misc_feature (1)..( 9): Result.005 file - promoters50/3435765
gttttatga

SEQ ID NO: 183647 - DNA, 9 bp, Unknown
  misc_feature (1)..( 9): Result.005 file - promoters50/3435765
ctttaatga

SEQ ID NO: 183648 - DNA, 9 bp, Unknown
  misc_feature (1)..( 9): Result.005 file - promoters50/3435765
atttaattt

SEQ ID NO: 183649 - DNA, 10 bp, Unknown
  misc_feature (1)..( 10): Result.005 file - promoters50/3435765
ataaaataaa

SEQ ID NO: 183650 - DNA, 10 bp, Unknown
  misc_feature (1)..( 10): Result.005 file - promoters50/3435765
atacaataat

SEQ ID NO: 183651 - DNA, 10 bp, Unknown
  misc_feature (1)..( 10): Result.005 file - promoters50/3435765
atataattaa

SEQ ID NO: 183652 - DNA, 10 bp, Unknown
  misc_feature (1)..( 10): Result.005 file - promoters50/3435765
ataacataga

SEQ ID NO: 183653 - DNA, 10 bp, Unknown
  misc_feature (1)..( 10): Result.005 file - promoters50/3435765
aggaaataaa

SEQ ID NO: 183654 - DNA, 10 bp, Unknown
  misc_feature (1)..( 10): Result.005 file - promoters50/3435765
ataaaataaa

SEQ ID NO: 183655 - DNA, 10 bp, Unknown
  misc_feature (1)..( 10): Result.005 file - promoters50/3435765
atataattaa

SEQ ID NO: 183656 - DNA, 10 bp, Unknown
  misc_feature (1)..( 10): Result.005 file - promoters50/3435765
ataacataga

SEQ ID NO: 183657 - DNA, 10 bp, Unknown
  misc_feature (1)..( 10): Result.005 file - promoters50/3435765
ttatgattaa

SEQ ID NO: 183658 - DNA, 10 bp, Unknown
  misc_feature (1)..( 10): Result.005 file - promoters50/3435765
gtaacttagg

SEQ ID NO: 183659 - DNA, 8 bp, Unknown
  misc_feature (1)..( 8): Result.005 file - promoters50/3435765
tatagttt

SEQ ID NO: 183660 - DNA, 8 bp, Unknown
  misc_feature (1)..( 8): Result.005 file - promoters50/3435765
aataattt

SEQ ID NO: 183661 - DNA, 8 bp, Unknown
  misc_feature (1)..( 8): Result.005 file - promoters50/3435765
aataatta

SEQ ID NO: 183662 - DNA, 8 bp, Unknown
  misc_feature (1)..( 8): Result.005 file - promoters50/3435765
tatactta

SEQ ID NO: 183663 - DNA, 8 bp, Unknown
  misc_feature (1)..( 8): Result.005 file - promoters50/3435765
gacagtaa

SEQ ID NO: 183664 - DNA, 9 bp, Unknown
  misc_feature (1)..( 9): Result.005 file - promoters50/3435765
ttttatgat

SEQ ID NO: 183665 - DNA, 9 bp, Unknown
  misc_feature (1)..( 9): Result.005 file - promoters50/3435765
aattatgat

SEQ ID NO: 183666 - DNA, 9 bp, Unknown
  misc_feature (1)..( 9): Result.005 file - promoters50/3435765
ttttatgaa

SEQ ID NO: 183667 - DNA, 9 bp, Unknown
  misc_feature (1)..( 9): Result.005 file - promoters50/3435765
tttaatgaa

SEQ ID NO: 183668 - DNA, 9 bp, Unknown
  misc_feature (1)..( 9): Result.005 file - promoters50/3435765
tttaatttt

SEQ ID NO: 183669 - DNA, 9 bp, Unknown
  misc_feature (1)..( 9): Result.005 file - promoters50/3435803
gtttttctg

SEQ ID NO: 183670 - DNA, 9 bp, Unknown
  misc_feature (1)..( 9): Result.005 file - promoters50/3435803
ttttgtcta

SEQ ID NO: 183671 - DNA, 10 bp, Unknown
  misc_feature (1)..( 10): Result.005 file - promoters50/3435803
ttattttctg

SEQ ID NO: 183672 - DNA, 9 bp, Unknown
  misc_feature (1)..( 9): Result.005 file - promoters50/3435803
atttgtcgt

SEQ ID NO: 183673 - DNA, 10 bp, Unknown
  misc_feature (1)..( 10): Result.005 file - promoters50/3435803
gttctgtttc

SEQ ID NO: 183674 - DNA, 12 bp, Unknown
  misc_feature (1)..( 12): Result.005 file - promoters50/3435833
ataaaagtttgt

SEQ ID NO: 183675 - DNA, 12 bp, Unknown
  misc_feature (1)..( 12): Result.005 file - promoters50/3435833
ttcaaactttca

SEQ ID NO: 183676 - DNA, 12 bp, Unknown
  misc_feature (1)..( 12): Result.005 file - promoters50/3435833
agaaaagtaaga

SEQ ID NO: 183677 - DNA, 12 bp, Unknown
  misc_feature (1)..( 12): Result.005 file - promoters50/3435833
ctcacactaaac

SEQ ID NO: 183678 - DNA, 12 bp, Unknown
  misc_feature (1)..( 12): Result.005 file - promoters50/3435833
agaaaaataacc

SEQ ID NO: 183679 - DNA, 12 bp, Unknown
  misc_feature (1)..( 12): Result.005 file - promoters50/3435833
aataaattaatc

SEQ ID NO: 183680 - DNA, 12 bp, Unknown
  misc_feature (1)..( 12): Result.005 file - promoters50/3435833
acgagattcatc

SEQ ID NO: 183681 - DNA, 14 bp, Unknown
  misc_feature (1)..( 14): Result.005 file - promoters50/3435833
ataataaaagtttg

SEQ ID NO: 183682 - DNA, 14 bp, Unknown
  misc_feature (1)..( 14): Result.005 file - promoters50/3435833
ttaagaaaaataac

SEQ ID NO: 183683 - DNA, 14 bp, Unknown
  misc_feature (1)..( 14): Result.005 file - promoters50/3435833
ttacgaaacgtcac

SEQ ID NO: 183684 - DNA, 14 bp, Unknown
  misc_feature (1)..( 14): Result.005 file - promoters50/3435833
ttgagaaaagtaag

SEQ ID NO: 183685 - DNA, 14 bp, Unknown
  misc_feature (1)..( 14): Result.005 file - promoters50/3435833
taaataaattaatc

SEQ ID NO: 183686 - DNA, 14 bp, Unknown
  misc_feature (1)..( 14): Result.005 file - promoters50/3435833
tgacgagattcatc

SEQ ID NO: 183687 - DNA, 20 bp, Unknown
  misc_feature (1)..( 20): Result.005 file - promoters50/3435833
atttagtgggcttaaagtgt

SEQ ID NO: 183688 - DNA, 20 bp, Unknown
  misc_feature (1)..( 20): Result.005 file - promoters50/3435833
tatacttgggcctaaatact

SEQ ID NO: 183689 - DNA, 20 bp, Unknown
  misc_feature (1)..( 20): Result.005 file - promoters50/3435833
ttttggtgagcttaatggcc

SEQ ID NO: 183690 - DNA, 20 bp, Unknown
  misc_feature (1)..( 20): Result.005 file - promoters50/3435833
catttacaagcccaaagaat

SEQ ID NO: 183691 - DNA, 20 bp, Unknown
  misc_feature (1)..( 20): Result.005 file - promoters50/3435833
ttttggatttaacaaaagtt

SEQ ID NO: 183692 - DNA, 20 bp, Unknown
  misc_feature (1)..( 20): Result.005 file - promoters50/3435833
gattaataagggtatatttg

SEQ ID NO: 183693 - DNA, 10 bp, Unknown
  misc_feature (1)..( 10): Result.005 file - promoters50/3435891
tgttttcact

SEQ ID NO: 183694 - DNA, 10 bp, Unknown
  misc_feature (1)..( 10): Result.005 file - promoters50/3435891
taattttact

SEQ ID NO: 183695 - DNA, 10 bp, Unknown
  misc_feature (1)..( 10): Result.005 file - promoters50/3435891
tgtattcacc

SEQ ID NO: 183696 - DNA, 9 bp, Unknown
  misc_feature (1)..( 9): Result.005 file - promoters50/3435891
aactcttta

SEQ ID NO: 183697 - DNA, 9 bp, Unknown
  misc_feature (1)..( 9): Result.005 file - promoters50/3435891
aactttttt

SEQ ID NO: 183698 - DNA, 10 bp, Unknown
  misc_feature (1)..( 10): Result.005 file - promoters50/3435891
tgttttatta

SEQ ID NO: 183699 - DNA, 7 bp, Unknown
  misc_feature (1)..( 7): Result.005 file - promoters50/3435891
acaaaaa

SEQ ID NO: 183700 - DNA, 7 bp, Unknown
  misc_feature (1)..( 7): Result.005 file - promoters50/3435891
tcaaaaa

SEQ ID NO: 183701 - DNA, 7 bp, Unknown
  misc_feature (1)..( 7): Result.005 file - promoters50/3435891
acaaaaa

SEQ ID NO: 183702 - DNA, 7 bp, Unknown
  misc_feature (1)..( 7): Result.005 file - promoters50/3435891
tttattg

SEQ ID NO: 183703 - DNA, 7 bp, Unknown
  misc_feature (1)..( 7): Result.005 file - promoters50/3435891
tttatta

SEQ ID NO: 183704 - DNA, 7 bp, Unknown
  misc_feature (1)..( 7): Result.005 file - promoters50/3435891
tttttta

SEQ ID NO: 183705 - DNA, 9 bp, Unknown
  misc_feature (1)..( 9): Result.005 file - promoters50/3435891
ttgtctaag

SEQ ID NO: 183706 - DNA, 9 bp, Unknown
  misc_feature (1)..( 9): Result.005 file - promoters50/3435891
ctgtcaaag

SEQ ID NO: 183707 - DNA, 9 bp, Unknown
  misc_feature (1)..( 9): Result.005 file - promoters50/3435891
ctgtcatta

SEQ ID NO: 183708 - DNA, 7 bp, Unknown
  misc_feature (1)..( 7): Result.005 file - promoters50/3435917
ataaagg

SEQ ID NO: 183709 - DNA, 7 bp, Unknown
  misc_feature (1)..( 7): Result.005 file - promoters50/3435917
ataaagt

SEQ ID NO: 183710 - DNA, 7 bp, Unknown
  misc_feature (1)..( 7): Result.005 file - promoters50/3435917
ataaagt

SEQ ID NO: 183711 - DNA, 7 bp, Unknown
  misc_feature (1)..( 7): Result.005 file - promoters50/3435917
tttataa

SEQ ID NO: 183712 - DNA, 7 bp, Unknown
  misc_feature (1)..( 7): Result.005 file - promoters50/3435917
tttatat

SEQ ID NO: 183713 - DNA, 7 bp, Unknown
  misc_feature (1)..( 7): Result.005 file - promoters50/3435917
tttttaa

SEQ ID NO: 183714 - DNA, 8 bp, Unknown
  misc_feature (1)..( 8): Result.005 file - promoters50/3435917
ataaaata

SEQ ID NO: 183715 - DNA, 8 bp, Unknown
  misc_feature (1)..( 8): Result.005 file - promoters50/3435917
ataaaaaa

SEQ ID NO: 183716 - DNA, 8 bp, Unknown
  misc_feature (1)..( 8): Result.005 file - promoters50/3435917
gtaagata

SEQ ID NO: 183717 - DNA, 8 bp, Unknown
  misc_feature (1)..( 8): Result.005 file - promoters50/3435917
cattgtaa

SEQ ID NO: 183718 - DNA, 8 bp, Unknown
  misc_feature (1)..( 8): Result.005 file - promoters50/3435917
tattttaa

SEQ ID NO: 183719 - DNA, 8 bp, Unknown
  misc_feature (1)..( 8): Result.005 file - promoters50/3435917
tatttttt

SEQ ID NO: 183720 - DNA, 8 bp, Unknown
  misc_feature (1)..( 8): Result.005 file - promoters50/3436121
ttttaaga

SEQ ID NO: 183721 - DNA, 8 bp, Unknown
  misc_feature (1)..( 8): Result.005 file - promoters50/3436121
gtttaagc

SEQ ID NO: 183722 - DNA, 9 bp, Unknown
  misc_feature (1)..( 9): Result.005 file - promoters50/3436121
ttttgaaga

SEQ ID NO: 183723 - DNA, 7 bp, Unknown
  misc_feature (1)..( 7): Result.005 file - promoters50/3436121
aagaaaa

SEQ ID NO: 183724 - DNA, 7 bp, Unknown
  misc_feature (1)..( 7): Result.005 file - promoters50/3436121
aagaaat

SEQ ID NO: 183725 - DNA, 7 bp, Unknown
  misc_feature (1)..( 7): Result.005 file - promoters50/3436121
aagtaat

SEQ ID NO: 183726 - DNA, 8 bp, Unknown
  misc_feature (1)..( 8): Result.005 file - promoters50/3436121
acatgtct

SEQ ID NO: 183727 - DNA, 8 bp, Unknown
  misc_feature (1)..( 8): Result.005 file - promoters50/3436121
ttatgtct

SEQ ID NO: 183728 - DNA, 8 bp, Unknown
  misc_feature (1)..( 8): Result.005 file - promoters50/3436121
ttatgtca

SEQ ID NO: 183729 - DNA, 7 bp, Unknown
  misc_feature (1)..( 7): Result.005 file - promoters50/3436121
gatcgaa

SEQ ID NO: 183730 - DNA, 7 bp, Unknown
  misc_feature (1)..( 7): Result.005 file - promoters50/3436121
gatcgat

SEQ ID NO: 183731 - DNA, 7 bp, Unknown
  misc_feature (1)..( 7): Result.005 file - promoters50/3436121
gatggat

SEQ ID NO: 183732 - DNA, 7 bp, Unknown
  misc_feature (1)..( 7): Result.005 file - promoters50/3436139
attaata

SEQ ID NO: 183733 - DNA, 7 bp, Unknown
  misc_feature (1)..( 7): Result.005 file - promoters50/3436139
gttaata

SEQ ID NO: 183734 - DNA, 7 bp, Unknown
  misc_feature (1)..( 7): Result.005 file - promoters50/3436139
atttata

SEQ ID NO: 183735 - DNA, 7 bp, Unknown
  misc_feature (1)..( 7): Result.005 file - promoters50/3436222
aaaaata

SEQ ID NO: 183736 - DNA, 7 bp, Unknown
  misc_feature (1)..( 7): Result.005 file - promoters50/3436222
aaaaatc

SEQ ID NO: 183737 - DNA, 7 bp, Unknown
  misc_feature (1)..( 7): Result.005 file - promoters50/3436222
taaaata

SEQ ID NO: 183738 - DNA, 10 bp, Unknown
  misc_feature (1)..( 10): Result.005 file - promoters50/3436222
atcaaaaatg

SEQ ID NO: 183739 - DNA, 10 bp, Unknown
  misc_feature (1)..( 10): Result.005 file - promoters50/3436222
atcagaaatt

SEQ ID NO: 183740 - DNA, 10 bp, Unknown
  misc_feature (1)..( 10): Result.005 file - promoters50/3436222
atttaaaatg

SEQ ID NO: 183741 - DNA, 9 bp, Unknown
  misc_feature (1)..( 9): Result.005 file - promoters50/3436222
gacaaaaat

SEQ ID NO: 183742 - DNA, 9 bp, Unknown
  misc_feature (1)..( 9): Result.005 file - promoters50/3436222
gacagaaac

SEQ ID NO: 183743 - DNA, 9 bp, Unknown
  misc_feature (1)..( 9): Result.005 file - promoters50/3436222
ttgaaaaat

SEQ ID NO: 183744 - DNA, 10 bp, Unknown
  misc_feature (1)..( 10): Result.005 file - promoters50/3436222
atataatatt

SEQ ID NO: 183745 - DNA, 10 bp, Unknown
  misc_feature (1)..( 10): Result.005 file - promoters50/3436222
atataaacat

SEQ ID NO: 183746 - DNA, 10 bp, Unknown
  misc_feature (1)..( 10): Result.005 file - promoters50/3436222
atataaaata

SEQ ID NO: 183747 - DNA, 8 bp, Unknown
  misc_feature (1)..( 8): Result.005 file - promoters50/3436265
gaaagttt

SEQ ID NO: 183748 - DNA, 8 bp, Unknown
  misc_feature (1)..( 8): Result.005 file - promoters50/3436265
caaacttt

SEQ ID NO: 183749 - DNA, 8 bp, Unknown
  misc_feature (1)..( 8): Result.005 file - promoters50/3436265
taaacttc

SEQ ID NO: 183750 - DNA, 8 bp, Unknown
  misc_feature (1)..( 8): Result.005 file - promoters50/3436265
taaacttt

SEQ ID NO: 183751 - DNA, 11 bp, Unknown
  misc_feature (1)..( 11): Result.005 file - promoters50/3436265
ctcaataatat

SEQ ID NO: 183752 - DNA, 11 bp, Unknown
  misc_feature (1)..( 11): Result.005 file - promoters50/3436265
attaataatgt

SEQ ID NO: 183753 - DNA, 11 bp, Unknown
  misc_feature (1)..( 11): Result.005 file - promoters50/3436265
tattatagtat

SEQ ID NO: 183754 - DNA, 11 bp, Unknown
  misc_feature (1)..( 11): Result.005 file - promoters50/3436265
atttataaatc

SEQ ID NO: 183755 - DNA, 9 bp, Unknown
  misc_feature (1)..( 9): Result.005 file - promoters50/3436265
cttctttgt

SEQ ID NO: 183756 - DNA, 9 bp, Unknown
  misc_feature (1)..( 9): Result.005 file - promoters50/3436265
attctatgt

SEQ ID NO: 183757 - DNA, 9 bp, Unknown
  misc_feature (1)..( 9): Result.005 file - promoters50/3436265
cttttttaa

SEQ ID NO: 183758 - DNA, 9 bp, Unknown
  misc_feature (1)..( 9): Result.005 file - promoters50/3436265
gttttttat

SEQ ID NO: 183759 - DNA, 9 bp, Unknown
  misc_feature (1)..( 9): Result.005 file - promoters50/3436265
cttaagtag

SEQ ID NO: 183760 - DNA, 9 bp, Unknown
  misc_feature (1)..( 9): Result.005 file - promoters50/3436265
attatgtat

SEQ ID NO: 183761 - DNA, 9 bp, Unknown
  misc_feature (1)..( 9): Result.005 file - promoters50/3436265
attttgtta

SEQ ID NO: 183762 - DNA, 9 bp, Unknown
  misc_feature (1)..( 9): Result.005 file - promoters50/3436265
tatatatat

SEQ ID NO: 183763 - DNA, 12 bp, Unknown
  misc_feature (1)..( 12): Result.005 file - promoters50/3436267
cattataacctc

SEQ ID NO: 183764 - DNA, 12 bp, Unknown
  misc_feature (1)..( 12): Result.005 file - promoters50/3436267
tattattacctc

SEQ ID NO: 183765 - DNA, 12 bp, Unknown
  misc_feature (1)..( 12): Result.005 file - promoters50/3436267
cattattgatcc

SEQ ID NO: 183766 - DNA, 12 bp, Unknown
  misc_feature (1)..( 12): Result.005 file - promoters50/3436267
gattttaagaca

SEQ ID NO: 183767 - DNA, 12 bp, Unknown
  misc_feature (1)..( 12): Result.005 file - promoters50/3436267
tattataaaact

SEQ ID NO: 183768 - DNA, 12 bp, Unknown
  misc_feature (1)..( 12): Result.005 file - promoters50/3436267
cattgttgttgc

SEQ ID NO: 183769 - DNA, 10 bp, Unknown
  misc_feature (1)..( 10): Result.005 file - promoters50/3436312
ctatgctata

SEQ ID NO: 183770 - DNA, 10 bp, Unknown
  misc_feature (1)..( 10): Result.005 file - promoters50/3436312
ttttgctatg

SEQ ID NO: 183771 - DNA, 10 bp, Unknown
  misc_feature (1)..( 10): Result.005 file - promoters50/3436312
ttttgttatg

SEQ ID NO: 183772 - DNA, 10 bp, Unknown
  misc_feature (1)..( 10): Result.005 file - promoters50/3436319
cctatttata

SEQ ID NO: 183773 - DNA, 10 bp, Unknown
  misc_feature (1)..( 10): Result.005 file - promoters50/3436319
tatatctata

SEQ ID NO: 183774 - DNA, 10 bp, Unknown
  misc_feature (1)..( 10): Result.005 file - promoters50/3436319
cctaattatt

SEQ ID NO: 183775 - DNA, 8 bp, Unknown
  misc_feature (1)..( 8): Result.005 file - promoters50/3436319
actgttaa

SEQ ID NO: 183776 - DNA, 8 bp, Unknown
  misc_feature (1)..( 8): Result.005 file - promoters50/3436319
acttttaa

SEQ ID NO: 183777 - DNA, 8 bp, Unknown
  misc_feature (1)..( 8): Result.005 file - promoters50/3436319
ttttttaa

SEQ ID NO: 183778 - DNA, 7 bp, Unknown
  misc_feature (1)..( 7): Result.005 file - promoters50/3436319
ttaaatt

SEQ ID NO: 183779 - DNA, 7 bp, Unknown
  misc_feature (1)..( 7): Result.005 file - promoters50/3436319
ataaatt

SEQ ID NO: 183780 - DNA, 7 bp, Unknown
  misc_feature (1)..( 7): Result.005 file - promoters50/3436319
ttaaatt

SEQ ID NO: 183781 - DNA, 10 bp, Unknown
  misc_feature (1)..( 10): Result.005 file - promoters50/3436319
taataactaa

SEQ ID NO: 183782 - DNA, 10 bp, Unknown
  misc_feature (1)..( 10): Result.005 file - promoters50/3436319
taataattaa

SEQ ID NO: 183783 - DNA, 10 bp, Unknown
  misc_feature (1)..( 10): Result.005 file - promoters50/3436319
gaatacttag

SEQ ID NO: 183784 - DNA, 10 bp, Unknown
  misc_feature (1)..( 10): Result.005 file - promoters50/3436319
atataatttt

SEQ ID NO: 183785 - DNA, 8 bp, Unknown
  misc_feature (1)..( 8): Result.005 file - promoters50/3436319
aatgttac

SEQ ID NO: 183786 - DNA, 8 bp, Unknown
  misc_feature (1)..( 8): Result.005 file - promoters50/3436319
aatgtttg

SEQ ID NO: 183787 - DNA, 8 bp, Unknown
  misc_feature (1)..( 8): Result.005 file - promoters50/3436319
tatgtttg

SEQ ID NO: 183788 - DNA, 8 bp, Unknown
  misc_feature (1)..( 8): Result.005 file - promoters50/3436319
catatttc

SEQ ID NO: 183789 - DNA, 8 bp, Unknown
  misc_feature (1)..( 8): Result.005 file - promoters50/3436319
catctttt

SEQ ID NO: 183790 - DNA, 8 bp, Unknown
  misc_feature (1)..( 8): Result.005 file - promoters50/3436319
aatctttt

SEQ ID NO: 183791 - DNA, 9 bp, Unknown
  misc_feature (1)..( 9): Result.005 file - promoters50/3436412
tttgtatat

SEQ ID NO: 183792 - DNA, 9 bp, Unknown
  misc_feature (1)..( 9): Result.005 file - promoters50/3436412
attgtatct

SEQ ID NO: 183793 - DNA, 9 bp, Unknown
  misc_feature (1)..( 9): Result.005 file - promoters50/3436412
tttgtttat

SEQ ID NO: 183794 - DNA, 9 bp, Unknown
  misc_feature (1)..( 9): Result.005 file - promoters50/3436412
gttgattaa

SEQ ID NO: 183795 - DNA, 13 bp, Unknown
  misc_feature (1)..( 13): Result.005 file - promoters50/3436481
aaatattttactt

SEQ ID NO: 183796 - DNA, 13 bp, Unknown
  misc_feature (1)..( 13): Result.005 file - promoters50/3436481
ttatatttcgcaa

SEQ ID NO: 183797 - DNA, 13 bp, Unknown
  misc_feature (1)..( 13): Result.005 file - promoters50/3436481
tgaaattttttac

SEQ ID NO: 183798 - DNA, 13 bp, Unknown
  misc_feature (1)..( 13): Result.005 file - promoters50/3436481
aaaaatgtttaat

SEQ ID NO: 183799 - DNA, 13 bp, Unknown
  misc_feature (1)..( 13): Result.005 file - promoters50/3436481
taaaagaatcacc

SEQ ID NO: 183800 - DNA, 13 bp, Unknown
  misc_feature (1)..( 13): Result.005 file - promoters50/3436481
tcaaagaaacaag

SEQ ID NO: 183801 - DNA, 13 bp, Unknown
  misc_feature (1)..( 13): Result.005 file - promoters50/3436481
caccatttttcta

SEQ ID NO: 183802 - DNA, 16 bp, Unknown
  misc_feature (1)..( 16): Result.005 file - promoters50/3436481
tttcattacagattta

SEQ ID NO: 183803 - DNA, 16 bp, Unknown
  misc_feature (1)..( 16): Result.005 file - promoters50/3436481
ataacaaacaaatttc

SEQ ID NO: 183804 - DNA, 16 bp, Unknown
  misc_feature (1)..( 16): Result.005 file - promoters50/3436481
ataaaaaactaatcaa

SEQ ID NO: 183805 - DNA, 16 bp, Unknown
  misc_feature (1)..( 16): Result.005 file - promoters50/3436481
ccaatgaacaaaaaaa

SEQ ID NO: 183806 - DNA, 16 bp, Unknown
  misc_feature (1)..( 16): Result.005 file - promoters50/3436481
gctagatacaaaaccc

SEQ ID NO: 183807 - DNA, 16 bp, Unknown
  misc_feature (1)..( 16): Result.005 file - promoters50/3436481
aaaatttataaatgta

SEQ ID NO: 183808 - DNA, 13 bp, Unknown
  misc_feature (1)..( 13): Result.005 file - promoters50/3436481
tatacaaaatagt

SEQ ID NO: 183809 - DNA, 13 bp, Unknown
  misc_feature (1)..( 13): Result.005 file - promoters50/3436481
ctaacagaataaa

SEQ ID NO: 183810 - DNA, 13 bp, Unknown
  misc_feature (1)..( 13): Result.005 file - promoters50/3436481
taatcaacatatt

SEQ ID NO: 183811 - DNA, 13 bp, Unknown
  misc_feature (1)..( 13): Result.005 file - promoters50/3436481
taaacagtaaaat

SEQ ID NO: 183812 - DNA, 13 bp, Unknown
  misc_feature (1)..( 13): Result.005 file - promoters50/3436481
aaaaaagtataaa

SEQ ID NO: 183813 - DNA, 13 bp, Unknown
  misc_feature (1)..( 13): Result.005 file - promoters50/3436481
caaacaaatttca

SEQ ID NO: 183814 - DNA, 19 bp, Unknown
  misc_feature (1)..( 19): Result.005 file - promoters50/3436481
atcattaatttgtttattt

SEQ ID NO: 183815 - DNA, 19 bp, Unknown
  misc_feature (1)..( 19): Result.005 file - promoters50/3436481
aaaattgattttttttttt

SEQ ID NO: 183816 - DNA, 19 bp, Unknown
  misc_feature (1)..( 19): Result.005 file - promoters50/3436481
ttgtgtaatttttttctat

SEQ ID NO: 183817 - DNA, 19 bp, Unknown
  misc_feature (1)..( 19): Result.005 file - promoters50/3436481
atcattatttttttttgta

SEQ ID NO: 183818 - DNA, 19 bp, Unknown
  misc_feature (1)..( 19): Result.005 file - promoters50/3436481
cataaaattttgttttact

SEQ ID NO: 183819 - DNA, 19 bp, Unknown
  misc_feature (1)..( 19): Result.005 file - promoters50/3436481
ctctaccttttttttgttt

SEQ ID NO: 183820 - DNA, 12 bp, Unknown
  misc_feature (1)..( 12): Result.005 file - promoters50/3436529
tatatataaaga

SEQ ID NO: 183821 - DNA, 12 bp, Unknown
  misc_feature (1)..( 12): Result.005 file - promoters50/3436529
acaatataaaca

SEQ ID NO: 183822 - DNA, 12 bp, Unknown
  misc_feature (1)..( 12): Result.005 file - promoters50/3436529
tatatataaagc

SEQ ID NO: 183823 - DNA, 12 bp, Unknown
  misc_feature (1)..( 12): Result.005 file - promoters50/3436529
tatatatacaca

SEQ ID NO: 183824 - DNA, 12 bp, Unknown
  misc_feature (1)..( 12): Result.005 file - promoters50/3436529
ctcatataaata

SEQ ID NO: 183825 - DNA, 12 bp, Unknown
  misc_feature (1)..( 12): Result.005 file - promoters50/3436529
cacatattaaca

SEQ ID NO: 183826 - DNA, 9 bp, Unknown
  misc_feature (1)..( 9): Result.005 file - promoters50/3436529
aacttattt

SEQ ID NO: 183827 - DNA, 9 bp, Unknown
  misc_feature (1)..( 9): Result.005 file - promoters50/3436529
tttttattt

SEQ ID NO: 183828 - DNA, 9 bp, Unknown
  misc_feature (1)..( 9): Result.005 file - promoters50/3436529
tatatattt

SEQ ID NO: 183829 - DNA, 9 bp, Unknown
  misc_feature (1)..( 9): Result.005 file - promoters50/3436529
ttcttattt

SEQ ID NO: 183830 - DNA, 9 bp, Unknown
  misc_feature (1)..( 9): Result.005 file - promoters50/3436529
ttcttataa

SEQ ID NO: 183831 - DNA, 9 bp, Unknown
  misc_feature (1)..( 9): Result.005 file - promoters50/3436529
tatagattt

SEQ ID NO: 183832 - DNA, 11 bp, Unknown
  misc_feature (1)..( 11): Result.005 file - promoters50/3436529
attttgaaaaa

SEQ ID NO: 183833 - DNA, 11 bp, Unknown
  misc_feature (1)..( 11): Result.005 file - promoters50/3436529
ttttcgaatct

SEQ ID NO: 183834 - DNA, 11 bp, Unknown
  misc_feature (1)..( 11): Result.005 file - promoters50/3436529
ttttttaaaaa

SEQ ID NO: 183835 - DNA, 12 bp, Unknown
  misc_feature (1)..( 12): Result.005 file - promoters50/3436529
taattagaaaga

SEQ ID NO: 183836 - DNA, 12 bp, Unknown
  misc_feature (1)..( 12): Result.005 file - promoters50/3436529
attgtttaagat

SEQ ID NO: 183837 - DNA, 12 bp, Unknown
  misc_feature (1)..( 12): Result.005 file - promoters50/3436529
tttgtttctctt

SEQ ID NO: 183838 - DNA, 14 bp, Unknown
  misc_feature (1)..( 14): Result.005 file - promoters50/3436529
tcagatatacattg

SEQ ID NO: 183839 - DNA, 14 bp, Unknown
  misc_feature (1)..( 14): Result.005 file - promoters50/3436529
ttttctataaatta

SEQ ID NO: 183840 - DNA, 14 bp, Unknown
  misc_feature (1)..( 14): Result.005 file - promoters50/3436529
acggatttacttga

SEQ ID NO: 183841 - DNA, 14 bp, Unknown
  misc_feature (1)..( 14): Result.005 file - promoters50/3436529
agagctaaaaacgg

SEQ ID NO: 183842 - DNA, 14 bp, Unknown
  misc_feature (1)..( 14): Result.005 file - promoters50/3436529
ttttttatagatta

SEQ ID NO: 183843 - DNA, 14 bp, Unknown
  misc_feature (1)..( 14): Result.005 file - promoters50/3436529
acttttttttctga

SEQ ID NO: 183844 - DNA, 9 bp, Unknown
  misc_feature (1)..( 9): Result.005 file - promoters50/3436655
aaagggacc

SEQ ID NO: 183845 - DNA, 9 bp, Unknown
  misc_feature (1)..( 9): Result.005 file - promoters50/3436655
aaatggaat

SEQ ID NO: 183846 - DNA, 9 bp, Unknown
  misc_feature (1)..( 9): Result.005 file - promoters50/3436655
atatgtaat

SEQ ID NO: 183847 - DNA, 8 bp, Unknown
  misc_feature (1)..( 8): Result.005 file - promoters50/3436661
tttttttt

SEQ ID NO: 183848 - DNA, 8 bp, Unknown
  misc_feature (1)..( 8): Result.005 file - promoters50/3436661
tttttttt

SEQ ID NO: 183849 - DNA, 8 bp, Unknown
  misc_feature (1)..( 8): Result.005 file - promoters50/3436661
tttatcgt

SEQ ID NO: 183850 - DNA, 13 bp, Unknown
  misc_feature (1)..( 13): Result.005 file - promoters50/3436661
ctttagttccggt

SEQ ID NO: 183851 - DNA, 13 bp, Unknown
  misc_feature (1)..( 13): Result.005 file - promoters50/3436661
ctttggtttaatg

SEQ ID NO: 183852 - DNA, 13 bp, Unknown
  misc_feature (1)..( 13): Result.005 file - promoters50/3436661
gttttgttcaatg

SEQ ID NO: 183853 - DNA, 7 bp, Unknown
  misc_feature (1)..( 7): Result.005 file - promoters50/3436661
atacttt

SEQ ID NO: 183854 - DNA, 7 bp, Unknown
  misc_feature (1)..( 7): Result.005 file - promoters50/3436661
ttacttt

SEQ ID NO: 183855 - DNA, 7 bp, Unknown
  misc_feature (1)..( 7): Result.005 file - promoters50/3436661
atactta

SEQ ID NO: 183856 - DNA, 15 bp, Unknown
  misc_feature (1)..( 15): Result.005 file - promoters50/3436661
tttactgtagaacag

SEQ ID NO: 183857 - DNA, 15 bp, Unknown
  misc_feature (1)..( 15): Result.005 file - promoters50/3436661
tttactgtagaacag

SEQ ID NO: 183858 - DNA, 15 bp, Unknown
  misc_feature (1)..( 15): Result.005 file - promoters50/3436661
acagaagtagaaaga

SEQ ID NO: 183859 - DNA, 14 bp, Unknown
  misc_feature (1)..( 14): Result.005 file - promoters50/3436661
tctaaaatatctat

SEQ ID NO: 183860 - DNA, 14 bp, Unknown
  misc_feature (1)..( 14): Result.005 file - promoters50/3436661
tctagaattttatt

SEQ ID NO: 183861 - DNA, 14 bp, Unknown
  misc_feature (1)..( 14): Result.005 file - promoters50/3436661
actaaaatattatt

SEQ ID NO: 183862 - DNA, 7 bp, Unknown
  misc_feature (1)..( 7): Result.005 file - promoters50/3436661
taagtgg

SEQ ID NO: 183863 - DNA, 7 bp, Unknown
  misc_feature (1)..( 7): Result.005 file - promoters50/3436661
taactgg

SEQ ID NO: 183864 - DNA, 7 bp, Unknown
  misc_feature (1)..( 7): Result.005 file - promoters50/3436661
taaatgg

SEQ ID NO: 183865 - DNA, 9 bp, Unknown
  misc_feature (1)..( 9): Result.005 file - promoters50/3436661
gtttaatgt

SEQ ID NO: 183866 - DNA, 9 bp, Unknown
  misc_feature (1)..( 9): Result.005 file - promoters50/3436661
gttaaatta

SEQ ID NO: 183867 - DNA, 9 bp, Unknown
  misc_feature (1)..( 9): Result.005 file - promoters50/3436661
ctaaaatat

SEQ ID NO: 183868 - DNA, 13 bp, Unknown
  misc_feature (1)..( 13): Result.005 file - promoters50/3436661
atataattgtatt

SEQ ID NO: 183869 - DNA, 13 bp, Unknown
  misc_feature (1)..( 13): Result.005 file - promoters50/3436661
ctagaattttatt

SEQ ID NO: 183870 - DNA, 13 bp, Unknown
  misc_feature (1)..( 13): Result.005 file - promoters50/3436661
ctaaaatattatt

SEQ ID NO: 183871 - DNA, 7 bp, Unknown
  misc_feature (1)..( 7): Result.005 file - promoters50/3436661
aaaatat

SEQ ID NO: 183872 - DNA, 7 bp, Unknown
  misc_feature (1)..( 7): Result.005 file - promoters50/3436661
aaactat

SEQ ID NO: 183873 - DNA, 7 bp, Unknown
  misc_feature (1)..( 7): Result.005 file - promoters50/3436661
aaaatat

SEQ ID NO: 183874 - DNA, 12 bp, Unknown
  misc_feature (1)..( 12): Result.005 file - promoters50/3436718
gaaataagtttg

SEQ ID NO: 183875 - DNA, 12 bp, Unknown
  misc_feature (1)..( 12): Result.005 file - promoters50/3436718
tgtataactttg

SEQ ID NO: 183876 - DNA, 12 bp, Unknown
  misc_feature (1)..( 12): Result.005 file - promoters50/3436718
gaaattagtgat

SEQ ID NO: 183877 - DNA, 8 bp, Unknown
  misc_feature (1)..( 8): Result.005 file - promoters50/3436718
cttgcttc

SEQ ID NO: 183878 - DNA, 8 bp, Unknown
  misc_feature (1)..( 8): Result.005 file - promoters50/3436718
ctttctta

SEQ ID NO: 183879 - DNA, 8 bp, Unknown
  misc_feature (1)..( 8): Result.005 file - promoters50/3436718
ttttttta

SEQ ID NO: 183880 - DNA, 8 bp, Unknown
  misc_feature (1)..( 8): Result.005 file - promoters50/3436718
attgtttt

SEQ ID NO: 183881 - DNA, 8 bp, Unknown
  misc_feature (1)..( 8): Result.005 file - promoters50/3436718
gtaacaac

SEQ ID NO: 183882 - DNA, 8 bp, Unknown
  misc_feature (1)..( 8): Result.005 file - promoters50/3436718
ctaaaaac

SEQ ID NO: 183883 - DNA, 8 bp, Unknown
  misc_feature (1)..( 8): Result.005 file - promoters50/3436718
ctaaaatt

SEQ ID NO: 183884 - DNA, 13 bp, Unknown
  misc_feature (1)..( 13): Result.005 file - promoters50/3436718
agttattaatcac

SEQ ID NO: 183885 - DNA, 13 bp, Unknown
  misc_feature (1)..( 13): Result.005 file - promoters50/3436718
agtgattcatctt

SEQ ID NO: 183886 - DNA, 13 bp, Unknown
  misc_feature (1)..( 13): Result.005 file - promoters50/3436718
ataatttaatcac

SEQ ID NO: 183887 - DNA, 9 bp, Unknown
  misc_feature (1)..( 9): Result.005 file - promoters50/3436718
tttattaaa

SEQ ID NO: 183888 - DNA, 9 bp, Unknown
  misc_feature (1)..( 9): Result.005 file - promoters50/3436718
ttttttaaa

SEQ ID NO: 183889 - DNA, 9 bp, Unknown
  misc_feature (1)..( 9): Result.005 file - promoters50/3436718
actatgaaa

SEQ ID NO: 183890 - DNA, 12 bp, Unknown
  misc_feature (1)..( 12): Result.005 file - promoters50/3436718
aaaagttttatt

SEQ ID NO: 183891 - DNA, 12 bp, Unknown
  misc_feature (1)..( 12): Result.005 file - promoters50/3436718
aaaagttcatct

SEQ ID NO: 183892 - DNA, 12 bp, Unknown
  misc_feature (1)..( 12): Result.005 file - promoters50/3436718
caaacttcatct

SEQ ID NO: 183893 - DNA, 6 bp, Unknown
  misc_feature (1)..( 6): Result.005 file - promoters50/3436730
ttttta

SEQ ID NO: 183894 - DNA, 6 bp, Unknown
  misc_feature (1)..( 6): Result.005 file - promoters50/3436730
ttttta

SEQ ID NO: 183895 - DNA, 6 bp, Unknown
  misc_feature (1)..( 6): Result.005 file - promoters50/3436730
ttttta

SEQ ID NO: 183896 - DNA, 9 bp, Unknown
  misc_feature (1)..( 9): Result.005 file - promoters50/3436799
cttaaatat

SEQ ID NO: 183897 - DNA, 9 bp, Unknown
  misc_feature (1)..( 9): Result.005 file - promoters50/3436799
cttagatat

SEQ ID NO: 183898 - DNA, 9 bp, Unknown
  misc_feature (1)..( 9): Result.005 file - promoters50/3436799
cttgaatca

SEQ ID NO: 183899 - DNA, 11 bp, Unknown
  misc_feature (1)..( 11): Result.005 file - promoters50/3436799
taaaagaaaat

SEQ ID NO: 183900 - DNA, 11 bp, Unknown
  misc_feature (1)..( 11): Result.005 file - promoters50/3436799
taacagaataa

SEQ ID NO: 183901 - DNA, 11 bp, Unknown
  misc_feature (1)..( 11): Result.005 file - promoters50/3436799
aaacagagtaa

SEQ ID NO: 183902 - DNA, 10 bp, Unknown
  misc_feature (1)..( 10): Result.005 file - promoters50/3436799
gttaatcaaa

SEQ ID NO: 183903 - DNA, 10 bp, Unknown
  misc_feature (1)..( 10): Result.005 file - promoters50/3436799
aagaataaaa

SEQ ID NO: 183904 - DNA, 10 bp, Unknown
  misc_feature (1)..( 10): Result.005 file - promoters50/3436799
tcatataaat

SEQ ID NO: 183905 - DNA, 10 bp, Unknown
  misc_feature (1)..( 10): Result.005 file - promoters50/3436799
tgattgtttt

SEQ ID NO: 183906 - DNA, 10 bp, Unknown
  misc_feature (1)..( 10): Result.005 file - promoters50/3436799
caattttttt

SEQ ID NO: 183907 - DNA, 10 bp, Unknown
  misc_feature (1)..( 10): Result.005 file - promoters50/3436799
caattttgct

SEQ ID NO: 183908 - DNA, 13 bp, Unknown
  misc_feature (1)..( 13): Result.005 file - promoters50/3436883
agtaaatatttat

SEQ ID NO: 183909 - DNA, 13 bp, Unknown
  misc_feature (1)..( 13): Result.005 file - promoters50/3436883
tcaaaaaattcaa

SEQ ID NO: 183910 - DNA, 13 bp, Unknown
  misc_feature (1)..( 13): Result.005 file - promoters50/3436883
tagaaaaagtcaa

SEQ ID NO: 183911 - DNA, 13 bp, Unknown
  misc_feature (1)..( 13): Result.005 file - promoters50/3436883
aacgttaaggcaa

SEQ ID NO: 183912 - DNA, 13 bp, Unknown
  misc_feature (1)..( 13): Result.005 file - promoters50/3436883
aggaaaagataca

SEQ ID NO: 183913 - DNA, 10 bp, Unknown
  misc_feature (1)..( 10): Result.005 file - promoters50/3436943
tgctattaga

SEQ ID NO: 183914 - DNA, 10 bp, Unknown
  misc_feature (1)..( 10): Result.005 file - promoters50/3436943
agatatcaga

SEQ ID NO: 183915 - DNA, 10 bp, Unknown
  misc_feature (1)..( 10): Result.005 file - promoters50/3436943
agatctcaag

SEQ ID NO: 183916 - DNA, 11 bp, Unknown
  misc_feature (1)..( 11): Result.005 file - promoters50/3436943
tattccacaaa

SEQ ID NO: 183917 - DNA, 11 bp, Unknown
  misc_feature (1)..( 11): Result.005 file - promoters50/3436943
ttttccccaaa

SEQ ID NO: 183918 - DNA, 11 bp, Unknown
  misc_feature (1)..( 11): Result.005 file - promoters50/3436943
ttttcccacat

SEQ ID NO: 183919 - DNA, 8 bp, Unknown
  misc_feature (1)..( 8): Result.005 file - promoters50/3436971
cttacaaa

SEQ ID NO: 183920 - DNA, 8 bp, Unknown
  misc_feature (1)..( 8): Result.005 file - promoters50/3436971
attagaaa

SEQ ID NO: 183921 - DNA, 8 bp, Unknown
  misc_feature (1)..( 8): Result.005 file - promoters50/3436971
ctttcaag

SEQ ID NO: 183922 - DNA, 13 bp, Unknown
  misc_feature (1)..( 13): Result.005 file - promoters50/3437072
ataaaataaattt

SEQ ID NO: 183923 - DNA, 13 bp, Unknown
  misc_feature (1)..( 13): Result.005 file - promoters50/3437072
gctgaatcaattt

SEQ ID NO: 183924 - DNA, 13 bp, Unknown
  misc_feature (1)..( 13): Result.005 file - promoters50/3437072
atacaataattac

SEQ ID NO: 183925 - DNA, 13 bp, Unknown
  misc_feature (1)..( 13): Result.005 file - promoters50/3437072
aaaatatcaatac

SEQ ID NO: 183926 - DNA, 13 bp, Unknown
  misc_feature (1)..( 13): Result.005 file - promoters50/3437072
gttgattcatata

SEQ ID NO: 183927 - DNA, 13 bp, Unknown
  misc_feature (1)..( 13): Result.005 file - promoters50/3437072
agaggttcaattt

SEQ ID NO: 183928 - DNA, 10 bp, Unknown
  misc_feature (1)..( 10): Result.005 file - promoters50/3437072
agttaattta

SEQ ID NO: 183929 - DNA, 10 bp, Unknown
  misc_feature (1)..( 10): Result.005 file - promoters50/3437072
cattaaatta

SEQ ID NO: 183930 - DNA, 10 bp, Unknown
  misc_feature (1)..( 10): Result.005 file - promoters50/3437072
taataatttt

SEQ ID NO: 183931 - DNA, 10 bp, Unknown
  misc_feature (1)..( 10): Result.005 file - promoters50/3437072
acttaaatta

SEQ ID NO: 183932 - DNA, 10 bp, Unknown
  misc_feature (1)..( 10): Result.005 file - promoters50/3437072
catcaaaccg

SEQ ID NO: 183933 - DNA, 10 bp, Unknown
  misc_feature (1)..( 10): Result.005 file - promoters50/3437072
aaataattaa

SEQ ID NO: 183934 - DNA, 10 bp, Unknown
  misc_feature (1)..( 10): Result.005 file - promoters50/3437072
ataaaataaa

SEQ ID NO: 183935 - DNA, 10 bp, Unknown
  misc_feature (1)..( 10): Result.005 file - promoters50/3437072
ttaaaatatt

SEQ ID NO: 183936 - DNA, 10 bp, Unknown
  misc_feature (1)..( 10): Result.005 file - promoters50/3437072
ttaatatatt

SEQ ID NO: 183937 - DNA, 10 bp, Unknown
  misc_feature (1)..( 10): Result.005 file - promoters50/3437072
atagaatggc

SEQ ID NO: 183938 - DNA, 10 bp, Unknown
  misc_feature (1)..( 10): Result.005 file - promoters50/3437072
aaaaactaaa

SEQ ID NO: 183939 - DNA, 10 bp, Unknown
  misc_feature (1)..( 10): Result.005 file - promoters50/3437072
ttagaatata

SEQ ID NO: 183940 - DNA, 16 bp, Unknown
  misc_feature (1)..( 16): Result.005 file - promoters50/3437072
aaagactttaacagga

SEQ ID NO: 183941 - DNA, 16 bp, Unknown
  misc_feature (1)..( 16): Result.005 file - promoters50/3437072
cgattctttaaatttt

SEQ ID NO: 183942 - DNA, 16 bp, Unknown
  misc_feature (1)..( 16): Result.005 file - promoters50/3437072
ccaaattttacagaaa

SEQ ID NO: 183943 - DNA, 16 bp, Unknown
  misc_feature (1)..( 16): Result.005 file - promoters50/3437072
ttcttttttatattgc

SEQ ID NO: 183944 - DNA, 16 bp, Unknown
  misc_feature (1)..( 16): Result.005 file - promoters50/3437072
ttctattttattgtta

SEQ ID NO: 183945 - DNA, 16 bp, Unknown
  misc_feature (1)..( 16): Result.005 file - promoters50/3437072
gatatatttatatatt

SEQ ID NO: 183946 - DNA, 8 bp, Unknown
  misc_feature (1)..( 8): Result.005 file - promoters50/3437150
aaagaaga

SEQ ID NO: 183947 - DNA, 8 bp, Unknown
  misc_feature (1)..( 8): Result.005 file - promoters50/3437150
aaataagt

SEQ ID NO: 183948 - DNA, 8 bp, Unknown
  misc_feature (1)..( 8): Result.005 file - promoters50/3437150
aaaaaagg

SEQ ID NO: 183949 - DNA, 8 bp, Unknown
  misc_feature (1)..( 8): Result.005 file - promoters50/3437150
aaacaaga

SEQ ID NO: 183950 - DNA, 8 bp, Unknown
  misc_feature (1)..( 8): Result.005 file - promoters50/3437150
aaaaatac

SEQ ID NO: 183951 - DNA, 8 bp, Unknown
  misc_feature (1)..( 8): Result.005 file - promoters50/3437150
aaacatag

SEQ ID NO: 183952 - DNA, 8 bp, Unknown
  misc_feature (1)..( 8): Result.005 file - promoters50/3437150
taaaaagt

SEQ ID NO: 183953 - DNA, 13 bp, Unknown
  misc_feature (1)..( 13): Result.005 file - promoters50/3437150
agttataaaaact

SEQ ID NO: 183954 - DNA, 13 bp, Unknown
  misc_feature (1)..( 13): Result.005 file - promoters50/3437150
ctatatataaata

SEQ ID NO: 183955 - DNA, 13 bp, Unknown
  misc_feature (1)..( 13): Result.005 file - promoters50/3437150
catcataaaatga

SEQ ID NO: 183956 - DNA, 13 bp, Unknown
  misc_feature (1)..( 13): Result.005 file - promoters50/3437150
gttgataaaatta

SEQ ID NO: 183957 - DNA, 13 bp, Unknown
  misc_feature (1)..( 13): Result.005 file - promoters50/3437150
ccatataaaactc

SEQ ID NO: 183958 - DNA, 13 bp, Unknown
  misc_feature (1)..( 13): Result.005 file - promoters50/3437150
cctccaaaaaact

SEQ ID NO: 183959 - DNA, 13 bp, Unknown
  misc_feature (1)..( 13): Result.005 file - promoters50/3437150
ctatatataagct

SEQ ID NO: 183960 - DNA, 13 bp, Unknown
  misc_feature (1)..( 13): Result.005 file - promoters50/3437150
atttttcatttaa

SEQ ID NO: 183961 - DNA, 13 bp, Unknown
  misc_feature (1)..( 13): Result.005 file - promoters50/3437150
agaattcattatc

SEQ ID NO: 183962 - DNA, 13 bp, Unknown
  misc_feature (1)..( 13): Result.005 file - promoters50/3437150
gatttttatttgc

SEQ ID NO: 183963 - DNA, 13 bp, Unknown
  misc_feature (1)..( 13): Result.005 file - promoters50/3437150
aaaattaattatc

SEQ ID NO: 183964 - DNA, 13 bp, Unknown
  misc_feature (1)..( 13): Result.005 file - promoters50/3437150
agaattttgttat

SEQ ID NO: 183965 - DNA, 14 bp, Unknown
  misc_feature (1)..( 14): Result.005 file - promoters50/3437150
ataattttgttaaa

SEQ ID NO: 183966 - DNA, 15 bp, Unknown
  misc_feature (1)..( 15): Result.005 file - promoters50/3437150
gtttatttgaattaa

SEQ ID NO: 183967 - DNA, 15 bp, Unknown
  misc_feature (1)..( 15): Result.005 file - promoters50/3437150
tggattttgaatttt

SEQ ID NO: 183968 - DNA, 15 bp, Unknown
  misc_feature (1)..( 15): Result.005 file - promoters50/3437150
gagaacttgacttaa

SEQ ID NO: 183969 - DNA, 15 bp, Unknown
  misc_feature (1)..( 15): Result.005 file - promoters50/3437150
gtttatttgaacaaa

SEQ ID NO: 183970 - DNA, 15 bp, Unknown
  misc_feature (1)..( 15): Result.005 file - promoters50/3437150
atggcttagacttaa

SEQ ID NO: 183971 - DNA, 15 bp, Unknown
  misc_feature (1)..( 15): Result.005 file - promoters50/3437150
tactagacgacttaa

SEQ ID NO: 183972 - DNA, 15 bp, Unknown
  misc_feature (1)..( 15): Result.005 file - promoters50/3437150
ttctaatttattata

SEQ ID NO: 183973 - DNA, 15 bp, Unknown
  misc_feature (1)..( 15): Result.005 file - promoters50/3437150
ttaaatatttttcat

SEQ ID NO: 183974 - DNA, 15 bp, Unknown
  misc_feature (1)..( 15): Result.005 file - promoters50/3437150
gaaaagattgttgga

SEQ ID NO: 183975 - DNA, 15 bp, Unknown
  misc_feature (1)..( 15): Result.005 file - promoters50/3437150
ttaattatcaaaact

SEQ ID NO: 183976 - DNA, 15 bp, Unknown
  misc_feature (1)..( 15): Result.005 file - promoters50/3437150
agtataattttgtta

SEQ ID NO: 183977 - DNA, 16 bp, Unknown
  misc_feature (1)..( 16): Result.005 file - promoters50/3437150
agaattcattatctgt

SEQ ID NO: 183978 - DNA, 16 bp, Unknown
  misc_feature (1)..( 16): Result.005 file - promoters50/3437150
aagaagaattttgtta

SEQ ID NO: 183979 - DNA, 11 bp, Unknown
  misc_feature (1)..( 11): Result.005 file - promoters50/3437193
ttaataattcg

SEQ ID NO: 183980 - DNA, 11 bp, Unknown
  misc_feature (1)..( 11): Result.005 file - promoters50/3437193
tgaataattcc

SEQ ID NO: 183981 - DNA, 11 bp, Unknown
  misc_feature (1)..( 11): Result.005 file - promoters50/3437193
gtaacaattct

SEQ ID NO: 183982 - DNA, 11 bp, Unknown
  misc_feature (1)..( 11): Result.005 file - promoters50/3437193
ttaaaaattaa

SEQ ID NO: 183983 - DNA, 11 bp, Unknown
  misc_feature (1)..( 11): Result.005 file - promoters50/3437193
gctaaaatttc

SEQ ID NO: 183984 - DNA, 11 bp, Unknown
  misc_feature (1)..( 11): Result.005 file - promoters50/3437193
gatttaaatcc

SEQ ID NO: 183985 - DNA, 21 bp, Unknown
  misc_feature (1)..( 21): Result.005 file - promoters50/3437193
atgcgaatgcatgccatttcc

SEQ ID NO: 183986 - DNA, 21 bp, Unknown
  misc_feature (1)..( 21): Result.005 file - promoters50/3437193
atcacaatacatgtttttgat

SEQ ID NO: 183987 - DNA, 21 bp, Unknown
  misc_feature (1)..( 21): Result.005 file - promoters50/3437193
tgatatatacatacatatact

SEQ ID NO: 183988 - DNA, 21 bp, Unknown
  misc_feature (1)..( 21): Result.005 file - promoters50/3437193
agaaagaaacatattttcgat

SEQ ID NO: 183989 - DNA, 21 bp, Unknown
  misc_feature (1)..( 21): Result.005 file - promoters50/3437193
agtatatcacaaattgtttaa

SEQ ID NO: 183990 - DNA, 21 bp, Unknown
  misc_feature (1)..( 21): Result.005 file - promoters50/3437193
ttttctataaataaatttttg

SEQ ID NO: 183991 - DNA, 21 bp, Unknown
  misc_feature (1)..( 21): Result.005 file - promoters50/3437193
ggtatcaaacacgttatcaat

SEQ ID NO: 183992 - DNA, 15 bp, Unknown
  misc_feature (1)..( 15): Result.005 file - promoters50/3437193
atacatatactgtat

SEQ ID NO: 183993 - DNA, 15 bp, Unknown
  misc_feature (1)..( 15): Result.005 file - promoters50/3437193
aaacatattttcgat

SEQ ID NO: 183994 - DNA, 15 bp, Unknown
  misc_feature (1)..( 15): Result.005 file - promoters50/3437193
ataaataaatttttg

SEQ ID NO: 183995 - DNA, 15 bp, Unknown
  misc_feature (1)..( 15): Result.005 file - promoters50/3437193
atacatgtttttgat

SEQ ID NO: 183996 - DNA, 15 bp, Unknown
  misc_feature (1)..( 15): Result.005 file - promoters50/3437193
tcacaaattgtttaa

SEQ ID NO: 183997 - DNA, 15 bp, Unknown
  misc_feature (1)..( 15): Result.005 file - promoters50/3437193
aaacacgttatcaat

SEQ ID NO: 183998 - DNA, 11 bp, Unknown
  misc_feature (1)..( 11): Result.005 file - promoters50/3437208
tagtttttaga

SEQ ID NO: 183999 - DNA, 11 bp, Unknown
  misc_feature (1)..( 11): Result.005 file - promoters50/3437208
aaattttcaga

SEQ ID NO: 184000 - DNA, 11 bp, Unknown
  misc_feature (1)..( 11): Result.005 file - promoters50/3437208
aaattttcccc

SEQ ID NO: 184001 - DNA, 11 bp, Unknown
  misc_feature (1)..( 11): Result.005 file - promoters50/3437208
attagataaaa

SEQ ID NO: 184002 - DNA, 11 bp, Unknown
  misc_feature (1)..( 11): Result.005 file - promoters50/3437208
attaaataaaa

SEQ ID NO: 184003 - DNA, 11 bp, Unknown
  misc_feature (1)..( 11): Result.005 file - promoters50/3437208
acgaaatcaaa

SEQ ID NO: 184004 - DNA, 8 bp, Unknown
  misc_feature (1)..( 8): Result.005 file - promoters50/3437208
aaatgaaa

SEQ ID NO: 184005 - DNA, 8 bp, Unknown
  misc_feature (1)..( 8): Result.005 file - promoters50/3437208
aaatcaaa

SEQ ID NO: 184006 - DNA, 8 bp, Unknown
  misc_feature (1)..( 8): Result.005 file - promoters50/3437208
taattaaa

SEQ ID NO: 184007 - DNA, 7 bp, Unknown
  misc_feature (1)..( 7): Result.005 file - promoters50/3437208
aaataat

SEQ ID NO: 184008 - DNA, 7 bp, Unknown
  misc_feature (1)..( 7): Result.005 file - promoters50/3437208
aaataag

SEQ ID NO: 184009 - DNA, 7 bp, Unknown
  misc_feature (1)..( 7): Result.005 file - promoters50/3437208
aaaaaag

SEQ ID NO: 184010 - DNA, 8 bp, Unknown
  misc_feature (1)..( 8): Result.005 file - promoters50/3437212
taaaagaa

SEQ ID NO: 184011 - DNA, 8 bp, Unknown
  misc_feature (1)..( 8): Result.005 file - promoters50/3437212
taatagat

SEQ ID NO: 184012 - DNA, 8 bp, Unknown
  misc_feature (1)..( 8): Result.005 file - promoters50/3437212
taacagat

SEQ ID NO: 184013 - DNA, 6 bp, Unknown
  misc_feature (1)..( 6): Result.005 file - promoters50/3437212
tagata

SEQ ID NO: 184014 - DNA, 6 bp, Unknown
  misc_feature (1)..( 6): Result.005 file - promoters50/3437212
tagata

SEQ ID NO: 184015 - DNA, 6 bp, Unknown
  misc_feature (1)..( 6): Result.005 file - promoters50/3437212
tagata

SEQ ID NO: 184016 - DNA, 7 bp, Unknown
  misc_feature (1)..( 7): Result.005 file - promoters50/3437212
ataattt

SEQ ID NO: 184017 - DNA, 7 bp, Unknown
  misc_feature (1)..( 7): Result.005 file - promoters50/3437212
ataattc

SEQ ID NO: 184018 - DNA, 7 bp, Unknown
  misc_feature (1)..( 7): Result.005 file - promoters50/3437212
ataattt

SEQ ID NO: 184019 - DNA, 10 bp, Unknown
  misc_feature (1)..( 10): Result.005 file - promoters50/3437212
gttagaaatg

SEQ ID NO: 184020 - DNA, 10 bp, Unknown
  misc_feature (1)..( 10): Result.005 file - promoters50/3437212
gttataaacg

SEQ ID NO: 184021 - DNA, 10 bp, Unknown
  misc_feature (1)..( 10): Result.005 file - promoters50/3437212
cacatacacg

SEQ ID NO: 184022 - DNA, 13 bp, Unknown
  misc_feature (1)..( 13): Result.005 file - promoters50/3437244
acgaatcacaggg

SEQ ID NO: 184023 - DNA, 13 bp, Unknown
  misc_feature (1)..( 13): Result.005 file - promoters50/3437244
aagaatcaaccag

SEQ ID NO: 184024 - DNA, 13 bp, Unknown
  misc_feature (1)..( 13): Result.005 file - promoters50/3437244
tcgaatctaatat

SEQ ID NO: 184025 - DNA, 13 bp, Unknown
  misc_feature (1)..( 13): Result.005 file - promoters50/3437244
ttgaattacaaaa

SEQ ID NO: 184026 - DNA, 13 bp, Unknown
  misc_feature (1)..( 13): Result.005 file - promoters50/3437244
taaaatcaagtga

SEQ ID NO: 184027 - DNA, 13 bp, Unknown
  misc_feature (1)..( 13): Result.005 file - promoters50/3437244
tgtaatgaaccag

SEQ ID NO: 184028 - DNA, 13 bp, Unknown
  misc_feature (1)..( 13): Result.005 file - promoters50/3437244
acaaataaacata

SEQ ID NO: 184029 - DNA, 13 bp, Unknown
  misc_feature (1)..( 13): Result.005 file - promoters50/3437244
acaaaaaaagcta

SEQ ID NO: 184030 - DNA, 13 bp, Unknown
  misc_feature (1)..( 13): Result.005 file - promoters50/3437244
agggaacaagtct

SEQ ID NO: 184031 - DNA, 13 bp, Unknown
  misc_feature (1)..( 13): Result.005 file - promoters50/3437244
gtgtaacaattct

SEQ ID NO: 184032 - DNA, 13 bp, Unknown
  misc_feature (1)..( 13): Result.005 file - promoters50/3437244
aatgaaccagtga

SEQ ID NO: 184033 - DNA, 13 bp, Unknown
  misc_feature (1)..( 13): Result.005 file - promoters50/3437244
aatcaaccaggac

SEQ ID NO: 184034 - DNA, 13 bp, Unknown
  misc_feature (1)..( 13): Result.005 file - promoters50/3437244
gtttaaaaattaa

SEQ ID NO: 184035 - DNA, 13 bp, Unknown
  misc_feature (1)..( 13): Result.005 file - promoters50/3437244
ttggtaaaatttc

SEQ ID NO: 184036 - DNA, 13 bp, Unknown
  misc_feature (1)..( 13): Result.005 file - promoters50/3437244
ctgaaaatattaa

SEQ ID NO: 184037 - DNA, 11 bp, Unknown
  misc_feature (1)..( 11): Result.005 file - promoters50/3437244
taacaaaaaga

SEQ ID NO: 184038 - DNA, 11 bp, Unknown
  misc_feature (1)..( 11): Result.005 file - promoters50/3437244
aattaaaaagg

SEQ ID NO: 184039 - DNA, 11 bp, Unknown
  misc_feature (1)..( 11): Result.005 file - promoters50/3437244
aaccaaaacca

SEQ ID NO: 184040 - DNA, 11 bp, Unknown
  misc_feature (1)..( 11): Result.005 file - promoters50/3437244
aaacaaaaact

SEQ ID NO: 184041 - DNA, 11 bp, Unknown
  misc_feature (1)..( 11): Result.005 file - promoters50/3437244
gaccaaatacg

SEQ ID NO: 184042 - DNA, 11 bp, Unknown
  misc_feature (1)..( 11): Result.005 file - promoters50/3437244
acgtaaagact

SEQ ID NO: 184043 - DNA, 17 bp, Unknown
  misc_feature (1)..( 17): Result.005 file - promoters50/3437244
cattttaaaaaaagaag

SEQ ID NO: 184044 - DNA, 17 bp, Unknown
  misc_feature (1)..( 17): Result.005 file - promoters50/3437244
atagtcaaacaaatgtt

SEQ ID NO: 184045 - DNA, 17 bp, Unknown
  misc_feature (1)..( 17): Result.005 file - promoters50/3437244
aataataataaaataat

SEQ ID NO: 184046 - DNA, 17 bp, Unknown
  misc_feature (1)..( 17): Result.005 file - promoters50/3437244
caactatccaaaatgaa

SEQ ID NO: 184047 - DNA, 17 bp, Unknown
  misc_feature (1)..( 17): Result.005 file - promoters50/3437244
ttctataaataaatttt

SEQ ID NO: 184048 - DNA, 17 bp, Unknown
  misc_feature (1)..( 17): Result.005 file - promoters50/3437244
aatgataataagacttt

SEQ ID NO: 184049 - DNA, 10 bp, Unknown
  misc_feature (1)..( 10): Result.005 file - promoters50/3437331
aattatatgt

SEQ ID NO: 184050 - DNA, 10 bp, Unknown
  misc_feature (1)..( 10): Result.005 file - promoters50/3437331
ttttatttgt

SEQ ID NO: 184051 - DNA, 11 bp, Unknown
  misc_feature (1)..( 11): Result.005 file - promoters50/3437331
cttctatgtgt

SEQ ID NO: 184052 - DNA, 11 bp, Unknown
  misc_feature (1)..( 11): Result.005 file - promoters50/3437331
gtttgattttg

SEQ ID NO: 184053 - DNA, 11 bp, Unknown
  misc_feature (1)..( 11): Result.005 file - promoters50/3437331
gtacgatttgt

SEQ ID NO: 184054 - DNA, 11 bp, Unknown
  misc_feature (1)..( 11): Result.005 file - promoters50/3437331
tacttacttga

SEQ ID NO: 184055 - DNA, 16 bp, Unknown
  misc_feature (1)..( 16): Result.005 file - promoters50/3437331
ataagaaattgagaaa

SEQ ID NO: 184056 - DNA, 16 bp, Unknown
  misc_feature (1)..( 16): Result.005 file - promoters50/3437331
ttcagatatttttggc

SEQ ID NO: 184057 - DNA, 16 bp, Unknown
  misc_feature (1)..( 16): Result.005 file - promoters50/3437331
tatcgaatttgtccca

SEQ ID NO: 184058 - DNA, 16 bp, Unknown
  misc_feature (1)..( 16): Result.005 file - promoters50/3437331
tgaagaaaaaccctaa

SEQ ID NO: 184059 - DNA, 16 bp, Unknown
  misc_feature (1)..( 16): Result.005 file - promoters50/3437331
ttcatataatacaaaa

SEQ ID NO: 184060 - DNA, 16 bp, Unknown
  misc_feature (1)..( 16): Result.005 file - promoters50/3437331
agccgaatttctccca

SEQ ID NO: 184061 - DNA, 12 bp, Unknown
  misc_feature (1)..( 12): Result.005 file - promoters50/3437331
taccgaatggaa

SEQ ID NO: 184062 - DNA, 12 bp, Unknown
  misc_feature (1)..( 12): Result.005 file - promoters50/3437331
aaccaaattaca

SEQ ID NO: 184063 - DNA, 12 bp, Unknown
  misc_feature (1)..( 12): Result.005 file - promoters50/3437331
aaccagattaaa

SEQ ID NO: 184064 - DNA, 12 bp, Unknown
  misc_feature (1)..( 12): Result.005 file - promoters50/3437331
tcatagataaaa

SEQ ID NO: 184065 - DNA, 12 bp, Unknown
  misc_feature (1)..( 12): Result.005 file - promoters50/3437331
tgtcaaatttgt

SEQ ID NO: 184066 - DNA, 12 bp, Unknown
  misc_feature (1)..( 12): Result.005 file - promoters50/3437331
gaccaaaacgcg

SEQ ID NO: 184067 - DNA, 11 bp, Unknown
  misc_feature (1)..( 11): Result.005 file - promoters50/3437367
aaatttagtaa

SEQ ID NO: 184068 - DNA, 11 bp, Unknown
  misc_feature (1)..( 11): Result.005 file - promoters50/3437367
aaaattattaa

SEQ ID NO: 184069 - DNA, 11 bp, Unknown
  misc_feature (1)..( 11): Result.005 file - promoters50/3437367
tcaattactaa

SEQ ID NO: 184070 - DNA, 11 bp, Unknown
  misc_feature (1)..( 11): Result.005 file - promoters50/3437367
taatctagagg

SEQ ID NO: 184071 - DNA, 11 bp, Unknown
  misc_feature (1)..( 11): Result.005 file - promoters50/3437367
acatttctagt

SEQ ID NO: 184072 - DNA, 11 bp, Unknown
  misc_feature (1)..( 11): Result.005 file - promoters50/3437367
aaatcgagaga

SEQ ID NO: 184073 - DNA, 12 bp, Unknown
  misc_feature (1)..( 12): Result.005 file - promoters50/3437367
atgcattgtgag

SEQ ID NO: 184074 - DNA, 12 bp, Unknown
  misc_feature (1)..( 12): Result.005 file - promoters50/3437367
tattattttgaa

SEQ ID NO: 184075 - DNA, 12 bp, Unknown
  misc_feature (1)..( 12): Result.005 file - promoters50/3437367
ccatgtttcgaa

SEQ ID NO: 184076 - DNA, 12 bp, Unknown
  misc_feature (1)..( 12): Result.005 file - promoters50/3437367
gtttatttttta

SEQ ID NO: 184077 - DNA, 12 bp, Unknown
  misc_feature (1)..( 12): Result.005 file - promoters50/3437367
gtttctttgctc

SEQ ID NO: 184078 - DNA, 12 bp, Unknown
  misc_feature (1)..( 12): Result.005 file - promoters50/3437367
ttttattttacc

SEQ ID NO: 184079 - DNA, 9 bp, Unknown
  misc_feature (1)..( 9): Result.005 file - promoters50/3437367
attattatt

SEQ ID NO: 184080 - DNA, 9 bp, Unknown
  misc_feature (1)..( 9): Result.005 file - promoters50/3437367
atttttatt

SEQ ID NO: 184081 - DNA, 9 bp, Unknown
  misc_feature (1)..( 9): Result.005 file - promoters50/3437367
attattcaa

SEQ ID NO: 184082 - DNA, 9 bp, Unknown
  misc_feature (1)..( 9): Result.005 file - promoters50/3437367
gtttttaag

SEQ ID NO: 184083 - DNA, 9 bp, Unknown
  misc_feature (1)..( 9): Result.005 file - promoters50/3437367
tttagtcag

SEQ ID NO: 184084 - DNA, 9 bp, Unknown
  misc_feature (1)..( 9): Result.005 file - promoters50/3437367
atttggtct

SEQ ID NO: 184085 - DNA, 20 bp, Unknown
  misc_feature (1)..( 20): Result.005 file - promoters50/3437367
agagtttttaagaagattag

SEQ ID NO: 184086 - DNA, 20 bp, Unknown
  misc_feature (1)..( 20): Result.005 file - promoters50/3437367
tcagtgtttgatgcatagtt

SEQ ID NO: 184087 - DNA, 20 bp, Unknown
  misc_feature (1)..( 20): Result.005 file - promoters50/3437367
ctcatttttattttaatggt

SEQ ID NO: 184088 - DNA, 20 bp, Unknown
  misc_feature (1)..( 20): Result.005 file - promoters50/3437367
tgatgttttaatttaaatgg

SEQ ID NO: 184089 - DNA, 20 bp, Unknown
  misc_feature (1)..( 20): Result.005 file - promoters50/3437367
tcacttttcatttggtctcc

SEQ ID NO: 184090 - DNA, 20 bp, Unknown
  misc_feature (1)..( 20): Result.005 file - promoters50/3437367
aaatggtttaattgcttact

SEQ ID NO: 184091 - DNA, 20 bp, Unknown
  misc_feature (1)..( 20): Result.005 file - promoters50/3437367
cgacaatttgattccttgtt

SEQ ID NO: 184092 - DNA, 10 bp, Unknown
  misc_feature (1)..( 10): Result.005 file - promoters50/3437575
taaagaagaa

SEQ ID NO: 184093 - DNA, 10 bp, Unknown
  misc_feature (1)..( 10): Result.005 file - promoters50/3437575
taatgaagaa

SEQ ID NO: 184094 - DNA, 11 bp, Unknown
  misc_feature (1)..( 11): Result.005 file - promoters50/3437575
caatttaagtt

SEQ ID NO: 184095 - DNA, 8 bp, Unknown
  misc_feature (1)..( 8): Result.005 file - promoters50/3437575
taaattaa

SEQ ID NO: 184096 - DNA, 8 bp, Unknown
  misc_feature (1)..( 8): Result.005 file - promoters50/3437575
taagttaa

SEQ ID NO: 184097 - DNA, 8 bp, Unknown
  misc_feature (1)..( 8): Result.005 file - promoters50/3437575
gaagataa

SEQ ID NO: 184098 - DNA, 10 bp, Unknown
  misc_feature (1)..( 10): Result.005 file - promoters50/3437652
attaacaatc

SEQ ID NO: 184099 - DNA, 10 bp, Unknown
  misc_feature (1)..( 10): Result.005 file - promoters50/3437652
cctaaaaata

SEQ ID NO: 184100 - DNA, 10 bp, Unknown
  misc_feature (1)..( 10): Result.005 file - promoters50/3437652
gaaaacaatg

SEQ ID NO: 184101 - DNA, 10 bp, Unknown
  misc_feature (1)..( 10): Result.005 file - promoters50/3437652
attaaaaaaa

SEQ ID NO: 184102 - DNA, 10 bp, Unknown
  misc_feature (1)..( 10): Result.005 file - promoters50/3437652
tgtaagaaaa

SEQ ID NO: 184103 - DNA, 10 bp, Unknown
  misc_feature (1)..( 10): Result.005 file - promoters50/3437652
attaaaaaaa

SEQ ID NO: 184104 - DNA, 10 bp, Unknown
  misc_feature (1)..( 10): Result.005 file - promoters50/3437652
gaactttggt

SEQ ID NO: 184105 - DNA, 10 bp, Unknown
  misc_feature (1)..( 10): Result.005 file - promoters50/3437652
gaattttttt

SEQ ID NO: 184106 - DNA, 10 bp, Unknown
  misc_feature (1)..( 10): Result.005 file - promoters50/3437652
gaagtttctg

SEQ ID NO: 184107 - DNA, 10 bp, Unknown
  misc_feature (1)..( 10): Result.005 file - promoters50/3437652
taagtttaag

SEQ ID NO: 184108 - DNA, 10 bp, Unknown
  misc_feature (1)..( 10): Result.005 file - promoters50/3437652
tcatttattt

SEQ ID NO: 184109 - DNA, 10 bp, Unknown
  misc_feature (1)..( 10): Result.005 file - promoters50/3437652
taattttata

SEQ ID NO: 184110 - DNA, 12 bp, Unknown
  misc_feature (1)..( 12): Result.005 file - promoters50/3437652
aagaaatggtcc

SEQ ID NO: 184111 - DNA, 12 bp, Unknown
  misc_feature (1)..( 12): Result.005 file - promoters50/3437652
gagaaatgccat

SEQ ID NO: 184112 - DNA, 12 bp, Unknown
  misc_feature (1)..( 12): Result.005 file - promoters50/3437652
tagatatgataa

SEQ ID NO: 184113 - DNA, 12 bp, Unknown
  misc_feature (1)..( 12): Result.005 file - promoters50/3437652
aacatattataa

SEQ ID NO: 184114 - DNA, 12 bp, Unknown
  misc_feature (1)..( 12): Result.005 file - promoters50/3437652
aacatatgacta

SEQ ID NO: 184115 - DNA, 12 bp, Unknown
  misc_feature (1)..( 12): Result.005 file - promoters50/3437652
tagataatcctc

SEQ ID NO: 184116 - DNA, 9 bp, Unknown
  misc_feature (1)..( 9): Result.005 file - promoters50/3437652
aaaagttat

SEQ ID NO: 184117 - DNA, 9 bp, Unknown
  misc_feature (1)..( 9): Result.005 file - promoters50/3437652
aaaagtttt

SEQ ID NO: 184118 - DNA, 9 bp, Unknown
  misc_feature (1)..( 9): Result.005 file - promoters50/3437652
aaaattagc

SEQ ID NO: 184119 - DNA, 9 bp, Unknown
  misc_feature (1)..( 9): Result.005 file - promoters50/3437652
aaaagtcag

SEQ ID NO: 184120 - DNA, 9 bp, Unknown
  misc_feature (1)..( 9): Result.005 file - promoters50/3437652
aaaatttga

SEQ ID NO: 184121 - DNA, 9 bp, Unknown
  misc_feature (1)..( 9): Result.005 file - promoters50/3437652
taaattttg

SEQ ID NO: 184122 - DNA, 10 bp, Unknown
  misc_feature (1)..( 10): Result.005 file - promoters50/3437652
ataaatattc

SEQ ID NO: 184123 - DNA, 10 bp, Unknown
  misc_feature (1)..( 10): Result.005 file - promoters50/3437652
taaaaaattt

SEQ ID NO: 184124 - DNA, 10 bp, Unknown
  misc_feature (1)..( 10): Result.005 file - promoters50/3437652
acaaaacttt

SEQ ID NO: 184125 - DNA, 10 bp, Unknown
  misc_feature (1)..( 10): Result.005 file - promoters50/3437652
acaaaaccct

SEQ ID NO: 184126 - DNA, 10 bp, Unknown
  misc_feature (1)..( 10): Result.005 file - promoters50/3437652
agaaaaaaaa

SEQ ID NO: 184127 - DNA, 10 bp, Unknown
  misc_feature (1)..( 10): Result.005 file - promoters50/3437652
ccaagaccaa

SEQ ID NO: 184128 - DNA, 10 bp, Unknown
  misc_feature (1)..( 10): Result.005 file - promoters50/3437660
attactttgg

SEQ ID NO: 184129 - DNA, 10 bp, Unknown
  misc_feature (1)..( 10): Result.005 file - promoters50/3437660
attactttta

SEQ ID NO: 184130 - DNA, 10 bp, Unknown
  misc_feature (1)..( 10): Result.005 file - promoters50/3437660
attaatttat

SEQ ID NO: 184131 - DNA, 10 bp, Unknown
  misc_feature (1)..( 10): Result.005 file - promoters50/3437660
tgaactatgg

SEQ ID NO: 184132 - DNA, 10 bp, Unknown
  misc_feature (1)..( 10): Result.005 file - promoters50/3437660
tgaaatatat

SEQ ID NO: 184133 - DNA, 10 bp, Unknown
  misc_feature (1)..( 10): Result.005 file - promoters50/3437660
aaaaagatag

SEQ ID NO: 184134 - DNA, 10 bp, Unknown
  misc_feature (1)..( 10): Result.005 file - promoters50/3437660
ctaactcatg

SEQ ID NO: 184135 - DNA, 10 bp, Unknown
  misc_feature (1)..( 10): Result.005 file - promoters50/3437660
ataattcaaa

SEQ ID NO: 184136 - DNA, 10 bp, Unknown
  misc_feature (1)..( 10): Result.005 file - promoters50/3437660
taaattaaaa

SEQ ID NO: 184137 - DNA, 10 bp, Unknown
  misc_feature (1)..( 10): Result.005 file - promoters50/3437660
ataatttgat

SEQ ID NO: 184138 - DNA, 10 bp, Unknown
  misc_feature (1)..( 10): Result.005 file - promoters50/3437660
tcaattcaca

SEQ ID NO: 184139 - DNA, 10 bp, Unknown
  misc_feature (1)..( 10): Result.005 file - promoters50/3437660
taaattcagc

SEQ ID NO: 184140 - DNA, 7 bp, Unknown
  misc_feature (1)..( 7): Result.005 file - promoters50/3437664
gtatata

SEQ ID NO: 184141 - DNA, 7 bp, Unknown
  misc_feature (1)..( 7): Result.005 file - promoters50/3437664
ttatata

SEQ ID NO: 184142 - DNA, 7 bp, Unknown
  misc_feature (1)..( 7): Result.005 file - promoters50/3437664
atacata

SEQ ID NO: 184143 - DNA, 9 bp, Unknown
  misc_feature (1)..( 9): Result.005 file - promoters50/3437664
catttattt

SEQ ID NO: 184144 - DNA, 9 bp, Unknown
  misc_feature (1)..( 9): Result.005 file - promoters50/3437664
aatttattt

SEQ ID NO: 184145 - DNA, 9 bp, Unknown
  misc_feature (1)..( 9): Result.005 file - promoters50/3437664
catctatac

SEQ ID NO: 184146 - DNA, 7 bp, Unknown
  misc_feature (1)..( 7): Result.005 file - promoters50/3437664
atttatt

SEQ ID NO: 184147 - DNA, 7 bp, Unknown
  misc_feature (1)..( 7): Result.005 file - promoters50/3437664
attcatt

SEQ ID NO: 184148 - DNA, 7 bp, Unknown
  misc_feature (1)..( 7): Result.005 file - promoters50/3437664
atttata

SEQ ID NO: 184149 - DNA, 7 bp, Unknown
  misc_feature (1)..( 7): Result.005 file - promoters50/3437671
ttaggtc

SEQ ID NO: 184150 - DNA, 7 bp, Unknown
  misc_feature (1)..( 7): Result.005 file - promoters50/3437671
ttaggtg

SEQ ID NO: 184151 - DNA, 7 bp, Unknown
  misc_feature (1)..( 7): Result.005 file - promoters50/3437671
ttatgtg

SEQ ID NO: 184152 - DNA, 9 bp, Unknown
  misc_feature (1)..( 9): Result.005 file - promoters50/3437683
atatctttt

SEQ ID NO: 184153 - DNA, 9 bp, Unknown
  misc_feature (1)..( 9): Result.005 file - promoters50/3437683
atatttttt

SEQ ID NO: 184154 - DNA, 9 bp, Unknown
  misc_feature (1)..( 9): Result.005 file - promoters50/3437683
aagtttttg

SEQ ID NO: 184155 - DNA, 9 bp, Unknown
  misc_feature (1)..( 9): Result.005 file - promoters50/3437683
acattttta

SEQ ID NO: 184156 - DNA, 10 bp, Unknown
  misc_feature (1)..( 10): Result.005 file - promoters50/3437683
ccttataaat

SEQ ID NO: 184157 - DNA, 10 bp, Unknown
  misc_feature (1)..( 10): Result.005 file - promoters50/3437683
ttctataaat

SEQ ID NO: 184158 - DNA, 10 bp, Unknown
  misc_feature (1)..( 10): Result.005 file - promoters50/3437683
ttctataagt

SEQ ID NO: 184159 - DNA, 8 bp, Unknown
  misc_feature (1)..( 8): Result.005 file - promoters50/3437683
aattgatc

SEQ ID NO: 184160 - DNA, 8 bp, Unknown
  misc_feature (1)..( 8): Result.005 file - promoters50/3437683
aattgatt

SEQ ID NO: 184161 - DNA, 8 bp, Unknown
  misc_feature (1)..( 8): Result.005 file - promoters50/3437683
gattcatt

SEQ ID NO: 184162 - DNA, 8 bp, Unknown
  misc_feature (1)..( 8): Result.005 file - promoters50/3437683
ttttacta

SEQ ID NO: 184163 - DNA, 8 bp, Unknown
  misc_feature (1)..( 8): Result.005 file - promoters50/3437683
ttttacta

SEQ ID NO: 184164 - DNA, 8 bp, Unknown
  misc_feature (1)..( 8): Result.005 file - promoters50/3437683
cattacta

SEQ ID NO: 184165 - DNA, 11 bp, Unknown
  misc_feature (1)..( 11): Result.005 file - promoters50/3437710
caaggaattta

SEQ ID NO: 184166 - DNA, 11 bp, Unknown
  misc_feature (1)..( 11): Result.005 file - promoters50/3437710
cgaataattta

SEQ ID NO: 184167 - DNA, 11 bp, Unknown
  misc_feature (1)..( 11): Result.005 file - promoters50/3437710
ttcataatttg

SEQ ID NO: 184168 - DNA, 11 bp, Unknown
  misc_feature (1)..( 11): Result.005 file - promoters50/3437710
cacataatgca

SEQ ID NO: 184169 - DNA, 11 bp, Unknown
  misc_feature (1)..( 11): Result.005 file - promoters50/3437710
ttcaaaatttt

SEQ ID NO: 184170 - DNA, 12 bp, Unknown
  misc_feature (1)..( 12): Result.005 file - promoters50/3437710
gtgtaaatcttt

SEQ ID NO: 184171 - DNA, 15 bp, Unknown
  misc_feature (1)..( 15): Result.005 file - promoters50/3437710
aaaataaaacattat

SEQ ID NO: 184172 - DNA, 15 bp, Unknown
  misc_feature (1)..( 15): Result.005 file - promoters50/3437710
aattaaaatcattaa

SEQ ID NO: 184173 - DNA, 15 bp, Unknown
  misc_feature (1)..( 15): Result.005 file - promoters50/3437710
tatataaatcatatg

SEQ ID NO: 184174 - DNA, 15 bp, Unknown
  misc_feature (1)..( 15): Result.005 file - promoters50/3437710
tttacatttcaataa

SEQ ID NO: 184175 - DNA, 15 bp, Unknown
  misc_feature (1)..( 15): Result.005 file - promoters50/3437710
tatataaaccaattt

SEQ ID NO: 184176 - DNA, 15 bp, Unknown
  misc_feature (1)..( 15): Result.005 file - promoters50/3437710
tatatattgcaatct

SEQ ID NO: 184177 - DNA, 10 bp, Unknown
  misc_feature (1)..( 10): Result.005 file - promoters50/3437710
aaattcgaat

SEQ ID NO: 184178 - DNA, 10 bp, Unknown
  misc_feature (1)..( 10): Result.005 file - promoters50/3437710
aaattcataa

SEQ ID NO: 184179 - DNA, 10 bp, Unknown
  misc_feature (1)..( 10): Result.005 file - promoters50/3437710
gaattcatgg

SEQ ID NO: 184180 - DNA, 10 bp, Unknown
  misc_feature (1)..( 10): Result.005 file - promoters50/3437710
aaattcattg

SEQ ID NO: 184181 - DNA, 10 bp, Unknown
  misc_feature (1)..( 10): Result.005 file - promoters50/3437710
tcgttctttg

SEQ ID NO: 184182 - DNA, 10 bp, Unknown
  misc_feature (1)..( 10): Result.005 file - promoters50/3437710
taaatctttg

SEQ ID NO: 184183 - DNA, 10 bp, Unknown
  misc_feature (1)..( 10): Result.005 file - promoters50/3437710
aaattttttt

SEQ ID NO: 184184 - DNA, 8 bp, Unknown
  misc_feature (1)..( 8): Result.005 file - promoters50/3437725
tagagcaa

SEQ ID NO: 184185 - DNA, 8 bp, Unknown
  misc_feature (1)..( 8): Result.005 file - promoters50/3437725
gagaacaa

SEQ ID NO: 184186 - DNA, 8 bp, Unknown
  misc_feature (1)..( 8): Result.005 file - promoters50/3437725
gagaaaac

SEQ ID NO: 184187 - DNA, 8 bp, Unknown
  misc_feature (1)..( 8): Result.005 file - promoters50/3437725
tgaaaatc

SEQ ID NO: 184188 - DNA, 8 bp, Unknown
  misc_feature (1)..( 8): Result.005 file - promoters50/3437725
tgataata

SEQ ID NO: 184189 - DNA, 8 bp, Unknown
  misc_feature (1)..( 8): Result.005 file - promoters50/3437725
aaataata

SEQ ID NO: 184190 - DNA, 7 bp, Unknown
  misc_feature (1)..( 7): Result.005 file - promoters50/3437776
atttacc

SEQ ID NO: 184191 - DNA, 7 bp, Unknown
  misc_feature (1)..( 7): Result.005 file - promoters50/3437776
attaacc

SEQ ID NO: 184192 - DNA, 7 bp, Unknown
  misc_feature (1)..( 7): Result.005 file - promoters50/3437776
atttaca

SEQ ID NO: 184193 - DNA, 11 bp, Unknown
  misc_feature (1)..( 11): Result.005 file - promoters50/3437779
agtatatttcc

SEQ ID NO: 184194 - DNA, 11 bp, Unknown
  misc_feature (1)..( 11): Result.005 file - promoters50/3437779
tatatattcta

SEQ ID NO: 184195 - DNA, 11 bp, Unknown
  misc_feature (1)..( 11): Result.005 file - promoters50/3437779
agtatataatt

SEQ ID NO: 184196 - DNA, 11 bp, Unknown
  misc_feature (1)..( 11): Result.005 file - promoters50/3437779
tttatttttta

SEQ ID NO: 184197 - DNA, 11 bp, Unknown
  misc_feature (1)..( 11): Result.005 file - promoters50/3437779
gagatttcttt

SEQ ID NO: 184198 - DNA, 11 bp, Unknown
  misc_feature (1)..( 11): Result.005 file - promoters50/3437779
gatatgagaaa

SEQ ID NO: 184199 - DNA, 11 bp, Unknown
  misc_feature (1)..( 11): Result.005 file - promoters50/3437779
catctgacaaa

SEQ ID NO: 184200 - DNA, 11 bp, Unknown
  misc_feature (1)..( 11): Result.005 file - promoters50/3437779
tttctaacaaa

SEQ ID NO: 184201 - DNA, 11 bp, Unknown
  misc_feature (1)..( 11): Result.005 file - promoters50/3437779
ctaatgacaat

SEQ ID NO: 184202 - DNA, 11 bp, Unknown
  misc_feature (1)..( 11): Result.005 file - promoters50/3437779
tttttaatttg

SEQ ID NO: 184203 - DNA, 9 bp, Unknown
  misc_feature (1)..( 9): Result.005 file - promoters50/3437779
attactttt

SEQ ID NO: 184204 - DNA, 9 bp, Unknown
  misc_feature (1)..( 9): Result.005 file - promoters50/3437779
atttctttg

SEQ ID NO: 184205 - DNA, 9 bp, Unknown
  misc_feature (1)..( 9): Result.005 file - promoters50/3437779
tttaatttt

SEQ ID NO: 184206 - DNA, 9 bp, Unknown
  misc_feature (1)..( 9): Result.005 file - promoters50/3437779
tttattttt

SEQ ID NO: 184207 - DNA, 9 bp, Unknown
  misc_feature (1)..( 9): Result.005 file - promoters50/3437779
cctattttt

SEQ ID NO: 184208 - DNA, 12 bp, Unknown
  misc_feature (1)..( 12): Result.005 file - promoters50/3437779
gatattattatg

SEQ ID NO: 184209 - DNA, 12 bp, Unknown
  misc_feature (1)..( 12): Result.005 file - promoters50/3437779
aaaattattaaa

SEQ ID NO: 184210 - DNA, 12 bp, Unknown
  misc_feature (1)..( 12): Result.005 file - promoters50/3437779
gcatttactaat

SEQ ID NO: 184211 - DNA, 12 bp, Unknown
  misc_feature (1)..( 12): Result.005 file - promoters50/3437779
aaaatcattata

SEQ ID NO: 184212 - DNA, 12 bp, Unknown
  misc_feature (1)..( 12): Result.005 file - promoters50/3437779
cataacattata

SEQ ID NO: 184213 - DNA, 12 bp, Unknown
  misc_feature (1)..( 12): Result.005 file - promoters50/3437803
tttattttaaag

SEQ ID NO: 184214 - DNA, 12 bp, Unknown
  misc_feature (1)..( 12): Result.005 file - promoters50/3437803
tcctatttaaat

SEQ ID NO: 184215 - DNA, 12 bp, Unknown
  misc_feature (1)..( 12): Result.005 file - promoters50/3437803
ccctatataaag

SEQ ID NO: 184216 - DNA, 12 bp, Unknown
  misc_feature (1)..( 12): Result.005 file - promoters50/3437803
tcctatttaaac

SEQ ID NO: 184217 - DNA, 12 bp, Unknown
  misc_feature (1)..( 12): Result.005 file - promoters50/3437803
gataatataaag

SEQ ID NO: 184218 - DNA, 8 bp, Unknown
  misc_feature (1)..( 8): Result.005 file - promoters50/3437803
ttctaaaa

SEQ ID NO: 184219 - DNA, 8 bp, Unknown
  misc_feature (1)..( 8): Result.005 file - promoters50/3437803
ttccaaaa

SEQ ID NO: 184220 - DNA, 8 bp, Unknown
  misc_feature (1)..( 8): Result.005 file - promoters50/3437803
ttctaagc

SEQ ID NO: 184221 - DNA, 8 bp, Unknown
  misc_feature (1)..( 8): Result.005 file - promoters50/3437803
gaccaaaa

SEQ ID NO: 184222 - DNA, 8 bp, Unknown
  misc_feature (1)..( 8): Result.005 file - promoters50/3437803
gtccaaag

SEQ ID NO: 184223 - DNA, 11 bp, Unknown
  misc_feature (1)..( 11): Result.005 file - promoters50/3437871
aaacgaaacac

SEQ ID NO: 184224 - DNA, 11 bp, Unknown
  misc_feature (1)..( 11): Result.005 file - promoters50/3437871
gatggaaacaa

SEQ ID NO: 184225 - DNA, 11 bp, Unknown
  misc_feature (1)..( 11): Result.005 file - promoters50/3437871
gacaaaaacct

SEQ ID NO: 184226 - DNA, 11 bp, Unknown
  misc_feature (1)..( 11): Result.005 file - promoters50/3437871
gaccaaaagag

SEQ ID NO: 184227 - DNA, 11 bp, Unknown
  misc_feature (1)..( 11): Result.005 file - promoters50/3437871
agaaaaaattt

SEQ ID NO: 184228 - DNA, 11 bp, Unknown
  misc_feature (1)..( 11): Result.005 file - promoters50/3437871
tattaaaattt

SEQ ID NO: 184229 - DNA, 11 bp, Unknown
  misc_feature (1)..( 11): Result.005 file - promoters50/3437871
aaagaaaatta

SEQ ID NO: 184230 - DNA, 11 bp, Unknown
  misc_feature (1)..( 11): Result.005 file - promoters50/3437871
aaaggaaatgt

SEQ ID NO: 184231 - DNA, 11 bp, Unknown
  misc_feature (1)..( 11): Result.005 file - promoters50/3437871
agaaaaagaag

SEQ ID NO: 184232 - DNA, 11 bp, Unknown
  misc_feature (1)..( 11): Result.005 file - promoters50/3437871
cataaaagaaa

SEQ ID NO: 184233 - DNA, 11 bp, Unknown
  misc_feature (1)..( 11): Result.005 file - promoters50/3437871
tgtcaaagaag

SEQ ID NO: 184234 - DNA, 12 bp, Unknown
  misc_feature (1)..( 12): Result.005 file - promoters50/3437871
catataagcaaa

SEQ ID NO: 184235 - DNA, 7 bp, Unknown
  misc_feature (1)..( 7): Result.005 file - promoters50/3437962
attttta

SEQ ID NO: 184236 - DNA, 7 bp, Unknown
  misc_feature (1)..( 7): Result.005 file - promoters50/3437962
atttttt

SEQ ID NO: 184237 - DNA, 8 bp, Unknown
  misc_feature (1)..( 8): Result.005 file - promoters50/3437962
gtttatta

SEQ ID NO: 184238 - DNA, 8 bp, Unknown
  misc_feature (1)..( 8): Result.005 file - promoters50/3437962
atttaaat

SEQ ID NO: 184239 - DNA, 8 bp, Unknown
  misc_feature (1)..( 8): Result.005 file - promoters50/3437962
ttttaaaa

SEQ ID NO: 184240 - DNA, 8 bp, Unknown
  misc_feature (1)..( 8): Result.005 file - promoters50/3437962
aattaaaa

SEQ ID NO: 184241 - DNA, 7 bp, Unknown
  misc_feature (1)..( 7): Result.005 file - promoters50/3438027
gttcttt

SEQ ID NO: 184242 - DNA, 7 bp, Unknown
  misc_feature (1)..( 7): Result.005 file - promoters50/3438027
tttcttt

SEQ ID NO: 184243 - DNA, 7 bp, Unknown
  misc_feature (1)..( 7): Result.005 file - promoters50/3438027
tttcttc

SEQ ID NO: 184244 - DNA, 9 bp, Unknown
  misc_feature (1)..( 9): Result.005 file - promoters50/3438046
taacaaaca

SEQ ID NO: 184245 - DNA, 9 bp, Unknown
  misc_feature (1)..( 9): Result.005 file - promoters50/3438046
taagaaaac

SEQ ID NO: 184246 - DNA, 9 bp, Unknown
  misc_feature (1)..( 9): Result.005 file - promoters50/3438046
catgaaaga

SEQ ID NO: 184247 - DNA, 11 bp, Unknown
  misc_feature (1)..( 11): Result.005 file - promoters50/3438046
tgacgatttat

SEQ ID NO: 184248 - DNA, 11 bp, Unknown
  misc_feature (1)..( 11): Result.005 file - promoters50/3438046
cctatatttat

SEQ ID NO: 184249 - DNA, 11 bp, Unknown
  misc_feature (1)..( 11): Result.005 file - promoters50/3438046
cctaaatttac

SEQ ID NO: 184250 - DNA, 8 bp, Unknown
  misc_feature (1)..( 8): Result.005 file - promoters50/3438065
tgtaaaag

SEQ ID NO: 184251 - DNA, 8 bp, Unknown
  misc_feature (1)..( 8): Result.005 file - promoters50/3438065
agtaaaat

SEQ ID NO: 184252 - DNA, 8 bp, Unknown
  misc_feature (1)..( 8): Result.005 file - promoters50/3438065
attaaaat

SEQ ID NO: 184253 - DNA, 8 bp, Unknown
  misc_feature (1)..( 8): Result.005 file - promoters50/3438065
agttaaat

SEQ ID NO: 184254 - DNA, 12 bp, Unknown
  misc_feature (1)..( 12): Result.005 file - promoters50/3438065
agaatcaaaaca

SEQ ID NO: 184255 - DNA, 12 bp, Unknown
  misc_feature (1)..( 12): Result.005 file - promoters50/3438065
ttaatcaaaagt

SEQ ID NO: 184256 - DNA, 12 bp, Unknown
  misc_feature (1)..( 12): Result.005 file - promoters50/3438065
ttattcagaaaa

SEQ ID NO: 184257 - DNA, 12 bp, Unknown
  misc_feature (1)..( 12): Result.005 file - promoters50/3438065
aaagacaaaagt

SEQ ID NO: 184258 - DNA, 9 bp, Unknown
  misc_feature (1)..( 9): Result.005 file - promoters50/3438065
gaaactttg

SEQ ID NO: 184259 - DNA, 9 bp, Unknown
  misc_feature (1)..( 9): Result.005 file - promoters50/3438065
gaaaatttg

SEQ ID NO: 184260 - DNA, 9 bp, Unknown
  misc_feature (1)..( 9): Result.005 file - promoters50/3438065
gaagctttt

SEQ ID NO: 184261 - DNA, 9 bp, Unknown
  misc_feature (1)..( 9): Result.005 file - promoters50/3438065
ataaattta

SEQ ID NO: 184262 - DNA, 13 bp, Unknown
  misc_feature (1)..( 13): Result.005 file - promoters50/3438065
aaaacagagcttc

SEQ ID NO: 184263 - DNA, 13 bp, Unknown
  misc_feature (1)..( 13): Result.005 file - promoters50/3438065
aaaacaaacgaaa

SEQ ID NO: 184264 - DNA, 13 bp, Unknown
  misc_feature (1)..( 13): Result.005 file - promoters50/3438065
aaaaaaaaaaaaa

SEQ ID NO: 184265 - DNA, 13 bp, Unknown
  misc_feature (1)..( 13): Result.005 file - promoters50/3438065
aaagaaatatcgc

SEQ ID NO: 184266 - DNA, 10 bp, Unknown
  misc_feature (1)..( 10): Result.005 file - promoters50/3438077
aaagcccatt

SEQ ID NO: 184267 - DNA, 10 bp, Unknown
  misc_feature (1)..( 10): Result.005 file - promoters50/3438077
aaagcccaaa

SEQ ID NO: 184268 - DNA, 10 bp, Unknown
  misc_feature (1)..( 10): Result.005 file - promoters50/3438077
aaagccctag

SEQ ID NO: 184269 - DNA, 10 bp, Unknown
  misc_feature (1)..( 10): Result.005 file - promoters50/3438077
taggcccaac

SEQ ID NO: 184270 - DNA, 10 bp, Unknown
  misc_feature (1)..( 10): Result.005 file - promoters50/3438077
tcggcccacc

SEQ ID NO: 184271 - DNA, 10 bp, Unknown
  misc_feature (1)..( 10): Result.005 file - promoters50/3438077
aaggcccaat

SEQ ID NO: 184272 - DNA, 10 bp, Unknown
  misc_feature (1)..( 10): Result.005 file - promoters50/3438077
tgggcctaat

SEQ ID NO: 184273 - DNA, 9 bp, Unknown
  misc_feature (1)..( 9): Result.005 file - promoters50/3438077
agacccaaa

SEQ ID NO: 184274 - DNA, 9 bp, Unknown
  misc_feature (1)..( 9): Result.005 file - promoters50/3438077
aagcccaaa

SEQ ID NO: 184275 - DNA, 9 bp, Unknown
  misc_feature (1)..( 9): Result.005 file - promoters50/3438077
aggcccaac

SEQ ID NO: 184276 - DNA, 9 bp, Unknown
  misc_feature (1)..( 9): Result.005 file - promoters50/3438077
cggcccacc

SEQ ID NO: 184277 - DNA, 9 bp, Unknown
  misc_feature (1)..( 9): Result.005 file - promoters50/3438077
aggcccaat

SEQ ID NO: 184278 - DNA, 9 bp, Unknown
  misc_feature (1)..( 9): Result.005 file - promoters50/3438077
gggcctaat

SEQ ID NO: 184279 - DNA, 10 bp, Unknown
  misc_feature (1)..( 10): Result.005 file - promoters50/3438171
atttttattg

SEQ ID NO: 184280 - DNA, 10 bp, Unknown
  misc_feature (1)..( 10): Result.005 file - promoters50/3438171
aattttatta

SEQ ID NO: 184281 - DNA, 10 bp, Unknown
  misc_feature (1)..( 10): Result.005 file - promoters50/3438171
ctttttattt

SEQ ID NO: 184282 - DNA, 10 bp, Unknown
  misc_feature (1)..( 10): Result.005 file - promoters50/3438171
atttttactc

SEQ ID NO: 184283 - DNA, 10 bp, Unknown
  misc_feature (1)..( 10): Result.005 file - promoters50/3438171
ctggttatta

SEQ ID NO: 184284 - DNA, 10 bp, Unknown
  misc_feature (1)..( 10): Result.005 file - promoters50/3438171
gtttctgttt

SEQ ID NO: 184285 - DNA, 12 bp, Unknown
  misc_feature (1)..( 12): Result.005 file - promoters50/3438171
tgtttaaaacaa

SEQ ID NO: 184286 - DNA, 12 bp, Unknown
  misc_feature (1)..( 12): Result.005 file - promoters50/3438171
gatttaaagaca

SEQ ID NO: 184287 - DNA, 12 bp, Unknown
  misc_feature (1)..( 12): Result.005 file - promoters50/3438171
catttaaataaa

SEQ ID NO: 184288 - DNA, 12 bp, Unknown
  misc_feature (1)..( 12): Result.005 file - promoters50/3438171
tgttcaaaattg

SEQ ID NO: 184289 - DNA, 12 bp, Unknown
  misc_feature (1)..( 12): Result.005 file - promoters50/3438171
cctttgaataaa

SEQ ID NO: 184290 - DNA, 12 bp, Unknown
  misc_feature (1)..( 12): Result.005 file - promoters50/3438171
caattaaaaagg

SEQ ID NO: 184291 - DNA, 12 bp, Unknown
  misc_feature (1)..( 12): Result.005 file - promoters50/3438171
tgttcaaggctt

SEQ ID NO: 184292 - DNA, 12 bp, Unknown
  misc_feature (1)..( 12): Result.005 file - promoters50/3438171
tttatataagtg

SEQ ID NO: 184293 - DNA, 12 bp, Unknown
  misc_feature (1)..( 12): Result.005 file - promoters50/3438171
aaaatataaata

SEQ ID NO: 184294 - DNA, 12 bp, Unknown
  misc_feature (1)..( 12): Result.005 file - promoters50/3438171
gctatttaagta

SEQ ID NO: 184295 - DNA, 12 bp, Unknown
  misc_feature (1)..( 12): Result.005 file - promoters50/3438171
cgtatatataaa

SEQ ID NO: 184296 - DNA, 12 bp, Unknown
  misc_feature (1)..( 12): Result.005 file - promoters50/3438171
cacttataaata

SEQ ID NO: 184297 - DNA, 12 bp, Unknown
  misc_feature (1)..( 12): Result.005 file - promoters50/3438171
tatatataaaac

SEQ ID NO: 184298 - DNA, 13 bp, Unknown
  misc_feature (1)..( 13): Result.005 file - promoters50/3438171
caataaaaaaaaa

SEQ ID NO: 184299 - DNA, 13 bp, Unknown
  misc_feature (1)..( 13): Result.005 file - promoters50/3438171
aaataaatttttg

SEQ ID NO: 184300 - DNA, 13 bp, Unknown
  misc_feature (1)..( 13): Result.005 file - promoters50/3438171
ttatatattctgc

SEQ ID NO: 184301 - DNA, 13 bp, Unknown
  misc_feature (1)..( 13): Result.005 file - promoters50/3438171
aaaaaaattcacg

SEQ ID NO: 184302 - DNA, 13 bp, Unknown
  misc_feature (1)..( 13): Result.005 file - promoters50/3438171
aaacaaatgtttg

SEQ ID NO: 184303 - DNA, 13 bp, Unknown
  misc_feature (1)..( 13): Result.005 file - promoters50/3438171
tactgtatgttta

SEQ ID NO: 184304 - DNA, 10 bp, Unknown
  misc_feature (1)..( 10): Result.005 file - promoters50/3438171
aaattataaa

SEQ ID NO: 184305 - DNA, 10 bp, Unknown
  misc_feature (1)..( 10): Result.005 file - promoters50/3438171
aaattttaat

SEQ ID NO: 184306 - DNA, 10 bp, Unknown
  misc_feature (1)..( 10): Result.005 file - promoters50/3438171
taattttcgt

SEQ ID NO: 184307 - DNA, 10 bp, Unknown
  misc_feature (1)..( 10): Result.005 file - promoters50/3438171
tgagtttaat

SEQ ID NO: 184308 - DNA, 10 bp, Unknown
  misc_feature (1)..( 10): Result.005 file - promoters50/3438171
taatgttaac

SEQ ID NO: 184309 - DNA, 10 bp, Unknown
  misc_feature (1)..( 10): Result.005 file - promoters50/3438171
ttatttttta

SEQ ID NO: 184310 - DNA, 12 bp, Unknown
  misc_feature (1)..( 12): Result.005 file - promoters50/3438171
aaaacattgatt

SEQ ID NO: 184311 - DNA, 12 bp, Unknown
  misc_feature (1)..( 12): Result.005 file - promoters50/3438171
aaaaaattcacg

SEQ ID NO: 184312 - DNA, 13 bp, Unknown
  misc_feature (1)..( 13): Result.005 file - promoters50/3438171
aaataaatttttg

SEQ ID NO: 184313 - DNA, 13 bp, Unknown
  misc_feature (1)..( 13): Result.005 file - promoters50/3438171
acatacatatact

SEQ ID NO: 184314 - DNA, 13 bp, Unknown
  misc_feature (1)..( 13): Result.005 file - promoters50/3438171
aaacaaatgtttg

SEQ ID NO: 184315 - DNA, 13 bp, Unknown
  misc_feature (1)..( 13): Result.005 file - promoters50/3438171
tgcaaaattatat

SEQ ID NO: 184316 - DNA, 12 bp, Unknown
  misc_feature (1)..( 12): Result.005 file - promoters50/3438171
cgtaatgtttca

SEQ ID NO: 184317 - DNA, 12 bp, Unknown
  misc_feature (1)..( 12): Result.005 file - promoters50/3438171
attaatatttag

SEQ ID NO: 184318 - DNA, 12 bp, Unknown
  misc_feature (1)..( 12): Result.005 file - promoters50/3438171
cttaatctttta

SEQ ID NO: 184319 - DNA, 12 bp, Unknown
  misc_feature (1)..( 12): Result.005 file - promoters50/3438171
gataatatttca

SEQ ID NO: 184320 - DNA, 12 bp, Unknown
  misc_feature (1)..( 12): Result.005 file - promoters50/3438171
tttaatatgaag

SEQ ID NO: 184321 - DNA, 12 bp, Unknown
  misc_feature (1)..( 12): Result.005 file - promoters50/3438171
tttgatatatac

SEQ ID NO: 184322 - DNA, 13 bp, Unknown
  misc_feature (1)..( 13): Result.005 file - promoters50/3438194
aagaagcagagag

SEQ ID NO: 184323 - DNA, 13 bp, Unknown
  misc_feature (1)..( 13): Result.005 file - promoters50/3438194
acgaaacagagga

SEQ ID NO: 184324 - DNA, 13 bp, Unknown
  misc_feature (1)..( 13): Result.005 file - promoters50/3438194
atgaagcaacttc

SEQ ID NO: 184325 - DNA, 13 bp, Unknown
  misc_feature (1)..( 13): Result.005 file - promoters50/3438194
tccaaggagagag

SEQ ID NO: 184326 - DNA, 13 bp, Unknown
  misc_feature (1)..( 13): Result.005 file - promoters50/3438194
tcgaaacacacac

SEQ ID NO: 184327 - DNA, 13 bp, Unknown
  misc_feature (1)..( 13): Result.005 file - promoters50/3438194
tccatggacaagg

SEQ ID NO: 184328 - DNA, 7 bp, Unknown
  misc_feature (1)..( 7): Result.005 file - promoters50/3438208
aaacaag

SEQ ID NO: 184329 - DNA, 7 bp, Unknown
  misc_feature (1)..( 7): Result.005 file - promoters50/3438208
aaacaat

SEQ ID NO: 184330 - DNA, 7 bp, Unknown
  misc_feature (1)..( 7): Result.005 file - promoters50/3438208
aaataat

SEQ ID NO: 184331 - DNA, 8 bp, Unknown
  misc_feature (1)..( 8): Result.005 file - promoters50/3438222
attactta

SEQ ID NO: 184332 - DNA, 8 bp, Unknown
  misc_feature (1)..( 8): Result.005 file - promoters50/3438222
attaatta

SEQ ID NO: 184333 - DNA, 8 bp, Unknown
  misc_feature (1)..( 8): Result.005 file - promoters50/3438222
tttacttg

SEQ ID NO: 184334 - DNA, 9 bp, Unknown
  misc_feature (1)..( 9): Result.005 file - promoters50/3438222
tatcaaatg

SEQ ID NO: 184335 - DNA, 9 bp, Unknown
  misc_feature (1)..( 9): Result.005 file - promoters50/3438222
tattaaatt

SEQ ID NO: 184336 - DNA, 9 bp, Unknown
  misc_feature (1)..( 9): Result.005 file - promoters50/3438222
tcgtaaatt

SEQ ID NO: 184337 - DNA, 13 bp, Unknown
  misc_feature (1)..( 13): Result.005 file - promoters50/3438226
ttttaattttata

SEQ ID NO: 184338 - DNA, 13 bp, Unknown
  misc_feature (1)..( 13): Result.005 file - promoters50/3438226
tcctaatttgata

SEQ ID NO: 184339 - DNA, 13 bp, Unknown
  misc_feature (1)..( 13): Result.005 file - promoters50/3438226
aattaatttattt

SEQ ID NO: 184340 - DNA, 13 bp, Unknown
  misc_feature (1)..( 13): Result.005 file - promoters50/3438226
tgacaattttctt

SEQ ID NO: 184341 - DNA, 13 bp, Unknown
  misc_feature (1)..( 13): Result.005 file - promoters50/3438226
aattcatttaagc

SEQ ID NO: 184342 - DNA, 13 bp, Unknown
  misc_feature (1)..( 13): Result.005 file - promoters50/3438226
tatcaattgtcta

SEQ ID NO: 184343 - DNA, 12 bp, Unknown
  misc_feature (1)..( 12): Result.005 file - promoters50/3438236
aatatatatatc

SEQ ID NO: 184344 - DNA, 12 bp, Unknown
  misc_feature (1)..( 12): Result.005 file - promoters50/3438236
gttatataaatc

SEQ ID NO: 184345 - DNA, 12 bp, Unknown
  misc_feature (1)..( 12): Result.005 file - promoters50/3438236
gacatatatact

SEQ ID NO: 184346 - DNA, 12 bp, Unknown
  misc_feature (1)..( 12): Result.005 file - promoters50/3438236
cttatttatgaa

SEQ ID NO: 184347 - DNA, 12 bp, Unknown
  misc_feature (1)..( 12): Result.005 file - promoters50/3438236
gttttatactca

SEQ ID NO: 184348 - DNA, 12 bp, Unknown
  misc_feature (1)..( 12): Result.005 file - promoters50/3438236
tatatataagta

SEQ ID NO: 184349 - DNA, 14 bp, Unknown
  misc_feature (1)..( 14): Result.005 file - promoters50/3438236
caaaagaatcagtg

SEQ ID NO: 184350 - DNA, 14 bp, Unknown
  misc_feature (1)..( 14): Result.005 file - promoters50/3438236
tcaaataattctcc

SEQ ID NO: 184351 - DNA, 14 bp, Unknown
  misc_feature (1)..( 14): Result.005 file - promoters50/3438236
caaaacaattcaag

SEQ ID NO: 184352 - DNA, 14 bp, Unknown
  misc_feature (1)..( 14): Result.005 file - promoters50/3438236
gattatatttcttg

SEQ ID NO: 184353 - DNA, 14 bp, Unknown
  misc_feature (1)..( 14): Result.005 file - promoters50/3438236
acttgtttttcttg

SEQ ID NO: 184354 - DNA, 14 bp, Unknown
  misc_feature (1)..( 14): Result.005 file - promoters50/3438236
tcaattaatctttt

SEQ ID NO: 184355 - DNA, 19 bp, Unknown
  misc_feature (1)..( 19): Result.005 file - promoters50/3438236
ggcccatttattcaatcca

SEQ ID NO: 184356 - DNA, 19 bp, Unknown
  misc_feature (1)..( 19): Result.005 file - promoters50/3438236
ctagcatttattcctcttt

SEQ ID NO: 184357 - DNA, 19 bp, Unknown
  misc_feature (1)..( 19): Result.005 file - promoters50/3438236
ggcctatttgtgatgggcc

SEQ ID NO: 184358 - DNA, 19 bp, Unknown
  misc_feature (1)..( 19): Result.005 file - promoters50/3438236
cattttcttatgcaaagcc

SEQ ID NO: 184359 - DNA, 19 bp, Unknown
  misc_feature (1)..( 19): Result.005 file - promoters50/3438236
ttagtattttcttgcatta

SEQ ID NO: 184360 - DNA, 19 bp, Unknown
  misc_feature (1)..( 19): Result.005 file - promoters50/3438236
gcatacaaattgctaagcc

SEQ ID NO: 184361 - DNA, 10 bp, Unknown
  misc_feature (1)..( 10): Result.005 file - promoters50/3438291
aaattgatct

SEQ ID NO: 184362 - DNA, 10 bp, Unknown
  misc_feature (1)..( 10): Result.005 file - promoters50/3438291
aaattcatct

SEQ ID NO: 184363 - DNA, 10 bp, Unknown
  misc_feature (1)..( 10): Result.005 file - promoters50/3438291
aaattgtctt

SEQ ID NO: 184364 - DNA, 9 bp, Unknown
  misc_feature (1)..( 9): Result.005 file - promoters50/3438291
taaaaacaa

SEQ ID NO: 184365 - DNA, 9 bp, Unknown
  misc_feature (1)..( 9): Result.005 file - promoters50/3438291
taaaatcaa

SEQ ID NO: 184366 - DNA, 9 bp, Unknown
  misc_feature (1)..( 9): Result.005 file - promoters50/3438291
caaattcat

SEQ ID NO: 184367 - DNA, 30 bp, Unknown
  misc_feature (1)..( 30): Result.005 file - promoters50/3438312
acgtgtcattttattattagctattgcttc

SEQ ID NO: 184368 - DNA, 30 bp, Unknown; identical to SEQ ID NO: 71939
  misc_feature (1)..( 30): Result.005 file - promoters50/3438312

SEQ ID NO: 184369 - DNA, 30 bp, Unknown
  misc_feature (1)..( 30): Result.005 file - promoters50/3438312
acgtgtcaagctttggttggttattgcttc

SEQ ID NO: 184370 - DNA, 15 bp, Unknown
  misc_feature (1)..( 15): Result.005 file - promoters50/3438312
cgccttagctttctc

SEQ ID NO: 184371 - DNA, 15 bp, Unknown
  misc_feature (1)..( 15): Result.005 file - promoters50/3438312
cgccttagctttctc

SEQ ID NO: 184372 - DNA, 15 bp, Unknown
  misc_feature (1)..( 15): Result.005 file - promoters50/3438312
cgccttagctttctc

SEQ ID NO: 184373 - DNA, 22 bp, Unknown
  misc_feature (1)..( 22): Result.005 file - promoters50/3438312
gacctagtcgtcctcgtctttt

SEQ ID NO: 184374 - DNA, 22 bp, Unknown
  misc_feature (1)..( 22): Result.005 file - promoters50/3438312
gaccgagtcgtcctcgtctttt

SEQ ID NO: 184375 - DNA, 22 bp, Unknown
  misc_feature (1)..( 22): Result.005 file - promoters50/3438312
gaccgactcgtcctcgtctttt

SEQ ID NO: 184376 - DNA, 20 bp, Unknown
  misc_feature (1)..( 20): Result.005 file - promoters50/3438312
ttcttcttctataaaacaat

SEQ ID NO: 184377 - DNA, 20 bp, Unknown
  misc_feature (1)..( 20): Result.005 file - promoters50/3438312
ttttgcttctataaatcaaa

SEQ ID NO: 184378 - DNA, 20 bp, Unknown
  misc_feature (1)..( 20): Result.005 file - promoters50/3438312
gatctttgccggaaaacaat

SEQ ID NO: 184379 - DNA, 20 bp, Unknown
  misc_feature (1)..( 20): Result.005 file - promoters50/3438312
ttcttcttctataaattaat

SEQ ID NO: 184380 - DNA, 9 bp, Unknown
  misc_feature (1)..( 9): Result.005 file - promoters50/3438312
aaaaaaaac

SEQ ID NO: 184381 - DNA, 9 bp, Unknown
  misc_feature (1)..( 9): Result.005 file - promoters50/3438312
gaaaacaac

SEQ ID NO: 184382 - DNA, 9 bp, Unknown
  misc_feature (1)..( 9): Result.005 file - promoters50/3438312
caataaaac

SEQ ID NO: 184383 - DNA, 22 bp, Unknown
  misc_feature (1)..( 22): Result.005 file - promoters50/3438312
gacctagtcgtcctcgtctttt

SEQ ID NO: 184384 - DNA, 22 bp, Unknown
  misc_feature (1)..( 22): Result.005 file - promoters50/3438312
tctcgtgaccgactcgtcctcg

SEQ ID NO: 184385 - DNA, 22 bp, Unknown
  misc_feature (1)..( 22): Result.005 file - promoters50/3438312
gaccgagtcgtcctcgtctttt

SEQ ID NO: 184386 - DNA, 8 bp, Unknown
  misc_feature (1)..( 8): Result.005 file - promoters50/3438312
ttcttgcc

SEQ ID NO: 184387 - DNA, 8 bp, Unknown
  misc_feature (1)..( 8): Result.005 file - promoters50/3438312
gtcttgcg

SEQ ID NO: 184388 - DNA, 8 bp, Unknown
  misc_feature (1)..( 8): Result.005 file - promoters50/3438312
ttctggcc

SEQ ID NO: 184389 - DNA, 12 bp, Unknown
  misc_feature (1)..( 12): Result.005 file - promoters50/3438369
aagtatataata

SEQ ID NO: 184390 - DNA, 12 bp, Unknown
  misc_feature (1)..( 12): Result.005 file - promoters50/3438369
caaaataaaatt

SEQ ID NO: 184391 - DNA, 12 bp, Unknown
  misc_feature (1)..( 12): Result.005 file - promoters50/3438369
aagtatttaaaa

SEQ ID NO: 184392 - DNA, 12 bp, Unknown
  misc_feature (1)..( 12): Result.005 file - promoters50/3438369
gaagaaagaaat

SEQ ID NO: 184393 - DNA, 12 bp, Unknown
  misc_feature (1)..( 12): Result.005 file - promoters50/3438369
taggaatgaaga

SEQ ID NO: 184394 - DNA, 12 bp, Unknown
  misc_feature (1)..( 12): Result.005 file - promoters50/3438369
aataaatgaaat

SEQ ID NO: 184395 - DNA, 10 bp, Unknown
  misc_feature (1)..( 10): Result.005 file - promoters50/3438369
aaaatatttt

SEQ ID NO: 184396 - DNA, 10 bp, Unknown
  misc_feature (1)..( 10): Result.005 file - promoters50/3438369
gaaagattca

SEQ ID NO: 184397 - DNA, 10 bp, Unknown
  misc_feature (1)..( 10): Result.005 file - promoters50/3438369
aaaatatttt

SEQ ID NO: 184398 - DNA, 10 bp, Unknown
  misc_feature (1)..( 10): Result.005 file - promoters50/3438369
caaatataaa

SEQ ID NO: 184399 - DNA, 10 bp, Unknown
  misc_feature (1)..( 10): Result.005 file - promoters50/3438369
ggaatctaag

SEQ ID NO: 184400 - DNA, 11 bp, Unknown
  misc_feature (1)..( 11): Result.005 file - promoters50/3438381
ttctacatcca

SEQ ID NO: 184401 - DNA, 11 bp, Unknown
  misc_feature (1)..( 11): Result.005 file - promoters50/3438381
cctcacagcca

SEQ ID NO: 184402 - DNA, 11 bp, Unknown
  misc_feature (1)..( 11): Result.005 file - promoters50/3438381
ttctaaatcag

SEQ ID NO: 184403 - DNA, 14 bp, Unknown
  misc_feature (1)..( 14): Result.005 file - promoters50/3438420
aaatgtaaaattat

SEQ ID NO: 184404 - DNA, 14 bp, Unknown
  misc_feature (1)..( 14): Result.005 file - promoters50/3438420
aaacgtataatatg

SEQ ID NO: 184405 - DNA, 14 bp, Unknown
  misc_feature (1)..( 14): Result.005 file - promoters50/3438420
aacaaaataataag

SEQ ID NO: 184406 - DNA, 14 bp, Unknown
  misc_feature (1)..( 14): Result.005 file - promoters50/3438420
aggaataaaatgga

SEQ ID NO: 184407 - DNA, 14 bp, Unknown
  misc_feature (1)..( 14): Result.005 file - promoters50/3438420
accggttcaataaa

SEQ ID NO: 184408 - DNA, 14 bp, Unknown
  misc_feature (1)..( 14): Result.005 file - promoters50/3438420
aagtcactaaccaa

SEQ ID NO: 184409 - DNA, 14 bp, Unknown
  misc_feature (1)..( 14): Result.005 file - promoters50/3438420
tcaccaataattgt

SEQ ID NO: 184410 - DNA, 11 bp, Unknown
  misc_feature (1)..( 11): Result.005 file - promoters50/3438420
agaacaaaata

SEQ ID NO: 184411 - DNA, 11 bp, Unknown
  misc_feature (1)..( 11): Result.005 file - promoters50/3438420
ggaataaaatg

SEQ ID NO: 184412 - DNA, 11 bp, Unknown
  misc_feature (1)..( 11): Result.005 file - promoters50/3438420
cgtataatatg

SEQ ID NO: 184413 - DNA, 11 bp, Unknown
  misc_feature (1)..( 11): Result.005 file - promoters50/3438420
tcaataaacca

SEQ ID NO: 184414 - DNA, 11 bp, Unknown
  misc_feature (1)..( 11): Result.005 file - promoters50/3438420
tcactaaccaa

SEQ ID NO: 184415 - DNA, 11 bp, Unknown
  misc_feature (1)..( 11): Result.005 file - promoters50/3438420
ccaataattgt

SEQ ID NO: 184416 - DNA, 8 bp, Unknown
  misc_feature (1)..( 8): Result.005 file - promoters50/3438479
cgttatct

SEQ ID NO: 184417 - DNA, 8 bp, Unknown
  misc_feature (1)..( 8): Result.005 file - promoters50/3438479
cgttatac

SEQ ID NO: 184418 - DNA, 8 bp, Unknown
  misc_feature (1)..( 8): Result.005 file - promoters50/3438479
ggttttct

SEQ ID NO: 184419 - DNA, 9 bp, Unknown
  misc_feature (1)..( 9): Result.005 file - promoters50/3438494
ccttataaa

SEQ ID NO: 184420 - DNA, 9 bp, Unknown
  misc_feature (1)..( 9): Result.005 file - promoters50/3438494
atatataaa

SEQ ID NO: 184421 - DNA, 9 bp, Unknown
  misc_feature (1)..( 9): Result.005 file - promoters50/3438494
atctataaa

SEQ ID NO: 184422 - DNA, 9 bp, Unknown
  misc_feature (1)..( 9): Result.005 file - promoters50/3438494
atatataaa

SEQ ID NO: 184423 - DNA, 9 bp, Unknown
  misc_feature (1)..( 9): Result.005 file - promoters50/3438494
ccttttaaa

SEQ ID NO: 184424 - DNA, 10 bp, Unknown
  misc_feature (1)..( 10): Result.005 file - promoters50/3438494
cctttaagtt

SEQ ID NO: 184425 - DNA, 10 bp, Unknown
  misc_feature (1)..( 10): Result.005 file - promoters50/3438494
aatttgagtt

SEQ ID NO: 184426 - DNA, 10 bp, Unknown
  misc_feature (1)..( 10): Result.005 file - promoters50/3438494
atttttagta

SEQ ID NO: 184427 - DNA, 10 bp, Unknown
  misc_feature (1)..( 10): Result.005 file - promoters50/3438494
aatgtgattg

SEQ ID NO: 184428 - DNA, 8 bp, Unknown
  misc_feature (1)..( 8): Result.005 file - promoters50/3438505
tacgcata

SEQ ID NO: 184429 - DNA, 8 bp, Unknown
  misc_feature (1)..( 8): Result.005 file - promoters50/3438505
tacccata

SEQ ID NO: 184430 - DNA, 8 bp, Unknown
  misc_feature (1)..( 8): Result.005 file - promoters50/3438505
ggcacatg

SEQ ID NO: 184431 - DNA, 6 bp, Unknown
  misc_feature (1)..( 6): Result.005 file - promoters50/3438505
cgacat

SEQ ID NO: 184432 - DNA, 6 bp, Unknown
  misc_feature (1)..( 6): Result.005 file - promoters50/3438505
cgacat

SEQ ID NO: 184433 - DNA, 6 bp, Unknown
  misc_feature (1)..( 6): Result.005 file - promoters50/3438505
cgacat

SEQ ID NO: 184434 - DNA, 7 bp, Unknown
  misc_feature (1)..( 7): Result.005 file - promoters50/3438505
gtttctt

SEQ ID NO: 184435 - DNA, 7 bp, Unknown
  misc_feature (1)..( 7): Result.005 file - promoters50/3438505
gttcctt

SEQ ID NO: 184436 - DNA, 7 bp, Unknown
  misc_feature (1)..( 7): Result.005 file - promoters50/3438505
gttcctc

SEQ ID NO: 184437 - DNA, 8 bp, Unknown
  misc_feature (1)..( 8): Result.005 file - promoters50/3438505
gttgatga

SEQ ID NO: 184438 - DNA, 8 bp, Unknown
  misc_feature (1)..( 8): Result.005 file - promoters50/3438505
gttgattc

SEQ ID NO: 184439 - DNA, 8 bp, Unknown
  misc_feature (1)..( 8): Result.005 file - promoters50/3438505
cttgattc

SEQ ID NO: 184440 - DNA, 12 bp, Unknown
  misc_feature (1)..( 12): Result.005 file - promoters50/3438512
caataatttaca

SEQ ID NO: 184441 - DNA, 12 bp, Unknown
  misc_feature (1)..( 12): Result.005 file - promoters50/3438512
tgaaaatttata

SEQ ID NO: 184442 - DNA, 12 bp, Unknown
  misc_feature (1)..( 12): Result.005 file - promoters50/3438512
gtataattttat

SEQ ID NO: 184443 - DNA, 12 bp, Unknown
  misc_feature (1)..( 12): Result.005 file - promoters50/3438512
caacaatgtaca

SEQ ID NO: 184444 - DNA, 12 bp, Unknown
  misc_feature (1)..( 12): Result.005 file - promoters50/3438512
taaaaatttttc

SEQ ID NO: 184445 - DNA, 12 bp, Unknown
  misc_feature (1)..( 12): Result.005 file - promoters50/3438512
ctatgatttctt

SEQ ID NO: 184446 - DNA, 15 bp, Unknown
  misc_feature (1)..( 15): Result.005 file - promoters50/3438512
tgagtatattttata

SEQ ID NO: 184447 - DNA, 15 bp, Unknown
  misc_feature (1)..( 15): Result.005 file - promoters50/3438512
tttgtaaattttgca

SEQ ID NO: 184448 - DNA, 15 bp, Unknown
  misc_feature (1)..( 15): Result.005 file - promoters50/3438512
tgattatatgtacaa

SEQ ID NO: 184449 - DNA, 15 bp, Unknown
  misc_feature (1)..( 15): Result.005 file - promoters50/3438512
ttacactatttgata

SEQ ID NO: 184450 - DNA, 15 bp, Unknown
  misc_feature (1)..( 15): Result.005 file - promoters50/3438512
gatgtaaaaattata

SEQ ID NO: 184451 - DNA, 15 bp, Unknown
  misc_feature (1)..( 15): Result.005 file - promoters50/3438512
tatctatatgcagaa

SEQ ID NO: 184452 - DNA, 12 bp, Unknown
  misc_feature (1)..( 12): Result.005 file - promoters50/3438512
ggaaaaaaataa

SEQ ID NO: 184453 - DNA, 12 bp, Unknown
  misc_feature (1)..( 12): Result.005 file - promoters50/3438512
tcaaaaaaaaaa

SEQ ID NO: 184454 - DNA, 12 bp, Unknown
  misc_feature (1)..( 12): Result.005 file - promoters50/3438512
acaaaaaataat

SEQ ID NO: 184455 - DNA, 12 bp, Unknown
  misc_feature (1)..( 12): Result.005 file - promoters50/3438512
acaaaacaattc

SEQ ID NO: 184456 - DNA, 12 bp, Unknown
  misc_feature (1)..( 12): Result.005 file - promoters50/3438512
tagaaacaatgt

SEQ ID NO: 184457 - DNA, 12 bp, Unknown
  misc_feature (1)..( 12): Result.005 file - promoters50/3438512
tcaataaactta

SEQ ID NO: 184458 - DNA, 12 bp, Unknown
  misc_feature (1)..( 12): Result.005 file - promoters50/3438512
tcaaaataaaaa

SEQ ID NO: 184459 - DNA, 9 bp, Unknown
  misc_feature (1)..( 9): Result.005 file - promoters50/3438512
atgtttaat

SEQ ID NO: 184460 - DNA, 9 bp, Unknown
  misc_feature (1)..( 9): Result.005 file - promoters50/3438512
ttgtttata

SEQ ID NO: 184461 - DNA, 9 bp, Unknown
  misc_feature (1)..( 9): Result.005 file - promoters50/3438512
atgtttgat

SEQ ID NO: 184462 - DNA, 9 bp, Unknown
  misc_feature (1)..( 9): Result.005 file - promoters50/3438512
gagttcata

SEQ ID NO: 184463 - DNA, 9 bp, Unknown
  misc_feature (1)..( 9): Result.005 file - promoters50/3438512
ttgcttaca

SEQ ID NO: 184464 - DNA, 9 bp, Unknown
  misc_feature (1)..( 9): Result.005 file - promoters50/3438512
atgttttta

SEQ ID NO: 184465 - DNA, 10 bp, Unknown
  misc_feature (1)..( 10): Result.005 file - promoters50/3438512
tactttttag

SEQ ID NO: 184466 - DNA, 10 bp, Unknown
  misc_feature (1)..( 10): Result.005 file - promoters50/3438512
tacttttttt

SEQ ID NO: 184467 - DNA, 10 bp, Unknown
  misc_feature (1)..( 10): Result.005 file - promoters50/3438512
atgtttttac

SEQ ID NO: 184468 - DNA, 10 bp, Unknown
  misc_feature (1)..( 10): Result.005 file - promoters50/3438512
gtctttgctt

SEQ ID NO: 184469 - DNA, 11 bp, Unknown
  misc_feature (1)..( 11): Result.005 file - promoters50/3438512
aagttgtttat

SEQ ID NO: 184470 - DNA, 11 bp, Unknown
  misc_feature (1)..( 11): Result.005 file - promoters50/3438512
tgtttttgctg

SEQ ID NO: 184471 - DNA, 12 bp, Unknown
  misc_feature (1)..( 12): Result.005 file - promoters50/3438512
tcataaagcact

SEQ ID NO: 184472 - DNA, 12 bp, Unknown
  misc_feature (1)..( 12): Result.005 file - promoters50/3438512
tcaaaaatactt

SEQ ID NO: 184473 - DNA, 12 bp, Unknown
  misc_feature (1)..( 12): Result.005 file - promoters50/3438512
tcataatattag

SEQ ID NO: 184474 - DNA, 12 bp, Unknown
  misc_feature (1)..( 12): Result.005 file - promoters50/3438512
aaaaaaatcatt

SEQ ID NO: 184475 - DNA, 12 bp, Unknown
  misc_feature (1)..( 12): Result.005 file - promoters50/3438512
gtaaaaattata

SEQ ID NO: 184476 - DNA, 12 bp, Unknown
  misc_feature (1)..( 12): Result.005 file - promoters50/3438512
gataaaataaat

SEQ ID NO: 184477 - DNA, 10 bp, Unknown
  misc_feature (1)..( 10): Result.005 file - promoters50/3438518
ttgtataaaa

SEQ ID NO: 184478 - DNA, 10 bp, Unknown
  misc_feature (1)..( 10): Result.005 file - promoters50/3438518
gtgtataaat

SEQ ID NO: 184479 - DNA, 10 bp, Unknown
  misc_feature (1)..( 10): Result.005 file - promoters50/3438518
gtttataaaa

SEQ ID NO: 184480 - DNA, 10 bp, Unknown
  misc_feature (1)..( 10): Result.005 file - promoters50/3438518
ttatatatag

SEQ ID NO: 184481 - DNA, 10 bp, Unknown
  misc_feature (1)..( 10): Result.005 file - promoters50/3438518
ctatatatat

SEQ ID NO: 184482 - DNA, 10 bp, Unknown
  misc_feature (1)..( 10): Result.005 file - promoters50/3438518
ttatatcaac

SEQ ID NO: 184483 - DNA, 9 bp, Unknown
  misc_feature (1)..( 9): Result.005 file - promoters50/3438594
aatcaattt

SEQ ID NO: 184484 - DNA, 9 bp, Unknown
  misc_feature (1)..( 9): Result.005 file - promoters50/3438594
aattaatta

SEQ ID NO: 184485 - DNA, 9 bp, Unknown
  misc_feature (1)..( 9): Result.005 file - promoters50/3438594
gctcacttt

SEQ ID NO: 184486 - DNA, 9 bp, Unknown
  misc_feature (1)..( 9): Result.005 file - promoters50/3438594
cgttattta

SEQ ID NO: 184487 - DNA, 9 bp, Unknown
  misc_feature (1)..( 9): Result.005 file - promoters50/3438594
atctaatta

SEQ ID NO: 184488 - DNA, 9 bp, Unknown
  misc_feature (1)..( 9): Result.005 file - promoters50/3438594
tactattta

SEQ ID NO: 184489 - DNA, 10 bp, Unknown
  misc_feature (1)..( 10): Result.005 file - promoters50/3438594
tgaattaaat

SEQ ID NO: 184490 - DNA, 10 bp, Unknown
  misc_feature (1)..( 10): Result.005 file - promoters50/3438594
aaaataaaaa

SEQ ID NO: 184491 - DNA, 10 bp, Unknown
  misc_feature (1)..( 10): Result.005 file - promoters50/3438594
tctataaaaa

SEQ ID NO: 184492 - DNA, 10 bp, Unknown
  misc_feature (1)..( 10): Result.005 file - promoters50/3438594
taaacaaaag

SEQ ID NO: 184493 - DNA, 10 bp, Unknown
  misc_feature (1)..( 10): Result.005 file - promoters50/3438594
aaaagaaaaa

SEQ ID NO: 184494 - DNA, 10 bp, Unknown
  misc_feature (1)..( 10): Result.005 file - promoters50/3438594
ggtattaaaa

SEQ ID NO: 184495 - DNA, 10 bp, Unknown
  misc_feature (1)..( 10): Result.005 file - promoters50/3438594
aaaagaaaat

SEQ ID NO: 184496 - DNA, 10 bp, Unknown
  misc_feature (1)..( 10): Result.005 file - promoters50/3438594
ataagtaaac

SEQ ID NO: 184497 - DNA, 10 bp, Unknown
  misc_feature (1)..( 10): Result.005 file - promoters50/3438594
aaaagaaatg

SEQ ID NO: 184498 - DNA, 10 bp, Unknown
  misc_feature (1)..( 10): Result.005 file - promoters50/3438594
agtggaaaat

SEQ ID NO: 184499 - DNA, 10 bp, Unknown
  misc_feature (1)..( 10): Result.005 file - promoters50/3438594
taaacaaaag

SEQ ID NO: 184500 - DNA, 10 bp, Unknown
  misc_feature (1)..( 10): Result.005 file - promoters50/3438594
aaaagaaaaa

SEQ ID NO: 184501 - DNA, 9 bp, Unknown
  misc_feature (1)..( 9): Result.005 file - promoters50/3438594
caaaaataa

SEQ ID NO: 184502 - DNA, 9 bp, Unknown
  misc_feature (1)..( 9): Result.005 file - promoters50/3438594
tagaaataa

SEQ ID NO: 184503 - DNA, 9 bp, Unknown
  misc_feature (1)..( 9): Result.005 file - promoters50/3438594
gccaaataa

SEQ ID NO: 184504 - DNA, 9 bp, Unknown
  misc_feature (1)..( 9): Result.005 file - promoters50/3438594
ccaaaatat

SEQ ID NO: 184505 - DNA, 10 bp, Unknown
  misc_feature (1)..( 10): Result.005 file - promoters50/3438594
tcaaaactaa

SEQ ID NO: 184506 - DNA, 10 bp, Unknown
  misc_feature (1)..( 10): Result.005 file - promoters50/3438594
gctaaattat

SEQ ID NO: 184507 - DNA, 10 bp, Unknown
  misc_feature (1)..( 10): Result.005 file - promoters50/3438594
acaaatctat

SEQ ID NO: 184508 - DNA, 10 bp, Unknown
  misc_feature (1)..( 10): Result.005 file - promoters50/3438594
tgcaaccaaa

SEQ ID NO: 184509 - DNA, 12 bp, Unknown
  misc_feature (1)..( 12): Result.005 file - promoters50/3438594
taaaaacttctt

SEQ ID NO: 184510 - DNA, 12 bp, Unknown
  misc_feature (1)..( 12): Result.005 file - promoters50/3438594
acaaaacttcgt

SEQ ID NO: 184511 - DNA, 13 bp, Unknown
  misc_feature (1)..( 13): Result.005 file - promoters50/3438594
ctaaaaccttttg

SEQ ID NO: 184512 - DNA, 13 bp, Unknown
  misc_feature (1)..( 13): Result.005 file - promoters50/3438594
accaaaacttctt

SEQ ID NO: 184513 - DNA, 13 bp, Unknown
  misc_feature (1)..( 13): Result.005 file - promoters50/3438594
ttaaaaacttctt

SEQ ID NO: 184514 - DNA, 13 bp, Unknown
  misc_feature (1)..( 13): Result.005 file - promoters50/3438594
ttaaaaataaact

SEQ ID NO: 184515 - DNA, 13 bp, Unknown
  misc_feature (1)..( 13): Result.005 file - promoters50/3438594
ttaataattcgtt

SEQ ID NO: 184516 - DNA, 15 bp, Unknown
  misc_feature (1)..( 15): Result.005 file - promoters50/3438594
tgaaagtatgttttt

SEQ ID NO: 184517 - DNA, 15 bp, Unknown
  misc_feature (1)..( 15): Result.005 file - promoters50/3438594
acttcatatgtattt

SEQ ID NO: 184518 - DNA, 15 bp, Unknown
  misc_feature (1)..( 15): Result.005 file - promoters50/3438594
aattattttgtattc

SEQ ID NO: 184519 - DNA, 15 bp, Unknown
  misc_feature (1)..( 15): Result.005 file - promoters50/3438594
tttgtttacgttttt

SEQ ID NO: 184520 - DNA, 15 bp, Unknown
  misc_feature (1)..( 15): Result.005 file - promoters50/3438594
aattattctgtttct

SEQ ID NO: 184521 - DNA, 15 bp, Unknown
  misc_feature (1)..( 15): Result.005 file - promoters50/3438594
cgtgtctaattatac

SEQ ID NO: 184522 - DNA, 8 bp, Unknown
  misc_feature (1)..( 8): Result.005 file - promoters50/3438594
caatttat

SEQ ID NO: 184523 - DNA, 8 bp, Unknown
  misc_feature (1)..( 8): Result.005 file - promoters50/3438594
ttatttat

SEQ ID NO: 184524 - DNA, 8 bp, Unknown
  misc_feature (1)..( 8): Result.005 file - promoters50/3438594
ttaattaa

SEQ ID NO: 184525 - DNA, 8 bp, Unknown
  misc_feature (1)..( 8): Result.005 file - promoters50/3438594
ctaattag

SEQ ID NO: 184526 - DNA, 8 bp, Unknown
  misc_feature (1)..( 8): Result.005 file - promoters50/3438594
ctatttag

SEQ ID NO: 184527 - DNA, 8 bp, Unknown
  misc_feature (1)..( 8): Result.005 file - promoters50/3438594
ctatttgg

SEQ ID NO: 184528 - DNA, 11 bp, Unknown
  misc_feature (1)..( 11): Result.005 file - promoters50/3438594
ggaaaaacttt

SEQ ID NO: 184529 - DNA, 11 bp, Unknown
  misc_feature (1)..( 11): Result.005 file - promoters50/3438594
ctaaaaccttt

SEQ ID NO: 184530 - DNA, 11 bp, Unknown
  misc_feature (1)..( 11): Result.005 file - promoters50/3438594
accaaaacttc

SEQ ID NO: 184531 - DNA, 11 bp, Unknown
  misc_feature (1)..( 11): Result.005 file - promoters50/3438594
ttaaaaacttc

SEQ ID NO: 184532 - DNA, 11 bp, Unknown
  misc_feature (1)..( 11): Result.005 file - promoters50/3438594
ttaaaaataaa

SEQ ID NO: 184533 - DNA, 11 bp, Unknown
  misc_feature (1)..( 11): Result.005 file - promoters50/3438594
ttaataattcg

SEQ ID NO: 184534 - DNA, 8 bp, Unknown
  misc_feature (1)..( 8): Result.005 file - promoters50/3438624
ggttgtgc

SEQ ID NO: 184535 - DNA, 8 bp, Unknown
  misc_feature (1)..( 8): Result.005 file - promoters50/3438624
tgttttgc

SEQ ID NO: 184536 - DNA, 8 bp, Unknown
  misc_feature (1)..( 8): Result.005 file - promoters50/3438624
tgtttttc

SEQ ID NO: 184537 - DNA, 8 bp, Unknown
  misc_feature (1)..( 8): Result.005 file - promoters50/3438624
acaaaatt

SEQ ID NO: 184538 - DNA, 8 bp, Unknown
  misc_feature (1)..( 8): Result.005 file - promoters50/3438624
aaaaaatt

SEQ ID NO: 184539 - DNA, 8 bp, Unknown
  misc_feature (1)..( 8): Result.005 file - promoters50/3438624
aaaaaatg

SEQ ID NO: 184540 - DNA, 9 bp, Unknown
  misc_feature (1)..( 9): Result.005 file - promoters50/3438632
gaaatagat

SEQ ID NO: 184541 - DNA, 9 bp, Unknown
  misc_feature (1)..( 9): Result.005 file - promoters50/3438632
cgtatagat

SEQ ID NO: 184542 - DNA, 9 bp, Unknown
  misc_feature (1)..( 9): Result.005 file - promoters50/3438632
gaaaaagag

SEQ ID NO: 184543 - DNA, 9 bp, Unknown
  misc_feature (1)..( 9): Result.005 file - promoters50/3438632
gagaaaatt

SEQ ID NO: 184544 - DNA, 9 bp, Unknown
  misc_feature (1)..( 9): Result.005 file - promoters50/3438632
gggaaaatg

SEQ ID NO: 184545 - DNA, 9 bp, Unknown
  misc_feature (1)..( 9): Result.005 file - promoters50/3438632
aatatagag

SEQ ID NO: 184546 - DNA, 10 bp, Unknown
  misc_feature (1)..( 10): Result.005 file - promoters50/3438634
catttaaaac

SEQ ID NO: 184547 - DNA, 10 bp, Unknown
  misc_feature (1)..( 10): Result.005 file - promoters50/3438634
tattcaaaac

SEQ ID NO: 184548 - DNA, 10 bp, Unknown
  misc_feature (1)..( 10): Result.005 file - promoters50/3438634
tatccaatat

SEQ ID NO: 184549 - DNA, 12 bp, Unknown
  misc_feature (1)..( 12): Result.005 file - promoters50/3438648
ttacataagttt

SEQ ID NO: 184550 - DNA, 12 bp, Unknown
  misc_feature (1)..( 12): Result.005 file - promoters50/3438648
caacagaaggtc

SEQ ID NO: 184551 - DNA, 12 bp, Unknown
  misc_feature (1)..( 12): Result.005 file - promoters50/3438648
aaacagaaaaaa

SEQ ID NO: 184552 - DNA, 12 bp, Unknown
  misc_feature (1)..( 12): Result.005 file - promoters50/3438648
aaactgaaacaa

SEQ ID NO: 184553 - DNA, 12 bp, Unknown
  misc_feature (1)..( 12): Result.005 file - promoters50/3438648
aaagagagccaa

SEQ ID NO: 184554 - DNA, 12 bp, Unknown
  misc_feature (1)..( 12): Result.005 file - promoters50/3438648
tggcagaaaaaa

SEQ ID NO: 184555 - DNA, 10 bp, Unknown
  misc_feature (1)..( 10): Result.005 file - promoters50/3438648
gaaaaaaata

SEQ ID NO: 184556 - DNA, 10 bp, Unknown
  misc_feature (1)..( 10): Result.005 file - promoters50/3438648
ataaaaaatt

SEQ ID NO: 184557 - DNA, 11 bp, Unknown
  misc_feature (1)..( 11): Result.005 file - promoters50/3438648
agaagaaaacg

SEQ ID NO: 184558 - DNA, 11 bp, Unknown
  misc_feature (1)..( 11): Result.005 file - promoters50/3438648
ttataaaaaca

SEQ ID NO: 184559 - DNA, 11 bp, Unknown
  misc_feature (1)..( 11): Result.005 file - promoters50/3438648
aaatacaaact

SEQ ID NO: 184560 - DNA, 11 bp, Unknown
  misc_feature (1)..( 11): Result.005 file - promoters50/3438648
gaagaaaaaca

SEQ ID NO: 184561 - DNA, 11 bp, Unknown
  misc_feature (1)..( 11): Result.005 file - promoters50/3438648
aagagaagaga

SEQ ID NO: 184562 - DNA, 12 bp, Unknown
  misc_feature (1)..( 12): Result.005 file - promoters50/3438648
aatgaaaattac

SEQ ID NO: 184563 - DNA, 12 bp, Unknown
  misc_feature (1)..( 12): Result.005 file - promoters50/3438648
cggaaaaaatac

SEQ ID NO: 184564 - DNA, 12 bp, Unknown
  misc_feature (1)..( 12): Result.005 file - promoters50/3438648
attgaaaattta

SEQ ID NO: 184565 - DNA, 13 bp, Unknown
  misc_feature (1)..( 13): Result.005 file - promoters50/3438648
tttaaaagaatgg

SEQ ID NO: 184566 - DNA, 13 bp, Unknown
  misc_feature (1)..( 13): Result.005 file - promoters50/3438648
ttggaaagagcaa

SEQ ID NO: 184567 - DNA, 13 bp, Unknown
  misc_feature (1)..( 13): Result.005 file - promoters50/3438648
agtgaaaacatcg

SEQ ID NO: 184568 - DNA, 14 bp, Unknown
  misc_feature (1)..( 14): Result.005 file - promoters50/3438771
aaaaataaaatatg

SEQ ID NO: 184569 - DNA, 14 bp, Unknown
  misc_feature (1)..( 14): Result.005 file - promoters50/3438771
ccaaaaaaaataaa

SEQ ID NO: 184570 - DNA, 14 bp, Unknown
  misc_feature (1)..( 14): Result.005 file - promoters50/3438771
tttaataaactgta

SEQ ID NO: 184571 - DNA, 14 bp, Unknown
  misc_feature (1)..( 14): Result.005 file - promoters50/3438771
ccaaaaaccccagt

SEQ ID NO: 184572 - DNA, 14 bp, Unknown
  misc_feature (1)..( 14): Result.005 file - promoters50/3438771
acaaaaagaactaa

SEQ ID NO: 184573 - DNA, 14 bp, Unknown
  misc_feature (1)..( 14): Result.005 file - promoters50/3438771
ctaaaacaaatcat

SEQ ID NO: 184574 - DNA, 14 bp, Unknown
  misc_feature (1)..( 14): Result.005 file - promoters50/3438771
ttaaaaaaaaaaaa

SEQ ID NO: 184575 - DNA, 8 bp, Unknown
  misc_feature (1)..( 8): Result.005 file - promoters50/3438785
attaatga

SEQ ID NO: 184576 - DNA, 8 bp, Unknown
  misc_feature (1)..( 8): Result.005 file - promoters50/3438785
attagtga

SEQ ID NO: 184577 - DNA, 8 bp, Unknown
  misc_feature (1)..( 8): Result.005 file - promoters50/3438785
tttagtgc

SEQ ID NO: 184578 - DNA, 11 bp, Unknown
  misc_feature (1)..( 11): Result.005 file - promoters50/3438919
ctttaatcaaa

SEQ ID NO: 184579 - DNA, 11 bp, Unknown
  misc_feature (1)..( 11): Result.005 file - promoters50/3438919
atttcatctga

SEQ ID NO: 184580 - DNA, 11 bp, Unknown
  misc_feature (1)..( 11): Result.005 file - promoters50/3438919
gtttaaacaat

SEQ ID NO: 184581 - DNA, 11 bp, Unknown
  misc_feature (1)..( 11): Result.005 file - promoters50/3438919
gaataaacaaa

SEQ ID NO: 184582 - DNA, 11 bp, Unknown
  misc_feature (1)..( 11): Result.005 file - promoters50/3438919
gtttaagcagc

SEQ ID NO: 184583 - DNA, 11 bp, Unknown
  misc_feature (1)..( 11): Result.005 file - promoters50/3438919
ggttaaacatc

SEQ ID NO: 184584 - DNA, 11 bp, Unknown
  misc_feature (1)..( 11): Result.005 file - promoters50/3438919
gtttaaggtaa

SEQ ID NO: 184585 - DNA, 11 bp, Unknown
  misc_feature (1)..( 11): Result.005 file - promoters50/3438919
ttttatttgaa

SEQ ID NO: 184586 - DNA, 11 bp, Unknown
  misc_feature (1)..( 11): Result.005 file - promoters50/3438919
tttgattagaa

SEQ ID NO: 184587 - DNA, 11 bp, Unknown
  misc_feature (1)..( 11): Result.005 file - promoters50/3438919
acacatttgag

SEQ ID NO: 184588 - DNA, 11 bp, Unknown
  misc_feature (1)..( 11): Result.005 file - promoters50/3438919
cttaatttatc

SEQ ID NO: 184589 - DNA, 11 bp, Unknown
  misc_feature (1)..( 11): Result.005 file - promoters50/3438919
caatatttatg

SEQ ID NO: 184590 - DNA, 11 bp, Unknown
  misc_feature (1)..( 11): Result.005 file - promoters50/3438919
gttgattatta

SEQ ID NO: 184591 - DNA, 9 bp, Unknown
  misc_feature (1)..( 9): Result.005 file - promoters50/3438927
atatgtaaa

SEQ ID NO: 184592 - DNA, 9 bp, Unknown
  misc_feature (1)..( 9): Result.005 file - promoters50/3438927
ataagtaaa

SEQ ID NO: 184593 - DNA, 9 bp, Unknown
  misc_feature (1)..( 9): Result.005 file - promoters50/3438927
aagagtaaa

SEQ ID NO: 184594 - DNA, 10 bp, Unknown
  misc_feature (1)..( 10): Result.005 file - promoters50/3438927
ccaaaaaata

SEQ ID NO: 184595 - DNA, 10 bp, Unknown
  misc_feature (1)..( 10): Result.005 file - promoters50/3438927
aaagaaaata

SEQ ID NO: 184596 - DNA, 10 bp, Unknown
  misc_feature (1)..( 10): Result.005 file - promoters50/3438927
aaatgaaata

SEQ ID NO: 184597 - DNA, 9 bp, Unknown
  misc_feature (1)..( 9): Result.005 file - promoters50/3438927
aaaaaaaaa

SEQ ID NO: 184598 - DNA, 9 bp, Unknown
  misc_feature (1)..( 9): Result.005 file - promoters50/3438927
aaaaagaaa

SEQ ID NO: 184599 - DNA, 9 bp, Unknown
  misc_feature (1)..( 9): Result.005 file - promoters50/3438927
aaaaaactt

SEQ ID NO: 184600 - DNA, 8 bp, Unknown
  misc_feature (1)..( 8): Result.005 file - promoters50/3438927
tgtacaaa

SEQ ID NO: 184601 - DNA, 8 bp, Unknown
  misc_feature (1)..( 8): Result.005 file - promoters50/3438927
agtaaaaa

SEQ ID NO: 184602 - DNA, 8 bp, Unknown
  misc_feature (1)..( 8): Result.005 file - promoters50/3438927
agtaaaga

SEQ ID NO: 184603 - DNA, 13 bp, Unknown
  misc_feature (1)..( 13): Result.005 file - promoters50/3438927
gaaaaatcttaac

SEQ ID NO: 184604 - DNA, 13 bp, Unknown
  misc_feature (1)..( 13): Result.005 file - promoters50/3438927
gaaatatcttaac

SEQ ID NO: 184605 - DNA, 13 bp, Unknown
  misc_feature (1)..( 13): Result.005 file - promoters50/3438927
aaaataaaataaa

SEQ ID NO: 184606 - DNA, 8 bp, Unknown
  misc_feature (1)..( 8): Result.005 file - promoters50/3438944
tcaataag

SEQ ID NO: 184607 - DNA, 8 bp, Unknown
  misc_feature (1)..( 8): Result.005 file - promoters50/3438944
acaaaaag

SEQ ID NO: 184608 - DNA, 8 bp, Unknown
  misc_feature (1)..( 8): Result.005 file - promoters50/3438944
acaaaagt

SEQ ID NO: 184609 - DNA, 8 bp, Unknown
  misc_feature (1)..( 8): Result.005 file - promoters50/3438946
ttaaaatc

SEQ ID NO: 184610 - DNA, 8 bp, Unknown
  misc_feature (1)..( 8): Result.005 file - promoters50/3438946
tcaaaatc

SEQ ID NO: 184611 - DNA, 8 bp, Unknown
  misc_feature (1)..( 8): Result.005 file - promoters50/3438946
ttataatg

SEQ ID NO: 184612 - DNA, 8 bp, Unknown
  misc_feature (1)..( 8): Result.005 file - promoters50/3438946
gcataatg

SEQ ID NO: 184613 - DNA, 7 bp, Unknown
  misc_feature (1)..( 7): Result.005 file - promoters50/3438946
agatagt

SEQ ID NO: 184614 - DNA, 7 bp, Unknown
  misc_feature (1)..( 7): Result.005 file - promoters50/3438946
agaaagt

SEQ ID NO: 184615 - DNA, 7 bp, Unknown
  misc_feature (1)..( 7): Result.005 file - promoters50/3438946
agaaagg

SEQ ID NO: 184616 - DNA, 8 bp, Unknown
  misc_feature (1)..( 8): Result.005 file - promoters50/3438946
gttaattg

SEQ ID NO: 184617 - DNA, 8 bp, Unknown
  misc_feature (1)..( 8): Result.005 file - promoters50/3438946
attacttg

SEQ ID NO: 184618 - DNA, 8 bp, Unknown
  misc_feature (1)..( 8): Result.005 file - promoters50/3438946
gttaattg

SEQ ID NO: 184619 - DNA, 10 bp, Unknown
  misc_feature (1)..( 10): Result.005 file - promoters50/3438990
aataaataaa

SEQ ID NO: 184620 - DNA, 10 bp, Unknown
  misc_feature (1)..( 10): Result.005 file - promoters50/3438990
aataaagatc

SEQ ID NO: 184621 - DNA, 10 bp, Unknown
  misc_feature (1)..( 10): Result.005 file - promoters50/3438990
tataaatata

SEQ ID NO: 184622 - DNA, 10 bp, Unknown
  misc_feature (1)..( 10): Result.005 file - promoters50/3438990
cgtaattata

SEQ ID NO: 184623 - DNA, 10 bp, Unknown
  misc_feature (1)..( 10): Result.005 file - promoters50/3438990
tataaacaaa

SEQ ID NO: 184624 - DNA, 10 bp, Unknown
  misc_feature (1)..( 10): Result.005 file - promoters50/3438990
tataaaaaca

SEQ ID NO: 184625 - DNA, 7 bp, Unknown
  misc_feature (1)..( 7): Result.005 file - promoters50/3439000
aataatt

SEQ ID NO: 184626 - DNA, 7 bp, Unknown
  misc_feature (1)..( 7): Result.005 file - promoters50/3439000
aataata

SEQ ID NO: 184627 - DNA, 7 bp, Unknown
  misc_feature (1)..( 7): Result.005 file - promoters50/3439000
aatcatt

SEQ ID NO: 184628 - DNA, 7 bp, Unknown
  misc_feature (1)..( 7): Result.005 file - promoters50/3439012
tctctat

SEQ ID NO: 184629 - DNA, 7 bp, Unknown
  misc_feature (1)..( 7): Result.005 file - promoters50/3439012
tctttat

SEQ ID NO: 184630 - DNA, 7 bp, Unknown
  misc_feature (1)..( 7): Result.005 file - promoters50/3439012
tctcttt

SEQ ID NO: 184631 - DNA, 7 bp, Unknown
  misc_feature (1)..( 7): Result.005 file - promoters50/3439012
cctttat

SEQ ID NO: 184632 - DNA, 12 bp, Unknown
  misc_feature (1)..( 12): Result.005 file - promoters50/3439012
attaattacgca

SEQ ID NO: 184633 - DNA, 12 bp, Unknown
  misc_feature (1)..( 12): Result.005 file - promoters50/3439012
cttagttacaga

SEQ ID NO: 184634 - DNA, 12 bp, Unknown
  misc_feature (1)..( 12): Result.005 file - promoters50/3439012
attaatgttaac

SEQ ID NO: 184635 - DNA, 12 bp, Unknown
  misc_feature (1)..( 12): Result.005 file - promoters50/3439012
ggcggttccaga

SEQ ID NO: 184636 - DNA, 11 bp, Unknown
  misc_feature (1)..( 11): Result.005 file - promoters50/3439014
tttttgctcca

SEQ ID NO: 184637 - DNA, 11 bp, Unknown
  misc_feature (1)..( 11): Result.005 file - promoters50/3439014
aatttggtcca

SEQ ID NO: 184638 - DNA, 11 bp, Unknown
  misc_feature (1)..( 11): Result.005 file - promoters50/3439014
tttttgttccc

SEQ ID NO: 184639 - DNA, 8 bp, Unknown
  misc_feature (1)..( 8): Result.005 file - promoters50/3439026
aaagaata

SEQ ID NO: 184640 - DNA, 8 bp, Unknown
  misc_feature (1)..( 8): Result.005 file - promoters50/3439026
aaaaaatt

SEQ ID NO: 184641 - DNA, 8 bp, Unknown
  misc_feature (1)..( 8): Result.005 file - promoters50/3439026
gcagaata

SEQ ID NO: 184642 - DNA, 11 bp, Unknown
  misc_feature (1)..( 11): Result.005 file - promoters50/3439026
aaagagttttg

SEQ ID NO: 184643 - DNA, 11 bp, Unknown
  misc_feature (1)..( 11): Result.005 file - promoters50/3439026
tattagttttg

SEQ ID NO: 184644 - DNA, 11 bp, Unknown
  misc_feature (1)..( 11): Result.005 file - promoters50/3439026
atggagatttg

SEQ ID NO: 184645 - DNA, 11 bp, Unknown
  misc_feature (1)..( 11): Result.005 file - promoters50/3439026
aaagagcttta

SEQ ID NO: 184646 - DNA, 7 bp, Unknown
  misc_feature (1)..( 7): Result.005 file - promoters50/3439026
cgagatc

SEQ ID NO: 184647 - DNA, 7 bp, Unknown
  misc_feature (1)..( 7): Result.005 file - promoters50/3439026
cgagatt

SEQ ID NO: 184648 - DNA, 7 bp, Unknown
  misc_feature (1)..( 7): Result.005 file - promoters50/3439026
cgaaatc

SEQ ID NO: 184649 - DNA, 8 bp, Unknown
  misc_feature (1)..( 8): Result.005 file - promoters50/3439026
aaataaat

SEQ ID NO: 184650 - DNA, 8 bp, Unknown
  misc_feature (1)..( 8): Result.005 file - promoters50/3439026
aaataatt

SEQ ID NO: 184651 - DNA, 8 bp, Unknown
  misc_feature (1)..( 8): Result.005 file - promoters50/3439026
aaataatt

SEQ ID NO: 184652 - DNA, 7 bp, Unknown
  misc_feature (1)..( 7): Result.005 file - promoters50/3439026
attatat

SEQ ID NO: 184653 - DNA, 7 bp, Unknown
  misc_feature (1)..( 7): Result.005 file - promoters50/3439026
tttatat

SEQ ID NO: 184654 - DNA, 8 bp, Unknown
  misc_feature (1)..( 8): Result.005 file - promoters50/3439026
tttgataa

SEQ ID NO: 184655 - DNA, 9 bp, Unknown
  misc_feature (1)..( 9): Result.005 file - promoters50/3439044
aaaaatgtg

SEQ ID NO: 184656 - DNA, 9 bp, Unknown
  misc_feature (1)..( 9): Result.005 file - promoters50/3439044
ttaaaggtg

SEQ ID NO: 184657 - DNA, 9 bp, Unknown
  misc_feature (1)..( 9): Result.005 file - promoters50/3439044
caaaatgtt

SEQ ID NO: 184658 - DNA, 9 bp, Unknown
  misc_feature (1)..( 9): Result.005 file - promoters50/3439044
aaaaagatg

SEQ ID NO: 184659 - DNA, 9 bp, Unknown
  misc_feature (1)..( 9): Result.005 file - promoters50/3439044
agaaatgat

SEQ ID NO: 184660 - DNA, 9 bp, Unknown
  misc_feature (1)..( 9): Result.005 file - promoters50/3439044
ttaaaggat

SEQ ID NO: 184661 - DNA, 9 bp, Unknown
  misc_feature (1)..( 9): Result.005 file - promoters50/3439044
tgtttctgt

SEQ ID NO: 184662 - DNA, 9 bp, Unknown
  misc_feature (1)..( 9): Result.005 file - promoters50/3439044
agtttgtgt

SEQ ID NO: 184663 - DNA, 9 bp, Unknown
  misc_feature (1)..( 9): Result.005 file - promoters50/3439044
agtttgttg

SEQ ID NO: 184664 - DNA, 9 bp, Unknown
  misc_feature (1)..( 9): Result.005 file - promoters50/3439044
gatttcttg

SEQ ID NO: 184665 - DNA, 9 bp, Unknown
  misc_feature (1)..( 9): Result.005 file - promoters50/3439044
gattttttg

SEQ ID NO: 184666 - DNA, 9 bp, Unknown
  misc_feature (1)..( 9): Result.005 file - promoters50/3439044
tctttcttc

SEQ ID NO: 184667 - DNA, 14 bp, Unknown
  misc_feature (1)..( 14): Result.005 file - promoters50/3439056
aactgaaataattt

SEQ ID NO: 184668 - DNA, 14 bp, Unknown
  misc_feature (1)..( 14): Result.005 file - promoters50/3439056
gcttgtgataattt

SEQ ID NO: 184669 - DNA, 14 bp, Unknown
  misc_feature (1)..( 14): Result.005 file - promoters50/3439056
atcttaaacaatac

SEQ ID NO: 184670 - DNA, 14 bp, Unknown
  misc_feature (1)..( 14): Result.005 file - promoters50/3439056
aactgaactaatca

SEQ ID NO: 184671 - DNA, 14 bp, Unknown
  misc_feature (1)..( 14): Result.005 file - promoters50/3439056
aactcaaatctgta

SEQ ID NO: 184672 - DNA, 9 bp, Unknown
  misc_feature (1)..( 9): Result.005 file - promoters50/3439059
ttatatata

SEQ ID NO: 184673 - DNA, 9 bp, Unknown
  misc_feature (1)..( 9): Result.005 file - promoters50/3439059
gtataaata

SEQ ID NO: 184674 - DNA, 9 bp, Unknown
  misc_feature (1)..( 9): Result.005 file - promoters50/3439059
ataaaaatg

SEQ ID NO: 184675 - DNA, 9 bp, Unknown
  misc_feature (1)..( 9): Result.005 file - promoters50/3439059
tcataaatg

SEQ ID NO: 184676 - DNA, 10 bp, Unknown
  misc_feature (1)..( 10): Result.005 file - promoters50/3439059
tataataatt

SEQ ID NO: 184677 - DNA, 10 bp, Unknown
  misc_feature (1)..( 10): Result.005 file - promoters50/3439059
aataaaaatg

SEQ ID NO: 184678 - DNA, 10 bp, Unknown
  misc_feature (1)..( 10): Result.005 file - promoters50/3439059
tatcataaat

SEQ ID NO: 184679 - DNA, 10 bp, Unknown
  misc_feature (1)..( 10): Result.005 file - promoters50/3439059
tataaatatg

SEQ ID NO: 184680 - DNA, 12 bp, Unknown
  misc_feature (1)..( 12): Result.005 file - promoters50/3439063
aacatgtcttag

SEQ ID NO: 184681 - DNA, 12 bp, Unknown
  misc_feature (1)..( 12): Result.005 file - promoters50/3439063
aacttgttttag

SEQ ID NO: 184682 - DNA, 12 bp, Unknown
  misc_feature (1)..( 12): Result.005 file - promoters50/3439063
ttttggtcttat

SEQ ID NO: 184683 - DNA, 12 bp, Unknown
  misc_feature (1)..( 12): Result.005 file - promoters50/3439063
atcatgtcacaa

SEQ ID NO: 184684 - DNA, 12 bp, Unknown
  misc_feature (1)..( 12): Result.005 file - promoters50/3439063
aatatgtcaaaa

SEQ ID NO: 184685 - DNA, 11 bp, Unknown
  misc_feature (1)..( 11): Result.005 file - promoters50/3439063
gactaacatta

SEQ ID NO: 184686 - DNA, 11 bp, Unknown
  misc_feature (1)..( 11): Result.005 file - promoters50/3439063
actcaacatta

SEQ ID NO: 184687 - DNA, 11 bp, Unknown
  misc_feature (1)..( 11): Result.005 file - promoters50/3439063
attcaaaattt

SEQ ID NO: 184688 - DNA, 11 bp, Unknown
  misc_feature (1)..( 11): Result.005 file - promoters50/3439063
attgaaaattc

SEQ ID NO: 184689 - DNA, 11 bp, Unknown
  misc_feature (1)..( 11): Result.005 file - promoters50/3439063
tagaaaaattg

SEQ ID NO: 184690 - DNA, 8 bp, Unknown
  misc_feature (1)..( 8): Result.005 file - promoters50/3439129
tttaagaa

SEQ ID NO: 184691 - DNA, 8 bp, Unknown
  misc_feature (1)..( 8): Result.005 file - promoters50/3439129
gttaggaa

SEQ ID NO: 184692 - DNA, 8 bp, Unknown
  misc_feature (1)..( 8): Result.005 file - promoters50/3439129
tttaagtt

SEQ ID NO: 184693 - DNA, 7 bp, Unknown
  misc_feature (1)..( 7): Result.005 file - promoters50/3439129
taattta

SEQ ID NO: 184694 - DNA, 7 bp, Unknown
  misc_feature (1)..( 7): Result.005 file - promoters50/3439129
caattta

SEQ ID NO: 184695 - DNA, 7 bp, Unknown
  misc_feature (1)..( 7): Result.005 file - promoters50/3439129
taagtta

SEQ ID NO: 184696 - DNA, 11 bp, Unknown
  misc_feature (1)..( 11): Result.005 file - promoters50/3439129
agaggaaatga

SEQ ID NO: 184697 - DNA, 11 bp, Unknown
  misc_feature (1)..( 11): Result.005 file - promoters50/3439129
agagtaaataa

SEQ ID NO: 184698 - DNA, 11 bp, Unknown
  misc_feature (1)..( 11): Result.005 file - promoters50/3439129
tcttgaagtga

SEQ ID NO: 184699 - DNA, 9 bp, Unknown
  misc_feature (1)..( 9): Result.005 file - promoters50/3439129
tctatttaa

SEQ ID NO: 184700 - DNA, 9 bp, Unknown
  misc_feature (1)..( 9): Result.005 file - promoters50/3439129
tcttttttt

SEQ ID NO: 184701 - DNA, 9 bp, Unknown
  misc_feature (1)..( 9): Result.005 file - promoters50/3439129
tctaattaa

SEQ ID NO: 184702 - DNA, 7 bp, Unknown
  misc_feature (1)..( 7): Result.005 file - promoters50/3439129
aaacagt

SEQ ID NO: 184703 - DNA, 7 bp, Unknown
  misc_feature (1)..( 7): Result.005 file - promoters50/3439129
aaacaga

SEQ ID NO: 184704 - DNA, 7 bp, Unknown
  misc_feature (1)..( 7): Result.005 file - promoters50/3439129
aaagaga

SEQ ID NO: 184705 - DNA, 10 bp, Unknown
  misc_feature (1)..( 10): Result.005 file - promoters50/3439129
taacagaaaa

SEQ ID NO: 184706 - DNA, 10 bp, Unknown
  misc_feature (1)..( 10): Result.005 file - promoters50/3439129
taacagagat

SEQ ID NO: 184707 - DNA, 10 bp, Unknown
  misc_feature (1)..( 10): Result.005 file - promoters50/3439129
atacagagat

SEQ ID NO: 184708 - DNA, 7 bp, Unknown
  misc_feature (1)..( 7): Result.005 file - promoters50/3439145
ctaatta

SEQ ID NO: 184709 - DNA, 7 bp, Unknown
  misc_feature (1)..( 7): Result.005 file - promoters50/3439145
ataatta

SEQ ID NO: 184710 - DNA, 7 bp, Unknown
  misc_feature (1)..( 7): Result.005 file - promoters50/3439145
atagtta

SEQ ID NO: 184711 - DNA, 7 bp, Unknown
  misc_feature (1)..( 7): Result.005 file - promoters50/3439145
ttacaaa

SEQ ID NO: 184712 - DNA, 7 bp, Unknown
  misc_feature (1)..( 7): Result.005 file - promoters50/3439145
ttaaaaa

SEQ ID NO: 184713 - DNA, 7 bp, Unknown
  misc_feature (1)..( 7): Result.005 file - promoters50/3439145
ttaaaag

SEQ ID NO: 184714 - DNA, 8 bp, Unknown
  misc_feature (1)..( 8): Result.005 file - promoters50/3439175
catgattt

SEQ ID NO: 184715 - DNA, 8 bp, Unknown
  misc_feature (1)..( 8): Result.005 file - promoters50/3439175
gatgcttt

SEQ ID NO: 184716 - DNA, 8 bp, Unknown
  misc_feature (1)..( 8): Result.005 file - promoters50/3439175
cataatta

SEQ ID NO: 184717 - DNA, 13 bp, Unknown
  misc_feature (1)..( 13): Result.005 file - promoters50/3439206
tagaatatttttt

SEQ ID NO: 184718 - DNA, 13 bp, Unknown
  misc_feature (1)..( 13): Result.005 file - promoters50/3439206
aagaaaattcttt

SEQ ID NO: 184719 - DNA, 13 bp, Unknown
  misc_feature (1)..( 13): Result.005 file - promoters50/3439206
aagaaagttcatc

SEQ ID NO: 184720 - DNA, 13 bp, Unknown
  misc_feature (1)..( 13): Result.005 file - promoters50/3439206
ccacgatttcttt

SEQ ID NO: 184721 - DNA, 13 bp, Unknown
  misc_feature (1)..( 13): Result.005 file - promoters50/3439206
ggtaaagttgatt

SEQ ID NO: 184722 - DNA, 13 bp, Unknown
  misc_feature (1)..( 13): Result.005 file - promoters50/3439206
cacaaacttggaa

SEQ ID NO: 184723 - DNA, 8 bp, Unknown
  misc_feature (1)..( 8): Result.005 file - promoters50/3439206
aaaaaact

SEQ ID NO: 184724 - DNA, 8 bp, Unknown
  misc_feature (1)..( 8): Result.005 file - promoters50/3439206
caaaaaca

SEQ ID NO: 184725 - DNA, 9 bp, Unknown
  misc_feature (1)..( 9): Result.005 file - promoters50/3439206
taataaata

SEQ ID NO: 184726 - DNA, 9 bp, Unknown
  misc_feature (1)..( 9): Result.005 file - promoters50/3439206
aaaagaaca

SEQ ID NO: 184727 - DNA, 9 bp, Unknown
  misc_feature (1)..( 9): Result.005 file - promoters50/3439206
caaaaagaa

SEQ ID NO: 184728 - DNA, 9 bp, Unknown
  misc_feature (1)..( 9): Result.005 file - promoters50/3439206
ggcaaaaca

SEQ ID NO: 184729 - DNA, 13 bp, Unknown
  misc_feature (1)..( 13): Result.005 file - promoters50/3439224
cttatctgggcct

SEQ ID NO: 184730 - DNA, 13 bp, Unknown
  misc_feature (1)..( 13): Result.005 file - promoters50/3439224
attatatgggcct

SEQ ID NO: 184731 - DNA, 13 bp, Unknown
  misc_feature (1)..( 13): Result.005 file - promoters50/3439224
attataaatagcc

SEQ ID NO: 184732 - DNA, 8 bp, Unknown
  misc_feature (1)..( 8): Result.005 file - promoters50/3439224
tttgttgt

SEQ ID NO: 184733 - DNA, 8 bp, Unknown
  misc_feature (1)..( 8): Result.005 file - promoters50/3439224
tttgtttc

SEQ ID NO: 184734 - DNA, 8 bp, Unknown
  misc_feature (1)..( 8): Result.005 file - promoters50/3439224
tttcttgt

SEQ ID NO: 184735 - DNA, 11 bp, Unknown
  misc_feature (1)..( 11): Result.005 file - promoters50/3439289
caatattttta

SEQ ID NO: 184736 - DNA, 11 bp, Unknown
  misc_feature (1)..( 11): Result.005 file - promoters50/3439289
aattattttca

SEQ ID NO: 184737 - DNA, 11 bp, Unknown
  misc_feature (1)..( 11): Result.005 file - promoters50/3439289
actgatttttc

SEQ ID NO: 184738 - DNA, 11 bp, Unknown
  misc_feature (1)..( 11): Result.005 file - promoters50/3439289
ttttatttcat

SEQ ID NO: 184739 - DNA, 11 bp, Unknown
  misc_feature (1)..( 11): Result.005 file - promoters50/3439289
tgttatcttca

SEQ ID NO: 184740 - DNA, 11 bp, Unknown
  misc_feature (1)..( 11): Result.005 file - promoters50/3439289
tgtaatcatac

SEQ ID NO: 184741 - DNA, 11 bp, Unknown
  misc_feature (1)..( 11): Result.005 file - promoters50/3439289
aatatttttac

SEQ ID NO: 184742 - DNA, 11 bp, Unknown
  misc_feature (1)..( 11): Result.005 file - promoters50/3439289
aaagtttttat

SEQ ID NO: 184743 - DNA, 11 bp, Unknown
  misc_feature (1)..( 11): Result.005 file - promoters50/3439289
tactgttttac

SEQ ID NO: 184744 - DNA, 11 bp, Unknown
  misc_feature (1)..( 11): Result.005 file - promoters50/3439289
cagctttttat

SEQ ID NO: 184745 - DNA, 11 bp, Unknown
  misc_feature (1)..( 11): Result.005 file - promoters50/3439289
ctgatttttca

SEQ ID NO: 184746 - DNA, 11 bp, Unknown
  misc_feature (1)..( 11): Result.005 file - promoters50/3439289
tgaatttggag

SEQ ID NO: 184747 - DNA, 18 bp, Unknown
  misc_feature (1)..( 18): Result.005 file - promoters50/3439289
gtatataagatatatgga

SEQ ID NO: 184748 - DNA, 18 bp, Unknown
  misc_feature (1)..( 18): Result.005 file - promoters50/3439289
ccaaaaaagaaatatgtc

SEQ ID NO: 184749 - DNA, 18 bp, Unknown
  misc_feature (1)..( 18): Result.005 file - promoters50/3439289
aataaatataaatatgga

SEQ ID NO: 184750 - DNA, 18 bp, Unknown
  misc_feature (1)..( 18): Result.005 file - promoters50/3439289
ttatgtgacatatatctt

SEQ ID NO: 184751 - DNA, 18 bp, Unknown
  misc_feature (1)..( 18): Result.005 file - promoters50/3439289
ccataaaggaaaaagccc

SEQ ID NO: 184752 - DNA, 18 bp, Unknown
  misc_feature (1)..( 18): Result.005 file - promoters50/3439289
tgtttatggaaaattggt

SEQ ID NO: 184753 - DNA, 14 bp, Unknown
  misc_feature (1)..( 14): Result.005 file - promoters50/3439289
aaaaaggaaagaat

SEQ ID NO: 184754 - DNA, 14 bp, Unknown
  misc_feature (1)..( 14): Result.005 file - promoters50/3439289
cgacaggaaaatgg

SEQ ID NO: 184755 - DNA, 14 bp, Unknown
  misc_feature (1)..( 14): Result.005 file - promoters50/3439289
ataaagcaaacaat

SEQ ID NO: 184756 - DNA, 14 bp, Unknown
  misc_feature (1)..( 14): Result.005 file - promoters50/3439289
aaaaaagaaataaa

SEQ ID NO: 184757 - DNA, 14 bp, Unknown
  misc_feature (1)..( 14): Result.005 file - promoters50/3439289
cttcaacaatatgc

SEQ ID NO: 184758 - DNA, 14 bp, Unknown
  misc_feature (1)..( 14): Result.005 file - promoters50/3439289
tcacaacaaattta

SEQ ID NO: 184759 - DNA, 14 bp, Unknown
  misc_feature (1)..( 14): Result.005 file - promoters50/3439289
aaaaaacaaataaa

SEQ ID NO: 184760 - DNA, 10 bp, Unknown
  misc_feature (1)..( 10): Result.005 file - promoters50/3439289
ccttgtactc

SEQ ID NO: 184761 - DNA, 10 bp, Unknown
  misc_feature (1)..( 10): Result.005 file - promoters50/3439289
ctttgtactt

SEQ ID NO: 184762 - DNA, 10 bp, Unknown
  misc_feature (1)..( 10): Result.005 file - promoters50/3439289
acttgtacac

SEQ ID NO: 184763 - DNA, 10 bp, Unknown
  misc_feature (1)..( 10): Result.005 file - promoters50/3439289
aattgtactt

SEQ ID NO: 184764 - DNA, 10 bp, Unknown
  misc_feature (1)..( 10): Result.005 file - promoters50/3439289
aatagtaaaa

SEQ ID NO: 184765 - DNA, 10 bp, Unknown
  misc_feature (1)..( 10): Result.005 file - promoters50/3439289
tgttgtgctt

SEQ ID NO: 184766 - DNA, 13 bp, Unknown
  misc_feature (1)..( 13): Result.005 file - promoters50/3439289
acgttaaggcaaa

SEQ ID NO: 184767 - DNA, 13 bp, Unknown
  misc_feature (1)..( 13): Result.005 file - promoters50/3439289
ccataaaggaaaa

SEQ ID NO: 184768 - DNA, 13 bp, Unknown
  misc_feature (1)..( 13): Result.005 file - promoters50/3439289
ccaaaaaagaaat

SEQ ID NO: 184769 - DNA, 13 bp, Unknown
  misc_feature (1)..( 13): Result.005 file - promoters50/3439289
tgtttaaaacaaa

SEQ ID NO: 184770 - DNA, 13 bp, Unknown
  misc_feature (1)..( 13): Result.005 file - promoters50/3439289
ataaaaaagaaaa

SEQ ID NO: 184771 - DNA, 13 bp, Unknown
  misc_feature (1)..( 13): Result.005 file - promoters50/3439289
tgtttatggaaaa

SEQ ID NO: 184772 - DNA, 13 bp, Unknown
  misc_feature (1)..( 13): Result.005 file - promoters50/3439289
ttaataaaacatt

SEQ ID NO: 184773 - DNA, 10 bp, Unknown
  misc_feature (1)..( 10): Result.005 file - promoters50/3439303
gcttggattc

SEQ ID NO: 184774 - DNA, 10 bp, Unknown
  misc_feature (1)..( 10): Result.005 file - promoters50/3439303
gtatggatta

SEQ ID NO: 184775 - DNA, 10 bp, Unknown
  misc_feature (1)..( 10): Result.005 file - promoters50/3439303
ttttgaattc

SEQ ID NO: 184776 - DNA, 10 bp, Unknown
  misc_feature (1)..( 10): Result.005 file - promoters50/3439303
tattgatgtg

SEQ ID NO: 184777 - DNA, 7 bp, Unknown
  misc_feature (1)..( 7): Result.005 file - promoters50/3439307
gaagatc

SEQ ID NO: 184778 - DNA, 6 bp, Unknown
  misc_feature (1)..( 6): Result.005 file - promoters50/3439307
aagatc

SEQ ID NO: 184779 - DNA, 7 bp, Unknown
  misc_feature (1)..( 7): Result.005 file - promoters50/3439307
gaagatg

SEQ ID NO: 184780 - DNA, 8 bp, Unknown
  misc_feature (1)..( 8): Result.005 file - promoters50/3439307
tgataatg

SEQ ID NO: 184781 - DNA, 8 bp, Unknown
  misc_feature (1)..( 8): Result.005 file - promoters50/3439307
tgataaga

SEQ ID NO: 184782 - DNA, 8 bp, Unknown
  misc_feature (1)..( 8): Result.005 file - promoters50/3439307
cgattaga

SEQ ID NO: 184783 - DNA, 7 bp, Unknown
  misc_feature (1)..( 7): Result.005 file - promoters50/3439330
attataa

SEQ ID NO: 184784 - DNA, 7 bp, Unknown
  misc_feature (1)..( 7): Result.005 file - promoters50/3439330
attttaa

SEQ ID NO: 184785 - DNA, 7 bp, Unknown
  misc_feature (1)..( 7): Result.005 file - promoters50/3439330
attttaa

SEQ ID NO: 184786 - DNA, 10 bp, Unknown
  misc_feature (1)..( 10): Result.005 file - promoters50/3439330
aataaaaaaa

SEQ ID NO: 184787 - DNA, 10 bp, Unknown
  misc_feature (1)..( 10): Result.005 file - promoters50/3439330
aataataaaa

SEQ ID NO: 184788 - DNA, 10 bp, Unknown
  misc_feature (1)..( 10): Result.005 file - promoters50/3439330
cggaaaaaag

SEQ ID NO: 184789 - DNA, 8 bp, Unknown
  misc_feature (1)..( 8): Result.005 file - promoters50/3439330
caaagagt

SEQ ID NO: 184790 - DNA, 8 bp, Unknown
  misc_feature (1)..( 8): Result.005 file - promoters50/3439330
aaaagagg

SEQ ID NO: 184791 - DNA, 8 bp, Unknown
  misc_feature (1)..( 8): Result.005 file - promoters50/3439330
aaaataga

SEQ ID NO: 184792 - DNA, 9 bp, Unknown
  misc_feature (1)..( 9): Result.005 file - promoters50/3439334
ttttacttg

SEQ ID NO: 184793 - DNA, 9 bp, Unknown
  misc_feature (1)..( 9): Result.005 file - promoters50/3439334
tgttatttg

SEQ ID NO: 184794 - DNA, 9 bp, Unknown
  misc_feature (1)..( 9): Result.005 file - promoters50/3439334
ttttatttg

SEQ ID NO: 184795 - DNA, 7 bp, Unknown
  misc_feature (1)..( 7): Result.005 file - promoters50/3439334
ttatatg

SEQ ID NO: 184796 - DNA, 7 bp, Unknown
  misc_feature (1)..( 7): Result.005 file - promoters50/3439334
atatatg

SEQ ID NO: 184797 - DNA, 7 bp, Unknown
  misc_feature (1)..( 7): Result.005 file - promoters50/3439334
ttatata

SEQ ID NO: 184798 - DNA, 7 bp, Unknown
  misc_feature (1)..( 7): Result.005 file - promoters50/3439334
aaaataa

SEQ ID NO: 184799 - DNA, 7 bp, Unknown
  misc_feature (1)..( 7): Result.005 file - promoters50/3439334
aaattaa

SEQ ID NO: 184800 - DNA, 7 bp, Unknown
  misc_feature (1)..( 7): Result.005 file - promoters50/3439334
aaaataa

SEQ ID NO: 184801 - DNA, 8 bp, Unknown
  misc_feature (1)..( 8): Result.005 file - promoters50/3439334
aaaaatag

SEQ ID NO: 184802 - DNA, 8 bp, Unknown
  misc_feature (1)..( 8): Result.005 file - promoters50/3439334
aaaaataa

SEQ ID NO: 184803 - DNA, 8 bp, Unknown
  misc_feature (1)..( 8): Result.005 file - promoters50/3439334
gaaattaa

SEQ ID NO: 184804 - DNA, 7 bp, Unknown
  misc_feature (1)..( 7): Result.005 file - promoters50/3439334
ttaaaat

SEQ ID NO: 184805 - DNA, 7 bp, Unknown
  misc_feature (1)..( 7): Result.005 file - promoters50/3439334
ttaaaat

SEQ ID NO: 184806 - DNA, 7 bp, Unknown
  misc_feature (1)..( 7): Result.005 file - promoters50/3439334
ttaaaaa

SEQ ID NO: 184807 - DNA, 7 bp, Unknown
  misc_feature (1)..( 7): Result.005 file - promoters50/3439334
taacttt

SEQ ID NO: 184808 - DNA, 7 bp, Unknown
  misc_feature (1)..( 7): Result.005 file - promoters50/3439334
aaacttt

SEQ ID NO: 184809 - DNA, 8 bp, Unknown
  misc_feature (1)..( 8): Result.005 file - promoters50/3439334
aaatcttg

SEQ ID NO: 184810 - DNA, 16 bp, Unknown
  misc_feature (1)..( 16): Result.005 file - promoters50/3439353
atatgcttatattcgt

SEQ ID NO: 184811 - DNA, 16 bp, Unknown
  misc_feature (1)..( 16): Result.005 file - promoters50/3439353
aaatctttaaattatt

SEQ ID NO: 184812 - DNA, 16 bp, Unknown
  misc_feature (1)..( 16): Result.005 file - promoters50/3439353
aaagctttaaacttta

SEQ ID NO: 184813 - DNA, 16 bp, Unknown
  misc_feature (1)..( 16): Result.005 file - promoters50/3439353
gagagaagaaatgatt

SEQ ID NO: 184814 - DNA, 16 bp, Unknown
  misc_feature (1)..( 16): Result.005 file - promoters50/3439353
ctagctttcaccatca

SEQ ID NO: 184815 - DNA, 16 bp, Unknown
  misc_feature (1)..( 16): Result.005 file - promoters50/3439353
tttcactgaaatgcta

SEQ ID NO: 184816 - DNA, 17 bp, Unknown
  misc_feature (1)..( 17): Result.005 file - promoters50/3439364
aaaaacatgttggtatg

SEQ ID NO: 184817 - DNA, 17 bp, Unknown
  misc_feature (1)..( 17): Result.005 file - promoters50/3439364
tgactcattttgacatc

SEQ ID NO: 184818 - DNA, 17 bp, Unknown
  misc_feature (1)..( 17): Result.005 file - promoters50/3439364
aaaaaaatgtttgataa

SEQ ID NO: 184819 - DNA, 17 bp, Unknown
  misc_feature (1)..( 17): Result.005 file - promoters50/3439364
aaccttgttttgatcgc

SEQ ID NO: 184820 - DNA, 17 bp, Unknown
  misc_feature (1)..( 17): Result.005 file - promoters50/3439364
tatcggctgatgaaaaa

SEQ ID NO: 184821 - DNA, 17 bp, Unknown
  misc_feature (1)..( 17): Result.005 file - promoters50/3439364
acaaaaatggataacgt

SEQ ID NO: 184822 - DNA, 17 bp, Unknown
  misc_feature (1)..( 17): Result.005 file - promoters50/3439364
tataaaatgcacgttga

SEQ ID NO: 184823 - DNA, 19 bp, Unknown
  misc_feature (1)..( 19): Result.005 file - promoters50/3439364
gtgattttaaaaaaaaaaa

SEQ ID NO: 184824 - DNA, 19 bp, Unknown
  misc_feature (1)..( 19): Result.005 file - promoters50/3439364
ttttttttaacaaatttct

SEQ ID NO: 184825 - DNA, 19 bp, Unknown
  misc_feature (1)..( 19): Result.005 file - promoters50/3439364
atatttttataaatagtaa

SEQ ID NO: 184826 - DNA, 19 bp, Unknown
  misc_feature (1)..( 19): Result.005 file - promoters50/3439364
tagaagttaaaaaatcttg

SEQ ID NO: 184827 - DNA, 19 bp, Unknown
  misc_feature (1)..( 19): Result.005 file - promoters50/3439364
accaaattaaaatgtttgt

SEQ ID NO: 184828 - DNA, 19 bp, Unknown
  misc_feature (1)..( 19): Result.005 file - promoters50/3439364
atatatttaatcagaaatt

SEQ ID NO: 184829 - DNA, 19 bp, Unknown
  misc_feature (1)..( 19): Result.005 file - promoters50/3439364
atcgctttaaactatagtt

SEQ ID NO: 184830 - DNA, 19 bp, Unknown
  misc_feature (1)..( 19): Result.005 file - promoters50/3439364
ttgagatagtactatcgtt

SEQ ID NO: 184831 - DNA, 13 bp, Unknown
  misc_feature (1)..( 13): Result.005 file - promoters50/3439364
gcatatatataag

SEQ ID NO: 184832 - DNA, 13 bp, Unknown
  misc_feature (1)..( 13): Result.005 file - promoters50/3439364
tactatataaact

SEQ ID NO: 184833 - DNA, 13 bp, Unknown
  misc_feature (1)..( 13): Result.005 file - promoters50/3439364
gtatatatactct

SEQ ID NO: 184834 - DNA, 13 bp, Unknown
  misc_feature (1)..( 13): Result.005 file - promoters50/3439364
ctatatataaagt

SEQ ID NO: 184835 - DNA, 13 bp, Unknown
  misc_feature (1)..( 13): Result.005 file - promoters50/3439364
ctatatataaaga

SEQ ID NO: 184836 - DNA, 13 bp, Unknown
  misc_feature (1)..( 13): Result.005 file - promoters50/3439364
ccttctataaaaa

SEQ ID NO: 184837 - DNA, 11 bp, Unknown
  misc_feature (1)..( 11): Result.005 file - promoters50/3439364
aaaaaaaaaat

SEQ ID NO: 184838 - DNA, 11 bp, Unknown
  misc_feature (1)..( 11): Result.005 file - promoters50/3439364
aaaaaaagaat

SEQ ID NO: 184839 - DNA, 11 bp, Unknown
  misc_feature (1)..( 11): Result.005 file - promoters50/3439364
aaaatactgaa

SEQ ID NO: 184840 - DNA, 11 bp, Unknown
  misc_feature (1)..( 11): Result.005 file - promoters50/3439364
aaaataataat

SEQ ID NO: 184841 - DNA, 11 bp, Unknown
  misc_feature (1)..( 11): Result.005 file - promoters50/3439364
gaatgaagaat

SEQ ID NO: 184842 - DNA, 11 bp, Unknown
  misc_feature (1)..( 11): Result.005 file - promoters50/3439364
tcaaacagatg

SEQ ID NO: 184843 - DNA, 11 bp, Unknown
  misc_feature (1)..( 11): Result.005 file - promoters50/3439364
ttaaaatatat

SEQ ID NO: 184844 - DNA, 11 bp, Unknown
  misc_feature (1)..( 11): Result.005 file - promoters50/3439364
ctgaaatatta

SEQ ID NO: 184845 - DNA, 11 bp, Unknown
  misc_feature (1)..( 11): Result.005 file - promoters50/3439364
cgacaatgtat

SEQ ID NO: 184846 - DNA, 12 bp, Unknown
  misc_feature (1)..( 12): Result.005 file - promoters50/3439364
tttaaactatag

SEQ ID NO: 184847 - DNA, 12 bp, Unknown
  misc_feature (1)..( 12): Result.005 file - promoters50/3439364
attgacatattt

SEQ ID NO: 184848 - DNA, 12 bp, Unknown
  misc_feature (1)..( 12): Result.005 file - promoters50/3439364
attgagatagta

SEQ ID NO: 184849 - DNA, 12 bp, Unknown
  misc_feature (1)..( 12): Result.005 file - promoters50/3439374
tagtaattactg

SEQ ID NO: 184850 - DNA, 12 bp, Unknown
  misc_feature (1)..( 12): Result.005 file - promoters50/3439374
tcttaattaaaa

SEQ ID NO: 184851 - DNA, 12 bp, Unknown
  misc_feature (1)..( 12): Result.005 file - promoters50/3439374
ttagaattacaa

SEQ ID NO: 184852 - DNA, 12 bp, Unknown
  misc_feature (1)..( 12): Result.005 file - promoters50/3439374
tctttatttgat

SEQ ID NO: 184853 - DNA, 12 bp, Unknown
  misc_feature (1)..( 12): Result.005 file - promoters50/3439374
aatcaagtgttt

SEQ ID NO: 184854 - DNA, 12 bp, Unknown
  misc_feature (1)..( 12): Result.005 file - promoters50/3439374
tctttatttcta

SEQ ID NO: 184855 - DNA, 12 bp, Unknown
  misc_feature (1)..( 12): Result.005 file - promoters50/3439374
atttaattctgt

SEQ ID NO: 184856 - DNA, 9 bp, Unknown
  misc_feature (1)..( 9): Result.005 file - promoters50/3439392
aaaaaggtt

SEQ ID NO: 184857 - DNA, 9 bp, Unknown
  misc_feature (1)..( 9): Result.005 file - promoters50/3439392
aaaatggtt

SEQ ID NO: 184858 - DNA, 9 bp, Unknown
  misc_feature (1)..( 9): Result.005 file - promoters50/3439392
taaattgtt

SEQ ID NO: 184859 - DNA, 14 bp, Unknown
  misc_feature (1)..( 14): Result.005 file - promoters50/3439416
ttgattaaaatgtc

SEQ ID NO: 184860 - DNA, 14 bp, Unknown
  misc_feature (1)..( 14): Result.005 file - promoters50/3439416
tactataaaatact

SEQ ID NO: 184861 - DNA, 14 bp, Unknown
  misc_feature (1)..( 14): Result.005 file - promoters50/3439416
tacaataaaaagag

SEQ ID NO: 184862 - DNA, 14 bp, Unknown
  misc_feature (1)..( 14): Result.005 file - promoters50/3439416
gagaatacaatcca

SEQ ID NO: 184863 - DNA, 14 bp, Unknown
  misc_feature (1)..( 14): Result.005 file - promoters50/3439416
aaaaatcaaatctt

SEQ ID NO: 184864 - DNA, 14 bp, Unknown
  misc_feature (1)..( 14): Result.005 file - promoters50/3439416
gaacatcaaatagt

SEQ ID NO: 184865 - DNA, 14 bp, Unknown
  misc_feature (1)..( 14): Result.005 file - promoters50/3439416
cttaatcaaatagt

SEQ ID NO: 184866 - DNA, 12 bp, Unknown
  misc_feature (1)..( 12): Result.005 file - promoters50/3439420
cttttttagtat

SEQ ID NO: 184867 - DNA, 12 bp, Unknown
  misc_feature (1)..( 12): Result.005 file - promoters50/3439420
tgtttttaattc

SEQ ID NO: 184868 - DNA, 12 bp, Unknown
  misc_feature (1)..( 12): Result.005 file - promoters50/3439420
tgattttactat

SEQ ID NO: 184869 - DNA, 12 bp, Unknown
  misc_feature (1)..( 12): Result.005 file - promoters50/3439420
tgtatttgacga

SEQ ID NO: 184870 - DNA, 9 bp, Unknown
  misc_feature (1)..( 9): Result.005 file - promoters50/3439420
gcgccaaaa

SEQ ID NO: 184871 - DNA, 9 bp, Unknown
  misc_feature (1)..( 9): Result.005 file - promoters50/3439420
gcgtcaaaa

SEQ ID NO: 184872 - DNA, 9 bp, Unknown
  misc_feature (1)..( 9): Result.005 file - promoters50/3439420
ttgtccaaa

SEQ ID NO: 184873 - DNA, 11 bp, Unknown
  misc_feature (1)..( 11): Result.005 file - promoters50/3439457
cgaatttttgt

SEQ ID NO: 184874 - DNA, 11 bp, Unknown
  misc_feature (1)..( 11): Result.005 file - promoters50/3439457
tgaatttttgt

SEQ ID NO: 184875 - DNA, 11 bp, Unknown
  misc_feature (1)..( 11): Result.005 file - promoters50/3439457
tgattttttaa

SEQ ID NO: 184876 - DNA, 11 bp, Unknown
  misc_feature (1)..( 11): Result.005 file - promoters50/3439472
tcattttctta

SEQ ID NO: 184877 - DNA, 11 bp, Unknown
  misc_feature (1)..( 11): Result.005 file - promoters50/3439472
ccattttcaag

SEQ ID NO: 184878 - DNA, 11 bp, Unknown
  misc_feature (1)..( 11): Result.005 file - promoters50/3439472
ttattttcggc

SEQ ID NO: 184879 - DNA, 11 bp, Unknown
  misc_feature (1)..( 11): Result.005 file - promoters50/3439472
ccaatttgtaa

SEQ ID NO: 184880 - DNA, 11 bp, Unknown
  misc_feature (1)..( 11): Result.005 file - promoters50/3439472
tagttttccaa

SEQ ID NO: 184881 - DNA, 11 bp, Unknown
  misc_feature (1)..( 11): Result.005 file - promoters50/3439472
atattgtcaaa

SEQ ID NO: 184882 - DNA, 12 bp, Unknown
  misc_feature (1)..( 12): Result.005 file - promoters50/3439482
acgaaattagtg

SEQ ID NO: 184883 - DNA, 12 bp, Unknown
  misc_feature (1)..( 12): Result.005 file - promoters50/3439482
cacaaattaggc

SEQ ID NO: 184884 - DNA, 12 bp, Unknown
  misc_feature (1)..( 12): Result.005 file - promoters50/3439482
taaaaattatac

SEQ ID NO: 184885 - DNA, 12 bp, Unknown
  misc_feature (1)..( 12): Result.005 file - promoters50/3439482
cacagattctga

SEQ ID NO: 184886 - DNA, 12 bp, Unknown
  misc_feature (1)..( 12): Result.005 file - promoters50/3439482
ttcgaattcggc

SEQ ID NO: 184887 - DNA, 12 bp, Unknown
  misc_feature (1)..( 12): Result.005 file - promoters50/3439482
cactgattttta

SEQ ID NO: 184888 - DNA, 8 bp, Unknown
  misc_feature (1)..( 8): Result.005 file - promoters50/3439506
aaactgaa

SEQ ID NO: 184889 - DNA, 8 bp, Unknown
  misc_feature (1)..( 8): Result.005 file - promoters50/3439506
aaattgaa

SEQ ID NO: 184890 - DNA, 8 bp, Unknown
  misc_feature (1)..( 8): Result.005 file - promoters50/3439506
aaattgtt

SEQ ID NO: 184891 - DNA, 8 bp, Unknown
  misc_feature (1)..( 8): Result.005 file - promoters50/3439506
aaataaga

SEQ ID NO: 184892 - DNA, 8 bp, Unknown
  misc_feature (1)..( 8): Result.005 file - promoters50/3439506
aaaaaaga

SEQ ID NO: 184893 - DNA, 8 bp, Unknown
  misc_feature (1)..( 8): Result.005 file - promoters50/3439506
aaaggagg

SEQ ID NO: 184894 - DNA, 11 bp, Unknown
  misc_feature (1)..( 11): Result.005 file - promoters50/3439595
tgcttatataa

SEQ ID NO: 184895 - DNA, 11 bp, Unknown
  misc_feature (1)..( 11): Result.005 file - promoters50/3439595
cccttataaaa

SEQ ID NO: 184896 - DNA, 11 bp, Unknown
  misc_feature (1)..( 11): Result.005 file - promoters50/3439595
cccatataaaa

SEQ ID NO: 184897 - DNA, 11 bp, Unknown
  misc_feature (1)..( 11): Result.005 file - promoters50/3439595
ggcctataaaa

SEQ ID NO: 184898 - DNA, 11 bp, Unknown
  misc_feature (1)..( 11): Result.005 file - promoters50/3439595
gccttatcaga

SEQ ID NO: 184899 - DNA, 11 bp, Unknown
  misc_feature (1)..( 11): Result.005 file - promoters50/3439595
actatataaag

SEQ ID NO: 184900 - DNA, 9 bp, Unknown
  misc_feature (1)..( 9): Result.005 file - promoters50/3439605
atattaaat

SEQ ID NO: 184901 - DNA, 9 bp, Unknown
  misc_feature (1)..( 9): Result.005 file - promoters50/3439605
cgattaaat

SEQ ID NO: 184902 - DNA, 9 bp, Unknown
  misc_feature (1)..( 9): Result.005 file - promoters50/3439605
ataataatt

SEQ ID NO: 184903 - DNA, 9 bp, Unknown
  misc_feature (1)..( 9): Result.005 file - promoters50/3439605
cgattgaat

SEQ ID NO: 184904 - DNA, 10 bp, Unknown
  misc_feature (1)..( 10): Result.005 file - promoters50/3439605
tccgtataat

SEQ ID NO: 184905 - DNA, 9 bp, Unknown
  misc_feature (1)..( 9): Result.005 file - promoters50/3439614
caaagaaat

SEQ ID NO: 184906 - DNA, 9 bp, Unknown
  misc_feature (1)..( 9): Result.005 file - promoters50/3439614
gaaaaaaag

SEQ ID NO: 184907 - DNA, 9 bp, Unknown
  misc_feature (1)..( 9): Result.005 file - promoters50/3439614
taaataaat

SEQ ID NO: 184908 - DNA, 9 bp, Unknown
  misc_feature (1)..( 9): Result.005 file - promoters50/3439614
gagaaaaag

SEQ ID NO: 184909 - DNA, 9 bp, Unknown
  misc_feature (1)..( 9): Result.005 file - promoters50/3439614
caaaaaagg

SEQ ID NO: 184910 - DNA, 9 bp, Unknown
  misc_feature (1)..( 9): Result.005 file - promoters50/3439614
aagaagaag

SEQ ID NO: 184911 - DNA, 9 bp, Unknown
  misc_feature (1)..( 9): Result.005 file - promoters50/3439614
cagaaggtc

SEQ ID NO: 184912 - DNA, 9 bp, Unknown
  misc_feature (1)..( 9): Result.005 file - promoters50/3439637
aataaaata

SEQ ID NO: 184913 - DNA, 9 bp, Unknown
  misc_feature (1)..( 9): Result.005 file - promoters50/3439637
aatcaaata

SEQ ID NO: 184914 - DNA, 9 bp, Unknown
  misc_feature (1)..( 9): Result.005 file - promoters50/3439637
gataaaaaa

SEQ ID NO: 184915 - DNA, 9 bp, Unknown
  misc_feature (1)..( 9): Result.005 file - promoters50/3439637
caactttaa

SEQ ID NO: 184916 - DNA, 9 bp, Unknown
  misc_feature (1)..( 9): Result.005 file - promoters50/3439637
caaatttct

SEQ ID NO: 184917 - DNA, 9 bp, Unknown
  misc_feature (1)..( 9): Result.005 file - promoters50/3439637
aaaattcta

SEQ ID NO: 184918 - DNA, 8 bp, Unknown
  misc_feature (1)..( 8): Result.005 file - promoters50/3439637
caaagaca

SEQ ID NO: 184919 - DNA, 8 bp, Unknown
  misc_feature (1)..( 8): Result.005 file - promoters50/3439637
caaagaaa

SEQ ID NO: 184920 - DNA, 8 bp, Unknown
  misc_feature (1)..( 8): Result.005 file - promoters50/3439637
taaagaaa

SEQ ID NO: 184921 - DNA, 16 bp, Unknown
  misc_feature (1)..( 16): Result.005 file - promoters50/3439662
tttagaaaatgggatt

SEQ ID NO: 184922 - DNA, 16 bp, Unknown
  misc_feature (1)..( 16): Result.005 file - promoters50/3439662
atttgaaattggtaga

SEQ ID NO: 184923 - DNA, 17 bp, Unknown
  misc_feature (1)..( 17): Result.005 file - promoters50/3439662
gaaccaaaatcggattt

SEQ ID NO: 184924 - DNA, 17 bp, Unknown
  misc_feature (1)..( 17): Result.005 file - promoters50/3439662
acttgtaatacccagta

SEQ ID NO: 184925 - DNA, 17 bp, Unknown
  misc_feature (1)..( 17): Result.005 file - promoters50/3439662
attagaacttgggagaa

SEQ ID NO: 184926 - DNA, 17 bp, Unknown
  misc_feature (1)..( 17): Result.005 file - promoters50/3439662
atttgagagttcagaaa

SEQ ID NO: 184927 - DNA, 7 bp, Unknown
  misc_feature (1)..( 7): Result.005 file - promoters50/3439905
aaataat

SEQ ID NO: 184928 - DNA, 7 bp, Unknown
  misc_feature (1)..( 7): Result.005 file - promoters50/3439905
aaataaa

SEQ ID NO: 184929 - DNA, 7 bp, Unknown
  misc_feature (1)..( 7): Result.005 file - promoters50/3439905
taataat

SEQ ID NO: 184930 - DNA, 7 bp, Unknown
  misc_feature (1)..( 7): Result.005 file - promoters50/3439905
taaaaaa

SEQ ID NO: 184931 - DNA, 7 bp, Unknown
  misc_feature (1)..( 7): Result.005 file - promoters50/3439905
taaaaac

SEQ ID NO: 184932 - DNA, 7 bp, Unknown
  misc_feature (1)..( 7): Result.005 file - promoters50/3439905
taaaaaa

SEQ ID NO: 184933 - DNA, 8 bp, Unknown
  misc_feature (1)..( 8): Result.005 file - promoters50/3441755
tgtatata

SEQ ID NO: 184934 - DNA, 8 bp, Unknown
  misc_feature (1)..( 8): Result.005 file - promoters50/3441755
tgtttatt

SEQ ID NO: 184935 - DNA, 8 bp, Unknown
  misc_feature (1)..( 8): Result.005 file - promoters50/3441755
cttttatt

SEQ ID NO: 184936 - DNA, 8 bp, Unknown
  misc_feature (1)..( 8): Result.005 file - promoters50/3441755
ctgtgtct

SEQ ID NO: 184937 - DNA, 8 bp, Unknown
  misc_feature (1)..( 8): Result.005 file - promoters50/3441755
ctgtgttg

SEQ ID NO: 184938 - DNA, 8 bp, Unknown
  misc_feature (1)..( 8): Result.005 file - promoters50/3441755
ttgtcttg

SEQ ID NO: 184939 - DNA, 14 bp, Unknown
  misc_feature (1)..( 14): Result.005 file - promoters50/3442171
aaaatgtttgttgt

SEQ ID NO: 184940 - DNA, 14 bp, Unknown
  misc_feature (1)..( 14): Result.005 file - promoters50/3442171
cggcggttcgtttt

SEQ ID NO: 184941 - DNA, 14 bp, Unknown
  misc_feature (1)..( 14): Result.005 file - promoters50/3442171
aatttgtttgaata

SEQ ID NO: 184942 - DNA, 14 bp, Unknown
  misc_feature (1)..( 14): Result.005 file - promoters50/3442171
ttcaaacttgatgt

SEQ ID NO: 184943 - DNA, 14 bp, Unknown
  misc_feature (1)..( 14): Result.005 file - promoters50/3442171
tctttatttgcgtg

SEQ ID NO: 184944 - DNA, 14 bp, Unknown
  misc_feature (1)..( 14): Result.005 file - promoters50/3442171
aatatgttttggtt

SEQ ID NO: 184945 - DNA, 11 bp, Unknown
  misc_feature (1)..( 11): Result.005 file - promoters50/3442171
acagatgttta

SEQ ID NO: 184946 - DNA, 11 bp, Unknown
  misc_feature (1)..( 11): Result.005 file - promoters50/3442171
acatatgttac

SEQ ID NO: 184947 - DNA, 11 bp, Unknown
  misc_feature (1)..( 11): Result.005 file - promoters50/3442171
ttagatttttt

SEQ ID NO: 184948 - DNA, 12 bp, Unknown
  misc_feature (1)..( 12): Result.005 file - promoters50/3442171
ggagatttgtta

SEQ ID NO: 184949 - DNA, 12 bp, Unknown
  misc_feature (1)..( 12): Result.005 file - promoters50/3442171
tctaatttgttt

SEQ ID NO: 184950 - DNA, 12 bp, Unknown
  misc_feature (1)..( 12): Result.005 file - promoters50/3442171
atagattagcta

SEQ ID NO: 184951 - DNA, 12 bp, Unknown
  misc_feature (1)..( 12): Result.005 file - promoters50/3442171
tgtcattggtta

SEQ ID NO: 184952 - DNA, 8 bp, Unknown
  misc_feature (1)..( 8): Result.005 file - promoters50/3442286
aattaaaa

SEQ ID NO: 184953 - DNA, 8 bp, Unknown
  misc_feature (1)..( 8): Result.005 file - promoters50/3442286
aatcaaat

SEQ ID NO: 184954 - DNA, 8 bp, Unknown
  misc_feature (1)..( 8): Result.005 file - promoters50/3442286
cattaaat

SEQ ID NO: 184955 - DNA, 8 bp, Unknown
  misc_feature (1)..( 8): Result.005 file - promoters50/3442286
aattgaat

SEQ ID NO: 184956 - DNA, 9 bp, Unknown
  misc_feature (1)..( 9): Result.005 file - promoters50/3442286
taaaagaaa

SEQ ID NO: 184957 - DNA, 9 bp, Unknown
  misc_feature (1)..( 9): Result.005 file - promoters50/3442286
taaaaaaaa

SEQ ID NO: 184958 - DNA, 9 bp, Unknown
  misc_feature (1)..( 9): Result.005 file - promoters50/3442286
tgagaaaat

SEQ ID NO: 184959 - DNA, 11 bp, Unknown
  misc_feature (1)..( 11): Result.005 file - promoters50/3442286
cctcttaccat

SEQ ID NO: 184960 - DNA, 11 bp, Unknown
  misc_feature (1)..( 11): Result.005 file - promoters50/3442286
cctcttcctag

SEQ ID NO: 184961 - DNA, 11 bp, Unknown
  misc_feature (1)..( 11): Result.005 file - promoters50/3442286
gctcttcatag

SEQ ID NO: 184962 - DNA, 7 bp, Unknown
  misc_feature (1)..( 7): Result.005 file - promoters50/3442286
atgtttc

SEQ ID NO: 184963 - DNA, 7 bp, Unknown
  misc_feature (1)..( 7): Result.005 file - promoters50/3442286
ttgtttc

SEQ ID NO: 184964 - DNA, 7 bp, Unknown
  misc_feature (1)..( 7): Result.005 file - promoters50/3442286
ttgattc

SEQ ID NO: 184965 - DNA, 8 bp, Unknown
  misc_feature (1)..( 8): Result.005 file - promoters50/3442286
atataatt

SEQ ID NO: 184966 - DNA, 8 bp, Unknown
  misc_feature (1)..( 8): Result.005 file - promoters50/3442286
atatcatt

SEQ ID NO: 184967 - DNA, 8 bp, Unknown
  misc_feature (1)..( 8): Result.005 file - promoters50/3442286
atatcacc

SEQ ID NO: 184968 - DNA, 10 bp, Unknown
  misc_feature (1)..( 10): Result.005 file - promoters50/3442286
taaagttaat

SEQ ID NO: 184969 - DNA, 10 bp, Unknown
  misc_feature (1)..( 10): Result.005 file - promoters50/3442286
taatgttttc

SEQ ID NO: 184970 - DNA, 10 bp, Unknown
  misc_feature (1)..( 10): Result.005 file - promoters50/3442286
acatgttttc

SEQ ID NO: 184971 - DNA, 7 bp, Unknown
  misc_feature (1)..( 7): Result.005 file - promoters50/3442286
gtttctc

SEQ ID NO: 184972 - DNA, 7 bp, Unknown
  misc_feature (1)..( 7): Result.005 file - promoters50/3442286
gtttctc

SEQ ID NO: 184973 - DNA, 7 bp, Unknown
  misc_feature (1)..( 7): Result.005 file - promoters50/3442286
gtttctt

SEQ ID NO: 184974 - DNA, 9 bp, Unknown
  misc_feature (1)..( 9): Result.005 file - promoters50/3442286
catatttgc

SEQ ID NO: 184975 - DNA, 9 bp, Unknown
  misc_feature (1)..( 9): Result.005 file - promoters50/3442286
catgttttc

SEQ ID NO: 184976 - DNA, 9 bp, Unknown
  misc_feature (1)..( 9): Result.005 file - promoters50/3442286
aatgttttc

SEQ ID NO: 184977 - DNA, 7 bp, Unknown
  misc_feature (1)..( 7): Result.005 file - promoters50/3442286
caaaaat

SEQ ID NO: 184978 - DNA, 7 bp, Unknown
  misc_feature (1)..( 7): Result.005 file - promoters50/3442286
caaaaac

SEQ ID NO: 184979 - DNA, 7 bp, Unknown
  misc_feature (1)..( 7): Result.005 file - promoters50/3442286
gaaaaac

SEQ ID NO: 184980 - DNA, 9 bp, Unknown
  misc_feature (1)..( 9): Result.005 file - promoters50/3443646
atttattaa

SEQ ID NO: 184981 - DNA, 9 bp, Unknown
  misc_feature (1)..( 9): Result.005 file - promoters50/3443646
cgttaataa

SEQ ID NO: 184982 - DNA, 9 bp, Unknown
  misc_feature (1)..( 9): Result.005 file - promoters50/3443646
aattatttg

SEQ ID NO: 184983 - DNA, 7 bp, Unknown
  misc_feature (1)..( 7): Result.005 file - promoters50/3443646
atttaac

SEQ ID NO: 184984 - DNA, 7 bp, Unknown
  misc_feature (1)..( 7): Result.005 file - promoters50/3443646
atttaag

SEQ ID NO: 184985 - DNA, 7 bp, Unknown
  misc_feature (1)..( 7): Result.005 file - promoters50/3443646
ttttaag

SEQ ID NO: 184986 - DNA, 12 bp, Unknown
  misc_feature (1)..( 12): Result.005 file - promoters50/3443646
gatcaaaaagaa

SEQ ID NO: 184987 - DNA, 12 bp, Unknown
  misc_feature (1)..( 12): Result.005 file - promoters50/3443646
gatcaataagaa

SEQ ID NO: 184988 - DNA, 12 bp, Unknown
  misc_feature (1)..( 12): Result.005 file - promoters50/3443646
gatctaaaagct

SEQ ID NO: 184989 - DNA, 9 bp, Unknown
  misc_feature (1)..( 9): Result.005 file - promoters50/3443646
aataaatgt

SEQ ID NO: 184990 - DNA, 9 bp, Unknown
  misc_feature (1)..( 9): Result.005 file - promoters50/3443646
aataaagct

SEQ ID NO: 184991 - DNA, 9 bp, Unknown
  misc_feature (1)..( 9): Result.005 file - promoters50/3443646
gataatgct

SEQ ID NO: 184992 - DNA, 12 bp, Unknown
  misc_feature (1)..( 12): Result.005 file - promoters50/3445482
gtaagaaaaaaa

SEQ ID NO: 184993 - DNA, 12 bp, Unknown
  misc_feature (1)..( 12): Result.005 file - promoters50/3445482
caaagaaattcc

SEQ ID NO: 184994 - DNA, 12 bp, Unknown
  misc_feature (1)..( 12): Result.005 file - promoters50/3445482
agaataaaaaca

SEQ ID NO: 184995 - DNA, 12 bp, Unknown
  misc_feature (1)..( 12): Result.005 file - promoters50/3445482
agaagaaacaaa

SEQ ID NO: 184996 - DNA, 13 bp, Unknown
  misc_feature (1)..( 13): Result.005 file - promoters50/3445482
atgtccaaacaaa

SEQ ID NO: 184997 - DNA, 13 bp, Unknown
  misc_feature (1)..( 13): Result.005 file - promoters50/3445482
tcaatcaaatcgg

SEQ ID NO: 184998 - DNA, 9 bp, Unknown
  misc_feature (1)..( 9): Result.005 file - promoters50/3445482
aaaaaaaaa

SEQ ID NO: 184999 - DNA, 9 bp, Unknown
  misc_feature (1)..( 9): Result.005 file - promoters50/3445482
tgaaaaaaa

SEQ ID NO: 185000 - DNA, 10 bp, Unknown
  misc_feature (1)..( 10): Result.005 file - promoters50/3445482
agaataaaaa

SEQ ID NO: 185001 - DNA, 10 bp, Unknown
  misc_feature (1)..( 10): Result.005 file - promoters50/3445482
agaaacaaag

SEQ ID NO: 185002 - DNA, 10 bp, Unknown
  misc_feature (1)..( 10): Result.005 file - promoters50/3445482
tcaaaaaaat

SEQ ID NO: 185003 - DNA, 10 bp, Unknown
  misc_feature (1)..( 10): Result.005 file - promoters50/3445482
tcaatcaaat

SEQ ID NO: 185004 - DNA, 13 bp, Unknown
  misc_feature (1)..( 13): Result.005 file - promoters50/3445482
ctcgtataattct

SEQ ID NO: 185005 - DNA, 13 bp, Unknown
  misc_feature (1)..( 13): Result.005 file - promoters50/3445482
tgtgtatcattct

SEQ ID NO: 185006 - DNA, 13 bp, Unknown
  misc_feature (1)..( 13): Result.005 file - promoters50/3445482
ttcgtttaacaga

SEQ ID NO: 185007 - DNA, 13 bp, Unknown
  misc_feature (1)..( 13): Result.005 file - promoters50/3445482
ctcttatgatttg

SEQ ID NO: 185008 - DNA, 13 bp, Unknown
  misc_feature (1)..( 13): Result.005 file - promoters50/3445482
tttttttgtttct

SEQ ID NO: 185009 - DNA, 13 bp, Unknown
  misc_feature (1)..( 13): Result.005 file - promoters50/3445482
tgtttttgctgat

SEQ ID NO: 185010 - DNA, 8 bp, Unknown
  misc_feature (1)..( 8): Result.005 file - promoters50/3447843
aagattta

SEQ ID NO: 185011 - DNA, 8 bp, Unknown
  misc_feature (1)..( 8): Result.005 file - promoters50/3447843
aaggtttt

SEQ ID NO: 185012 - DNA, 8 bp, Unknown
  misc_feature (1)..( 8): Result.005 file - promoters50/3447843
cagatttt

SEQ ID NO: 185013 - DNA, 8 bp, Unknown
  misc_feature (1)..( 8): Result.005 file - promoters50/3447843
gagatttt

SEQ ID NO: 185014 - DNA, 8 bp, Unknown
  misc_feature (1)..( 8): Result.005 file - promoters50/3447843
aagattgt

SEQ ID NO: 185015 - DNA, 9 bp, Unknown
  misc_feature (1)..( 9): Result.005 file - promoters50/3447843
taggtgttg

SEQ ID NO: 185016 - DNA, 20 bp, Unknown
  misc_feature (1)..( 20): Result.005 file - promoters50/3593205
gcaattaattagatttttta

SEQ ID NO: 185017 - DNA, 20 bp, Unknown
  misc_feature (1)..( 20): Result.005 file - promoters50/3593205
tacaattattcgatcttttt

SEQ ID NO: 185018 - DNA, 20 bp, Unknown
  misc_feature (1)..( 20): Result.005 file - promoters50/3593205
ccaaaaaattggatccgaaa

SEQ ID NO: 185019 - DNA, 20 bp, Unknown
  misc_feature (1)..( 20): Result.005 file - promoters50/3593205
ataaattattatattgaatc

SEQ ID NO: 185020 - DNA, 20 bp, Unknown
  misc_feature (1)..( 20): Result.005 file - promoters50/3593205
catccatcggagatttgtta

SEQ ID NO: 185021 - DNA, 20 bp, Unknown
  misc_feature (1)..( 20): Result.005 file - promoters50/3593205
atgaacatagagatctttat

SEQ ID NO: 185022 - DNA, 20 bp, Unknown
  misc_feature (1)..( 20): Result.005 file - promoters50/3593205
ataaataattataaagtatt

SEQ ID NO: 185023 - DNA, 20 bp, Unknown
  misc_feature (1)..( 20): Result.005 file - promoters50/3593205
agaagccttctgatatgtcc

SEQ ID NO: 185024 - DNA, 15 bp, Unknown
  misc_feature (1)..( 15): Result.005 file - promoters50/3593205
aacaccaaaaaaaga

SEQ ID NO: 185025 - DNA, 15 bp, Unknown
  misc_feature (1)..( 15): Result.005 file - promoters50/3593205
ttattcaaaaatcta

SEQ ID NO: 185026 - DNA, 15 bp, Unknown
  misc_feature (1)..( 15): Result.005 file - promoters50/3593205
gaacactaaaaggag

SEQ ID NO: 185027 - DNA, 15 bp, Unknown
  misc_feature (1)..( 15): Result.005 file - promoters50/3593205
ttatccaataatcta

SEQ ID NO: 185028 - DNA, 15 bp, Unknown
  misc_feature (1)..( 15): Result.005 file - promoters50/3593205
gaatctaatacaact

SEQ ID NO: 185029 - DNA, 15 bp, Unknown
  misc_feature (1)..( 15): Result.005 file - promoters50/3593205
tgaaactaaaactgt

SEQ ID NO: 185030 - DNA, 16 bp, Unknown
  misc_feature (1)..( 16): Result.005 file - promoters50/3593205
tttgctcagatttctc

SEQ ID NO: 185031 - DNA, 16 bp, Unknown
  misc_feature (1)..( 16): Result.005 file - promoters50/3593205
aacccgaagatttatc

SEQ ID NO: 185032 - DNA, 16 bp, Unknown
  misc_feature (1)..( 16): Result.005 file - promoters50/3593205
tttgttcaaattcaaa

SEQ ID NO: 185033 - DNA, 16 bp, Unknown
  misc_feature (1)..( 16): Result.005 file - promoters50/3593205
taagctcagattagtt

SEQ ID NO: 185034 - DNA, 16 bp, Unknown
  misc_feature (1)..( 16): Result.005 file - promoters50/3593205
atgtcctagatatatc

SEQ ID NO: 185035 - DNA, 16 bp, Unknown
  misc_feature (1)..( 16): Result.005 file - promoters50/3593205
taaaataatatataat

SEQ ID NO: 185036 - DNA, 16 bp, Unknown
  misc_feature (1)..( 16): Result.005 file - promoters50/3593205
ttgaatcatataaaaa

SEQ ID NO: 185037 - DNA, 12 bp, Unknown
  misc_feature (1)..( 12): Result.005 file - promoters50/3593205
aactaatttagc

SEQ ID NO: 185038 - DNA, 12 bp, Unknown
  misc_feature (1)..( 12): Result.005 file - promoters50/3593205
aacttattttat

SEQ ID NO: 185039 - DNA, 12 bp, Unknown
  misc_feature (1)..( 12): Result.005 file - promoters50/3593205
atctattttgtc

SEQ ID NO: 185040 - DNA, 12 bp, Unknown
  misc_feature (1)..( 12): Result.005 file - promoters50/3593205
aaatattttatt

SEQ ID NO: 185041 - DNA, 12 bp, Unknown
  misc_feature (1)..( 12): Result.005 file - promoters50/3593205
aaggagtttatt

SEQ ID NO: 185042 - DNA, 12 bp, Unknown
  misc_feature (1)..( 12): Result.005 file - promoters50/3593205
gtaatatttatt

SEQ ID NO: 185043 - DNA, 11 bp, Unknown
  misc_feature (1)..( 11): Result.005 file - promoters50/3593230
gtcattcaatg

SEQ ID NO: 185044 - DNA, 11 bp, Unknown
  misc_feature (1)..( 11): Result.005 file - promoters50/3593230
cacattcatcc

SEQ ID NO: 185045 - DNA, 11 bp, Unknown
  misc_feature (1)..( 11): Result.005 file - promoters50/3593230
cacgttcttct

SEQ ID NO: 185046 - DNA, 11 bp, Unknown
  misc_feature (1)..( 11): Result.005 file - promoters50/3593230
tacatgttttt

SEQ ID NO: 185047 - DNA, 11 bp, Unknown
  misc_feature (1)..( 11): Result.005 file - promoters50/3593230
catatatatgt

SEQ ID NO: 185048 - DNA, 11 bp, Unknown
  misc_feature (1)..( 11): Result.005 file - promoters50/3593230
gttatatattc

SEQ ID NO: 185049 - DNA, 10 bp, Unknown
  misc_feature (1)..( 10): Result.005 file - promoters50/3593230
aagataataa

SEQ ID NO: 185050 - DNA, 10 bp, Unknown
  misc_feature (1)..( 10): Result.005 file - promoters50/3593230
cagaaaattc

SEQ ID NO: 185051 - DNA, 10 bp, Unknown
  misc_feature (1)..( 10): Result.005 file - promoters50/3593230
ctcaaacttc

SEQ ID NO: 185052 - DNA, 10 bp, Unknown
  misc_feature (1)..( 10): Result.005 file - promoters50/3593230
gtgaatatta

SEQ ID NO: 185053 - DNA, 10 bp, Unknown
  misc_feature (1)..( 10): Result.005 file - promoters50/3593230
cagaaatgaa

SEQ ID NO: 185054 - DNA, 10 bp, Unknown
  misc_feature (1)..( 10): Result.005 file - promoters50/3593230
tagatatggg

SEQ ID NO: 185055 - DNA, 10 bp, Unknown
  misc_feature (1)..( 10): Result.005 file - promoters50/3593243
aaagataaga

SEQ ID NO: 185056 - DNA, 10 bp, Unknown
  misc_feature (1)..( 10): Result.005 file - promoters50/3593243
aaacataatg

SEQ ID NO: 185057 - DNA, 10 bp, Unknown
  misc_feature (1)..( 10): Result.005 file - promoters50/3593243
cgtcattatg

SEQ ID NO: 185058 - DNA, 8 bp, Unknown
  misc_feature (1)..( 8): Result.005 file - promoters50/3593243
ttgtcttc

SEQ ID NO: 185059 - DNA, 8 bp, Unknown
  misc_feature (1)..( 8): Result.005 file - promoters50/3593243
ttgttttc

SEQ ID NO: 185060 - DNA, 8 bp, Unknown
  misc_feature (1)..( 8): Result.005 file - promoters50/3593243
ttgttttt

SEQ ID NO: 185061 - DNA, 9 bp, Unknown
  misc_feature (1)..( 9): Result.005 file - promoters50/3593243
taacacatg

SEQ ID NO: 185062 - DNA, 9 bp, Unknown
  misc_feature (1)..( 9): Result.005 file - promoters50/3593243
taatacata

SEQ ID NO: 185063 - DNA, 9 bp, Unknown
  misc_feature (1)..( 9): Result.005 file - promoters50/3593243
acatatata

SEQ ID NO: 185064 - DNA, 8 bp, Unknown
  misc_feature (1)..( 8): Result.005 file - promoters50/3593243
ccaaagtc

SEQ ID NO: 185065 - DNA, 8 bp, Unknown
  misc_feature (1)..( 8): Result.005 file - promoters50/3593243
ccaatgtc

SEQ ID NO: 185066 - DNA, 8 bp, Unknown
  misc_feature (1)..( 8): Result.005 file - promoters50/3593243
taaatgtc

SEQ ID NO: 185067 - DNA, 13 bp, Unknown
  misc_feature (1)..( 13): Result.005 file - promoters50/3593264
aaacaaaaaaaaa

SEQ ID NO: 185068 - DNA, 13 bp, Unknown
  misc_feature (1)..( 13): Result.005 file - promoters50/3593264
taggaaaaaaaaa

SEQ ID NO: 185069 - DNA, 13 bp, Unknown
  misc_feature (1)..( 13): Result.005 file - promoters50/3593264
aaacaagaaaaac

SEQ ID NO: 185070 - DNA, 13 bp, Unknown
  misc_feature (1)..( 13): Result.005 file - promoters50/3593264
ctccaaccaaaag

SEQ ID NO: 185071 - DNA, 13 bp, Unknown
  misc_feature (1)..( 13): Result.005 file - promoters50/3593264
aatatataaaaat

SEQ ID NO: 185072 - DNA, 13 bp, Unknown
  misc_feature (1)..( 13): Result.005 file - promoters50/3593264
atgcaagcaacct

SEQ ID NO: 185073 - DNA, 13 bp, Unknown
  misc_feature (1)..( 13): Result.005 file - promoters50/3593264
agtcaaacgattt

SEQ ID NO: 185074 - DNA, 7 bp, Unknown
  misc_feature (1)..( 7): Result.005 file - promoters50/3593264
aaaattc

SEQ ID NO: 185075 - DNA, 7 bp, Unknown
  misc_feature (1)..( 7): Result.005 file - promoters50/3593264
aaaattt

SEQ ID NO: 185076 - DNA, 8 bp, Unknown
  misc_feature (1)..( 8): Result.005 file - promoters50/3593264
aaacattt

SEQ ID NO: 185077 - DNA, 8 bp, Unknown
  misc_feature (1)..( 8): Result.005 file - promoters50/3593264
caaagtca

SEQ ID NO: 185078 - DNA, 8 bp, Unknown
  misc_feature (1)..( 8): Result.005 file - promoters50/3593264
aaaacttc

SEQ ID NO: 185079 - DNA, 8 bp, Unknown
  misc_feature (1)..( 8): Result.005 file - promoters50/3593264
taaaatta

SEQ ID NO: 185080 - DNA, 8 bp, Unknown
  misc_feature (1)..( 8): Result.005 file - promoters50/3593264
aacagttg

SEQ ID NO: 185081 - DNA, 10 bp, Unknown
  misc_feature (1)..( 10): Result.005 file - promoters50/3593264
gacataacaa

SEQ ID NO: 185082 - DNA, 10 bp, Unknown
  misc_feature (1)..( 10): Result.005 file - promoters50/3593264
cacataaact

SEQ ID NO: 185083 - DNA, 10 bp, Unknown
  misc_feature (1)..( 10): Result.005 file - promoters50/3593264
cacctaaccg

SEQ ID NO: 185084 - DNA, 10 bp, Unknown
  misc_feature (1)..( 10): Result.005 file - promoters50/3593264
aaccaaactc

SEQ ID NO: 185085 - DNA, 10 bp, Unknown
  misc_feature (1)..( 10): Result.005 file - promoters50/3593264
atcaaatcaa

SEQ ID NO: 185086 - DNA, 10 bp, Unknown
  misc_feature (1)..( 10): Result.005 file - promoters50/3593264
taactaaaat

SEQ ID NO: 185087 - DNA, 11 bp, Unknown
  misc_feature (1)..( 11): Result.005 file - promoters50/3593264
aattttgatta

SEQ ID NO: 185088 - DNA, 11 bp, Unknown
  misc_feature (1)..( 11): Result.005 file - promoters50/3593264
tggtttggtta

SEQ ID NO: 185089 - DNA, 11 bp, Unknown
  misc_feature (1)..( 11): Result.005 file - promoters50/3593264
tcttttgaagt

SEQ ID NO: 185090 - DNA, 11 bp, Unknown
  misc_feature (1)..( 11): Result.005 file - promoters50/3593264
cgttttgtttt

SEQ ID NO: 185091 - DNA, 11 bp, Unknown
  misc_feature (1)..( 11): Result.005 file - promoters50/3593264
tgttttgttct

SEQ ID NO: 185092 - DNA, 11 bp, Unknown
  misc_feature (1)..( 11): Result.005 file - promoters50/3593264
tgtttttctaa

SEQ ID NO: 185093 - DNA, 8 bp, Unknown
  misc_feature (1)..( 8): Result.005 file - promoters50/3593290
atttattt

SEQ ID NO: 185094 - DNA, 8 bp, Unknown
  misc_feature (1)..( 8): Result.005 file - promoters50/3593290
ttttgttt

SEQ ID NO: 185095 - DNA, 8 bp, Unknown
  misc_feature (1)..( 8): Result.005 file - promoters50/3593290
ttttgttg

SEQ ID NO: 185096 - DNA, 8 bp, Unknown
  misc_feature (1)..( 8): Result.005 file - promoters50/3593290
ctcggaat

SEQ ID NO: 185097 - DNA, 8 bp, Unknown
  misc_feature (1)..( 8): Result.005 file - promoters50/3593290
ctcagaag

SEQ ID NO: 185098 - DNA, 8 bp, Unknown
  misc_feature (1)..( 8): Result.005 file - promoters50/3593290
tccagaag

SEQ ID NO: 185099 - DNA, 15 bp, Unknown
  misc_feature (1)..( 15): Result.005 file - promoters50/3593290
gctcgttgtggccat

SEQ ID NO: 185100 - DNA, 15 bp, Unknown
  misc_feature (1)..( 15): Result.005 file - promoters50/3593290
gattgttgtgacgca

SEQ ID NO: 185101 - DNA, 15 bp, Unknown
  misc_feature (1)..( 15): Result.005 file - promoters50/3593290
gattgatgtagggta

SEQ ID NO: 185102 - DNA, 15 bp, Unknown
  misc_feature (1)..( 15): Result.005 file - promoters50/3593290
ggttattgaaattga

SEQ ID NO: 185103 - DNA, 10 bp, Unknown
  misc_feature (1)..( 10): Result.005 file - promoters50/3593290
taactttaga

SEQ ID NO: 185104 - DNA, 10 bp, Unknown
  misc_feature (1)..( 10): Result.005 file - promoters50/3593290
gagcttgaga

SEQ ID NO: 185105 - DNA, 10 bp, Unknown
  misc_feature (1)..( 10): Result.005 file - promoters50/3593290
gagattgagg

SEQ ID NO: 185106 - DNA, 8 bp, Unknown
  misc_feature (1)..( 8): Result.005 file - promoters50/3593346
aaagaaac

SEQ ID NO: 185107 - DNA, 8 bp, Unknown
  misc_feature (1)..( 8): Result.005 file - promoters50/3593346
aaacaaaa

SEQ ID NO: 185108 - DNA, 8 bp, Unknown
  misc_feature (1)..( 8): Result.005 file - promoters50/3593346
aaacaaat

SEQ ID NO: 185109 - DNA, 8 bp, Unknown
  misc_feature (1)..( 8): Result.005 file - promoters50/3593346
aaacaatt

SEQ ID NO: 185110 - DNA, 8 bp, Unknown
  misc_feature (1)..( 8): Result.005 file - promoters50/3593346
aaaaaata

SEQ ID NO: 185111 - DNA, 8 bp, Unknown
  misc_feature (1)..( 8): Result.005 file - promoters50/3593346
taacaaat

SEQ ID NO: 185112 - DNA, 8 bp, Unknown
  misc_feature (1)..( 8): Result.005 file - promoters50/3593538
aaacaaat

SEQ ID NO: 185113 - DNA, 8 bp, Unknown
  misc_feature (1)..( 8): Result.005 file - promoters50/3593538
aaacaaaa

SEQ ID NO: 185114 - DNA, 8 bp, Unknown
  misc_feature (1)..( 8): Result.005 file - promoters50/3593538
aaacaaaa

SEQ ID NO: 185115 - DNA, 10 bp, Unknown
  misc_feature (1)..( 10): Result.005 file - promoters50/3593538
agtcaataga

SEQ ID NO: 185116 - DNA, 10 bp, Unknown
  misc_feature (1)..( 10): Result.005 file - promoters50/3593538
aaacaaaaga

SEQ ID NO: 185117 - DNA, 10 bp, Unknown
  misc_feature (1)..( 10): Result.005 file - promoters50/3593538
aaacaaaaaa

SEQ ID NO: 185118 - DNA, 9 bp, Unknown
  misc_feature (1)..( 9): Result.005 file - promoters50/3593733
attaattga

SEQ ID NO: 185119 - DNA, 9 bp, Unknown
  misc_feature (1)..( 9): Result.005 file - promoters50/3593733
aataagtga

SEQ ID NO: 185120 - DNA, 9 bp, Unknown
  misc_feature (1)..( 9): Result.005 file - promoters50/3593733
aatgagtaa

SEQ ID NO: 185121 - DNA, 12 bp, Unknown
  misc_feature (1)..( 12): Result.005 file - promoters50/3593733
tagcaatcaatt

SEQ ID NO: 185122 - DNA, 12 bp, Unknown
  misc_feature (1)..( 12): Result.005 file - promoters50/3593733
acgcaaacaatt

SEQ ID NO: 185123 - DNA, 12 bp, Unknown
  misc_feature (1)..( 12): Result.005 file - promoters50/3593733
acgaaaatataa

SEQ ID NO: 185124 - DNA, 13 bp, Unknown
  misc_feature (1)..( 13): Result.005 file - promoters50/3594312
ttgtataaatcat

SEQ ID NO: 185125 - DNA, 13 bp, Unknown
  misc_feature (1)..( 13): Result.005 file - promoters50/3594312
gtttatgaatctg

SEQ ID NO: 185126 - DNA, 13 bp, Unknown
  misc_feature (1)..( 13): Result.005 file - promoters50/3594312
tcttataaagtca

SEQ ID NO: 185127 - DNA, 13 bp, Unknown
  misc_feature (1)..( 13): Result.005 file - promoters50/3594312
ttttgtaaatctt

SEQ ID NO: 185128 - DNA, 13 bp, Unknown
  misc_feature (1)..( 13): Result.005 file - promoters50/3594312
gtttctgaaacag

SEQ ID NO: 185129 - DNA, 13 bp, Unknown
  misc_feature (1)..( 13): Result.005 file - promoters50/3594312
tcctttgattctt

SEQ ID NO: 185130 - DNA, 13 bp, Unknown
  misc_feature (1)..( 13): Result.005 file - promoters50/3594312
gtatatcattctt

SEQ ID NO: 185131 - DNA, 9 bp, Unknown
  misc_feature (1)..( 9): Result.005 file - promoters50/3594312
aatcaaact

SEQ ID NO: 185132 - DNA, 9 bp, Unknown
  misc_feature (1)..( 9): Result.005 file - promoters50/3594312
aattaaaaa

SEQ ID NO: 185133 - DNA, 9 bp, Unknown
  misc_feature (1)..( 9): Result.005 file - promoters50/3594312
aatcaaata

SEQ ID NO: 185134 - DNA, 9 bp, Unknown
  misc_feature (1)..( 9): Result.005 file - promoters50/3594312
ttttaaaaa

SEQ ID NO: 185135 - DNA, 9 bp, Unknown
  misc_feature (1)..( 9): Result.005 file - promoters50/3594312
aattaatta

SEQ ID NO: 185136 - DNA, 9 bp, Unknown
  misc_feature (1)..( 9): Result.005 file - promoters50/3594312
cattaatgt

SEQ ID NO: 185137 - DNA, 11 bp, Unknown
  misc_feature (1)..( 11): Result.005 file - promoters50/3594312
catgattttgt

SEQ ID NO: 185138 - DNA, 11 bp, Unknown
  misc_feature (1)..( 11): Result.005 file - promoters50/3594312
catgatttaaa

SEQ ID NO: 185139 - DNA, 11 bp, Unknown
  misc_feature (1)..( 11): Result.005 file - promoters50/3594312
aaagatttttc

SEQ ID NO: 185140 - DNA, 11 bp, Unknown
  misc_feature (1)..( 11): Result.005 file - promoters50/3594312
attgattcaaa

SEQ ID NO: 185141 - DNA, 11 bp, Unknown
  misc_feature (1)..( 11): Result.005 file - promoters50/3594312
atacatttttt

SEQ ID NO: 185142 - DNA, 11 bp, Unknown
  misc_feature (1)..( 11): Result.005 file - promoters50/3594312
ctgaattttta

SEQ ID NO: 185143 - DNA, 9 bp, Unknown
  misc_feature (1)..( 9): Result.005 file - promoters50/3594312
gattttgtg

SEQ ID NO: 185144 - DNA, 9 bp, Unknown
  misc_feature (1)..( 9): Result.005 file - promoters50/3594312
tattatgtt

SEQ ID NO: 185145 - DNA, 9 bp, Unknown
  misc_feature (1)..( 9): Result.005 file - promoters50/3594312
acttttgtg

SEQ ID NO: 185146 - DNA, 9 bp, Unknown
  misc_feature (1)..( 9): Result.005 file - promoters50/3594312
gatttttct

SEQ ID NO: 185147 - DNA, 9 bp, Unknown
  misc_feature (1)..( 9): Result.005 file - promoters50/3594312
cattttttt

SEQ ID NO: 185148 - DNA, 9 bp, Unknown
  misc_feature (1)..( 9): Result.005 file - promoters50/3594312
aatttttat

SEQ ID NO: 185149 - DNA, 11 bp, Unknown
  misc_feature (1)..( 11): Result.005 file - promoters50/3594312
gtaaaattaaa

SEQ ID NO: 185150 - DNA, 11 bp, Unknown
  misc_feature (1)..( 11): Result.005 file - promoters50/3594312
gtataattttt

SEQ ID NO: 185151 - DNA, 11 bp, Unknown
  misc_feature (1)..( 11): Result.005 file - promoters50/3594312
aagaaatgaaa

SEQ ID NO: 185152 - DNA, 11 bp, Unknown
  misc_feature (1)..( 11): Result.005 file - promoters50/3594312
gtggaatattg

SEQ ID NO: 185153 - DNA, 11 bp, Unknown
  misc_feature (1)..( 11): Result.005 file - promoters50/3594312
aatgaatatat

SEQ ID NO: 185154 - DNA, 11 bp, Unknown
  misc_feature (1)..( 11): Result.005 file - promoters50/3594312
taatagtttaa

SEQ ID NO: 185155 - DNA, 9 bp, Unknown
  misc_feature (1)..( 9): Result.005 file - promoters50/3594312
agaaaaaat

SEQ ID NO: 185156 - DNA, 9 bp, Unknown
  misc_feature (1)..( 9): Result.005 file - promoters50/3594312
tttaaaaat

SEQ ID NO: 185157 - DNA, 9 bp, Unknown
  misc_feature (1)..( 9): Result.005 file - promoters50/3594312
tgcaaaaaa

SEQ ID NO: 185158 - DNA, 9 bp, Unknown
  misc_feature (1)..( 9): Result.005 file - promoters50/3594312
tgcaaaaac

SEQ ID NO: 185159 - DNA, 9 bp, Unknown
  misc_feature (1)..( 9): Result.005 file - promoters50/3594312
accaaaaaa

SEQ ID NO: 185160 - DNA, 9 bp, Unknown
  misc_feature (1)..( 9): Result.005 file - promoters50/3594312
aataaaaaa

SEQ ID NO: 185161 - DNA, 15 bp, Unknown
  misc_feature (1)..( 15): Result.005 file - promoters50/3594312
attgaagactataaa

SEQ ID NO: 185162 - DNA, 15 bp, Unknown
  misc_feature (1)..( 15): Result.005 file - promoters50/3594312
attaaagctccaata

SEQ ID NO: 185163 - DNA, 15 bp, Unknown
  misc_feature (1)..( 15): Result.005 file - promoters50/3594312
attaaaaatgctttt

SEQ ID NO: 185164 - DNA, 15 bp, Unknown
  misc_feature (1)..( 15): Result.005 file - promoters50/3594312
tttaaaaagcataaa

SEQ ID NO: 185165 - DNA, 15 bp, Unknown
  misc_feature (1)..( 15): Result.005 file - promoters50/3594312
aataaaaaaactgtt

SEQ ID NO: 185166 - DNA, 15 bp, Unknown
  misc_feature (1)..( 15): Result.005 file - promoters50/3594312
ccaaaaaaaaaaaaa

SEQ ID NO: 185167 - DNA, 15 bp, Unknown
  misc_feature (1)..( 15): Result.005 file - promoters50/3594312
tttaaaaattgttta

SEQ ID NO: 185168 - DNA, 11 bp, Unknown
  misc_feature (1)..( 11): Result.005 file - promoters50/3594312
ttctaaattac

SEQ ID NO: 185169 - DNA, 11 bp, Unknown
  misc_feature (1)..( 11): Result.005 file - promoters50/3594312
ttctatatttt

SEQ ID NO: 185170 - DNA, 12 bp, Unknown
  misc_feature (1)..( 12): Result.005 file - promoters50/3594312
tcaaatactttt

SEQ ID NO: 185171 - DNA, 12 bp, Unknown
  misc_feature (1)..( 12): Result.005 file - promoters50/3594312
aaaaaaacttta

SEQ ID NO: 185172 - DNA, 12 bp, Unknown
  misc_feature (1)..( 12): Result.005 file - promoters50/3594312
aaaaatgcttgt

SEQ ID NO: 185173 - DNA, 12 bp, Unknown
  misc_feature (1)..( 12): Result.005 file - promoters50/3594312
ataaaaaataaa

SEQ ID NO: 185174 - DNA, 10 bp, Unknown
  misc_feature (1)..( 10): Result.005 file - promoters50/3594312
aattactttc

SEQ ID NO: 185175 - DNA, 10 bp, Unknown
  misc_feature (1)..( 10): Result.005 file - promoters50/3594312
aaatactttt

SEQ ID NO: 185176 - DNA, 10 bp, Unknown
  misc_feature (1)..( 10): Result.005 file - promoters50/3594312
ctatattttt

SEQ ID NO: 185177 - DNA, 10 bp, Unknown
  misc_feature (1)..( 10): Result.005 file - promoters50/3594312
aaaaacttta

SEQ ID NO: 185178 - DNA, 10 bp, Unknown
  misc_feature (1)..( 10): Result.005 file - promoters50/3594312
aaatgcttgt

SEQ ID NO: 185179 - DNA, 10 bp, Unknown
  misc_feature (1)..( 10): Result.005 file - promoters50/3594312
aaaaaataaa

SEQ ID NO: 185180 - DNA, 10 bp, Unknown
  misc_feature (1)..( 10): Result.005 file - promoters50/3597145
cgaggaccac

SEQ ID NO: 185181 - DNA, 10 bp, Unknown
  misc_feature (1)..( 10): Result.005 file - promoters50/3597145
cgaagacgaa

SEQ ID NO: 185182 - DNA, 10 bp, Unknown
  misc_feature (1)..( 10): Result.005 file - promoters50/3597145
tgaagaagaa

SEQ ID NO: 185183 - DNA, 10 bp, Unknown
  misc_feature (1)..( 10): Result.005 file - promoters50/3597145
ggaagacaca

SEQ ID NO: 185184 - DNA, 10 bp, Unknown
  misc_feature (1)..( 10): Result.005 file - promoters50/3597145
cgaagaggaa

SEQ ID NO: 185185 - DNA, 10 bp, Unknown
  misc_feature (1)..( 10): Result.005 file - promoters50/3597145
agaagaaaac

SEQ ID NO: 185186 - DNA, 13 bp, Unknown
  misc_feature (1)..( 13): Result.005 file - promoters50/3597145
tgattttaacact

SEQ ID NO: 185187 - DNA, 13 bp, Unknown
  misc_feature (1)..( 13): Result.005 file - promoters50/3597145
atattataaaaaa

SEQ ID NO: 185188 - DNA, 13 bp, Unknown
  misc_feature (1)..( 13): Result.005 file - promoters50/3597145
cacttataagaga

SEQ ID NO: 185189 - DNA, 13 bp, Unknown
  misc_feature (1)..( 13): Result.005 file - promoters50/3597145
aactaatagccag

SEQ ID NO: 185190 - DNA, 13 bp, Unknown
  misc_feature (1)..( 13): Result.005 file - promoters50/3597145
atatgataatggt

SEQ ID NO: 185191 - DNA, 13 bp, Unknown
  misc_feature (1)..( 13): Result.005 file - promoters50/3597145
aacaaacaaattt

SEQ ID NO: 185192 - DNA, 13 bp, Unknown
  misc_feature (1)..( 13): Result.005 file - promoters50/3597145
gttcgccaaccaa

SEQ ID NO: 185193 - DNA, 13 bp, Unknown
  misc_feature (1)..( 13): Result.005 file - promoters50/3597145
gaaaaagttcaaa

SEQ ID NO: 185194 - DNA, 13 bp, Unknown
  misc_feature (1)..( 13): Result.005 file - promoters50/3597145
taaaaagccaaaa

SEQ ID NO: 185195 - DNA, 13 bp, Unknown
  misc_feature (1)..( 13): Result.005 file - promoters50/3597145
caaatagttcgcc

SEQ ID NO: 185196 - DNA, 13 bp, Unknown
  misc_feature (1)..( 13): Result.005 file - promoters50/3597145
taaaaaaactgtt

SEQ ID NO: 185197 - DNA, 13 bp, Unknown
  misc_feature (1)..( 13): Result.005 file - promoters50/3597145
tttatatttcgca

SEQ ID NO: 185198 - DNA, 13 bp, Unknown
  misc_feature (1)..( 13): Result.005 file - promoters50/3597145
tctgagcttcgca

SEQ ID NO: 185199 - DNA, 13 bp, Unknown
  misc_feature (1)..( 13): Result.005 file - promoters50/3597145
acaagatccgtaa

SEQ ID NO: 185200 - DNA, 13 bp, Unknown
  misc_feature (1)..( 13): Result.005 file - promoters50/3597145
ttttcttccataa

SEQ ID NO: 185201 - DNA, 13 bp, Unknown
  misc_feature (1)..( 13): Result.005 file - promoters50/3597145
tgattttctatat

SEQ ID NO: 185202 - DNA, 13 bp, Unknown
  misc_feature (1)..( 13): Result.005 file - promoters50/3597145
caactttcaataa

SEQ ID NO: 185203 - DNA, 13 bp, Unknown
  misc_feature (1)..( 13): Result.005 file - promoters50/3597145
ttttgttccattt

SEQ ID NO: 185204 - DNA, 13 bp, Unknown
  misc_feature (1)..( 13): Result.005 file - promoters50/3597145
tttggtttagtga

SEQ ID NO: 185205 - DNA, 8 bp, Unknown
  misc_feature (1)..( 8): Result.005 file - promoters50/3597158
acacttag

SEQ ID NO: 185206 - DNA, 8 bp, Unknown
  misc_feature (1)..( 8): Result.005 file - promoters50/3597158
tcacatag

SEQ ID NO: 185207 - DNA, 8 bp, Unknown
  misc_feature (1)..( 8): Result.005 file - promoters50/3597158
tcacatca

SEQ ID NO: 185208 - DNA, 10 bp, Unknown
  misc_feature (1)..( 10): Result.005 file - promoters50/3597158
tttcaaaagt

SEQ ID NO: 185209 - DNA, 10 bp, Unknown
  misc_feature (1)..( 10): Result.005 file - promoters50/3597158
tttccaaagc

SEQ ID NO: 185210 - DNA, 10 bp, Unknown
  misc_feature (1)..( 10): Result.005 file - promoters50/3597158
ccaacaaagc

SEQ ID NO: 185211 - DNA, 12 bp, Unknown
  misc_feature (1)..( 12): Result.005 file - promoters50/3597158
attcagtttcac

SEQ ID NO: 185212 - DNA, 12 bp, Unknown
  misc_feature (1)..( 12): Result.005 file - promoters50/3597158
tcatagttccac

SEQ ID NO: 185213 - DNA, 12 bp, Unknown
  misc_feature (1)..( 12): Result.005 file - promoters50/3597158
attcactttcat

SEQ ID NO: 185214 - DNA, 10 bp, Unknown
  misc_feature (1)..( 10): Result.005 file - promoters50/3597158
aaaagaaaaa

SEQ ID NO: 185215 - DNA, 10 bp, Unknown
  misc_feature (1)..( 10): Result.005 file - promoters50/3597158
caaagcaaaa

SEQ ID NO: 185216 - DNA, 10 bp, Unknown
  misc_feature (1)..( 10): Result.005 file - promoters50/3597158
caaagctttt

SEQ ID NO: 185217 - DNA, 7 bp, Unknown
  misc_feature (1)..( 7): Result.005 file - promoters50/3597162
tgacttt

SEQ ID NO: 185218 - DNA, 7 bp, Unknown
  misc_feature (1)..( 7): Result.005 file - promoters50/3597162
tgacttg

SEQ ID NO: 185219 - DNA, 7 bp, Unknown
  misc_feature (1)..( 7): Result.005 file - promoters50/3597162
tgaattg

SEQ ID NO: 185220 - DNA, 8 bp, Unknown
  misc_feature (1)..( 8): Result.005 file - promoters50/3597162
agaaaaaa

SEQ ID NO: 185221 - DNA, 8 bp, Unknown
  misc_feature (1)..( 8): Result.005 file - promoters50/3597162
agataaaa

SEQ ID NO: 185222 - DNA, 8 bp, Unknown
  misc_feature (1)..( 8): Result.005 file - promoters50/3597162
agataaat

SEQ ID NO: 185223 - DNA, 7 bp, Unknown
  misc_feature (1)..( 7): Result.005 file - promoters50/3597162
aatagat

SEQ ID NO: 185224 - DNA, 7 bp, Unknown
  misc_feature (1)..( 7): Result.005 file - promoters50/3597162
aattgat

SEQ ID NO: 185225 - DNA, 7 bp, Unknown
  misc_feature (1)..( 7): Result.005 file - promoters50/3597162
aatagaa

SEQ ID NO: 185226 - DNA, 13 bp, Unknown
  misc_feature (1)..( 13): Result.005 file - promoters50/3597162
tctatataaatcc

SEQ ID NO: 185227 - DNA, 13 bp, Unknown
  misc_feature (1)..( 13): Result.005 file - promoters50/3597162
taaatagaaaacg

SEQ ID NO: 185228 - DNA, 13 bp, Unknown
  misc_feature (1)..( 13): Result.005 file - promoters50/3597162
tctatatatatcc

SEQ ID NO: 185229 - DNA, 9 bp, Unknown
  misc_feature (1)..( 9): Result.005 file - promoters50/3597162
ttaaaattg

SEQ ID NO: 185230 - DNA, 9 bp, Unknown
  misc_feature (1)..( 9): Result.005 file - promoters50/3597162
ttagaatag

SEQ ID NO: 185231 - DNA, 9 bp, Unknown
  misc_feature (1)..( 9): Result.005 file - promoters50/3597162
gaaaaatgg

SEQ ID NO: 185232 - DNA, 9 bp, Unknown
  misc_feature (1)..( 9): Result.005 file - promoters50/3597162
ttcaataga

SEQ ID NO: 185233 - DNA, 9 bp, Unknown
  misc_feature (1)..( 9): Result.005 file - promoters50/3597162
ttcaattta

SEQ ID NO: 185234 - DNA, 9 bp, Unknown
  misc_feature (1)..( 9): Result.005 file - promoters50/3597162
ctcatttta

SEQ ID NO: 185235 - DNA, 9 bp, Unknown
  misc_feature (1)..( 9): Result.005 file - promoters50/3597162
tgtatttta

SEQ ID NO: 185236 - DNA, 9 bp, Unknown
  misc_feature (1)..( 9): Result.005 file - promoters50/3597162
ttttatttt

SEQ ID NO: 185237 - DNA, 9 bp, Unknown
  misc_feature (1)..( 9): Result.005 file - promoters50/3597162
ttttttttt

SEQ ID NO: 185238 - DNA, 9 bp, Unknown
  misc_feature (1)..( 9): Result.005 file - promoters50/3597162
atttatttg

SEQ ID NO: 185239 - DNA, 11 bp, Unknown
  misc_feature (1)..( 11): Result.005 file - promoters50/3597162
actttcaattc

SEQ ID NO: 185240 - DNA, 11 bp, Unknown
  misc_feature (1)..( 11): Result.005 file - promoters50/3597162
aatttgaattg

SEQ ID NO: 185241 - DNA, 11 bp, Unknown
  misc_feature (1)..( 11): Result.005 file - promoters50/3597162
attatgacttg

SEQ ID NO: 185242 - DNA, 11 bp, Unknown
  misc_feature (1)..( 11): Result.005 file - promoters50/3597162
aatatgagata

SEQ ID NO: 185243 - DNA, 13 bp, Unknown
  misc_feature (1)..( 13): Result.005 file - promoters50/3597162
gtttaaacttaaa

SEQ ID NO: 185244 - DNA, 13 bp, Unknown
  misc_feature (1)..( 13): Result.005 file - promoters50/3597162
aaataaacttaat

SEQ ID NO: 185245 - DNA, 13 bp, Unknown
  misc_feature (1)..( 13): Result.005 file - promoters50/3597162
gttaaaaattaaa

SEQ ID NO: 185246 - DNA, 9 bp, Unknown
  misc_feature (1)..( 9): Result.005 file - promoters50/3597162
tgataaaat

SEQ ID NO: 185247 - DNA, 9 bp, Unknown
  misc_feature (1)..( 9): Result.005 file - promoters50/3597162
aaataaaaa

SEQ ID NO: 185248 - DNA, 9 bp, Unknown
  misc_feature (1)..( 9): Result.005 file - promoters50/3597162
aaagaaaat

SEQ ID NO: 185249 - DNA, 9 bp, Unknown
  misc_feature (1)..( 9): Result.005 file - promoters50/3597162
agttaaaaa

SEQ ID NO: 185250 - DNA, 10 bp, Unknown
  misc_feature (1)..( 10): Result.005 file - promoters50/3597162
aaagaaaatt

SEQ ID NO: 185251 - DNA, 10 bp, Unknown
  misc_feature (1)..( 10): Result.005 file - promoters50/3597162
atagaaaatt

SEQ ID NO: 185252 - DNA, 10 bp, Unknown
  misc_feature (1)..( 10): Result.005 file - promoters50/3597162
aaataaaaaa

SEQ ID NO: 185253 - DNA, 14 bp, Unknown
  misc_feature (1)..( 14): Result.005 file - promoters50/3597175
cgccaaaaaaaata

SEQ ID NO: 185254 - DNA, 14 bp, Unknown
  misc_feature (1)..( 14): Result.005 file - promoters50/3597175
acccaaaattgacc

SEQ ID NO: 185255 - DNA, 14 bp, Unknown
  misc_feature (1)..( 14): Result.005 file - promoters50/3597175
aaccaaaaataata

SEQ ID NO: 185256 - DNA, 14 bp, Unknown
  misc_feature (1)..( 14): Result.005 file - promoters50/3597175
aactaaacactgga

SEQ ID NO: 185257 - DNA, 14 bp, Unknown
  misc_feature (1)..( 14): Result.005 file - promoters50/3597175
aactatacaaagag

SEQ ID NO: 185258 - DNA, 14 bp, Unknown
  misc_feature (1)..( 14): Result.005 file - promoters50/3597175
ttcgaaataaatga

SEQ ID NO: 185259 - DNA, 16 bp, Unknown
  misc_feature (1)..( 16): Result.005 file - promoters50/3597175
attattttttactcgt

SEQ ID NO: 185260 - DNA, 16 bp, Unknown
  misc_feature (1)..( 16): Result.005 file - promoters50/3597175
attcttttccatccac

SEQ ID NO: 185261 - DNA, 16 bp, Unknown
  misc_feature (1)..( 16): Result.005 file - promoters50/3597175
tttcatttatttacaa

SEQ ID NO: 185262 - DNA, 16 bp, Unknown
  misc_feature (1)..( 16): Result.005 file - promoters50/3597175
gtaattttattataaa

SEQ ID NO: 185263 - DNA, 16 bp, Unknown
  misc_feature (1)..( 16): Result.005 file - promoters50/3597175
acttttttgttagaaa

SEQ ID NO: 185264 - DNA, 16 bp, Unknown
  misc_feature (1)..( 16): Result.005 file - promoters50/3597175
ttaaatttaaaaattc

SEQ ID NO: 185265 - DNA, 16 bp, Unknown
  misc_feature (1)..( 16): Result.005 file - promoters50/3597175
gttattaattagtctt

SEQ ID NO: 185266 - DNA, 11 bp, Unknown
  misc_feature (1)..( 11): Result.005 file - promoters50/3597175
tttaattaaaa

SEQ ID NO: 185267 - DNA, 11 bp, Unknown
  misc_feature (1)..( 11): Result.005 file - promoters50/3597175
cctaattaacc

SEQ ID NO: 185268 - DNA, 11 bp, Unknown
  misc_feature (1)..( 11): Result.005 file - promoters50/3597175
gagaattaaaa

SEQ ID NO: 185269 - DNA, 11 bp, Unknown
  misc_feature (1)..( 11): Result.005 file - promoters50/3597175
tctaattactg

SEQ ID NO: 185270 - DNA, 11 bp, Unknown
  misc_feature (1)..( 11): Result.005 file - promoters50/3597175
tttaattttcg

SEQ ID NO: 185271 - DNA, 11 bp, Unknown
  misc_feature (1)..( 11): Result.005 file - promoters50/3597175
atgaattacca

SEQ ID NO: 185272 - DNA, 12 bp, Unknown
  misc_feature (1)..( 12): Result.005 file - promoters50/3597175
tctcatatataa

SEQ ID NO: 185273 - DNA, 12 bp, Unknown
  misc_feature (1)..( 12): Result.005 file - promoters50/3597175
tataataaatac

SEQ ID NO: 185274 - DNA, 12 bp, Unknown
  misc_feature (1)..( 12): Result.005 file - promoters50/3597175
tcttatatattc

SEQ ID NO: 185275 - DNA, 12 bp, Unknown
  misc_feature (1)..( 12): Result.005 file - promoters50/3597175
aaatataaataa

SEQ ID NO: 185276 - DNA, 12 bp, Unknown
  misc_feature (1)..( 12): Result.005 file - promoters50/3597175
gcctttaaaaaa

SEQ ID NO: 185277 - DNA, 12 bp, Unknown
  misc_feature (1)..( 12): Result.005 file - promoters50/3597175
ctatttaagtaa

SEQ ID NO: 185278 - DNA, 10 bp, Unknown
  misc_feature (1)..( 10): Result.005 file - promoters50/3597175
acataaatct

SEQ ID NO: 185279 - DNA, 10 bp, Unknown
  misc_feature (1)..( 10): Result.005 file - promoters50/3597175
tcataaattt

SEQ ID NO: 185280 - DNA, 10 bp, Unknown
  misc_feature (1)..( 10): Result.005 file - promoters50/3597175
aaataaatcg

SEQ ID NO: 185281 - DNA, 10 bp, Unknown
  misc_feature (1)..( 10): Result.005 file - promoters50/3597175
aaataaacta

SEQ ID NO: 185282 - DNA, 10 bp, Unknown
  misc_feature (1)..( 10): Result.005 file - promoters50/3597175
taatgaacca

SEQ ID NO: 185283 - DNA, 10 bp, Unknown
  misc_feature (1)..( 10): Result.005 file - promoters50/3597175
taataagttt

SEQ ID NO: 185284 - DNA, 11 bp, Unknown
  misc_feature (1)..( 11): Result.005 file - promoters50/3597175
ccaaaattgac

SEQ ID NO: 185285 - DNA, 11 bp, Unknown
  misc_feature (1)..( 11): Result.005 file - promoters50/3597175
ataaatttgtc

SEQ ID NO: 185286 - DNA, 11 bp, Unknown
  misc_feature (1)..( 11): Result.005 file - promoters50/3597175
gtaaaattttt

SEQ ID NO: 185287 - DNA, 11 bp, Unknown
  misc_feature (1)..( 11): Result.005 file - promoters50/3597175
ggaaactttat

SEQ ID NO: 185288 - DNA, 11 bp, Unknown
  misc_feature (1)..( 11): Result.005 file - promoters50/3597175
ataagtttata

SEQ ID NO: 185289 - DNA, 11 bp, Unknown
  misc_feature (1)..( 11): Result.005 file - promoters50/3597175
gtgaattagtt

SEQ ID NO: 185290 - DNA, 11 bp, Unknown
  misc_feature (1)..( 11): Result.005 file - promoters50/3597175
ttatgaaaaca

SEQ ID NO: 185291 - DNA, 11 bp, Unknown
  misc_feature (1)..( 11): Result.005 file - promoters50/3597175
ttaagaagagt

SEQ ID NO: 185292 - DNA, 11 bp, Unknown
  misc_feature (1)..( 11): Result.005 file - promoters50/3597175
ataataagttt

SEQ ID NO: 185293 - DNA, 11 bp, Unknown
  misc_feature (1)..( 11): Result.005 file - promoters50/3597175
gtcataaattt

SEQ ID NO: 185294 - DNA, 11 bp, Unknown
  misc_feature (1)..( 11): Result.005 file - promoters50/3597175
tgaattagtta

SEQ ID NO: 185295 - DNA, 11 bp, Unknown
  misc_feature (1)..( 11): Result.005 file - promoters50/3597175
ttcacaaaaga

SEQ ID NO: 185296 - DNA, 8 bp, Unknown
  misc_feature (1)..( 8): Result.005 file - promoters50/3598435
gctgctga

SEQ ID NO: 185297 - DNA, 8 bp, Unknown
  misc_feature (1)..( 8): Result.005 file - promoters50/3598435
cttgctga

SEQ ID NO: 185298 - DNA, 8 bp, Unknown
  misc_feature (1)..( 8): Result.005 file - promoters50/3598435
cttcctgg

SEQ ID NO: 185299 - DNA, 12 bp, Unknown
  misc_feature (1)..( 12): Result.005 file - promoters50/3598435
tctatggtgtta

SEQ ID NO: 185300 - DNA, 12 bp, Unknown
  misc_feature (1)..( 12): Result.005 file - promoters50/3598435
tctttggttgtg

SEQ ID NO: 185301 - DNA, 12 bp, Unknown
  misc_feature (1)..( 12): Result.005 file - promoters50/3598435
aatttgcttgtg

SEQ ID NO: 185302 - DNA, 8 bp, Unknown
  misc_feature (1)..( 8): Result.005 file - promoters50/3598610
gttgcatt

SEQ ID NO: 185303 - DNA, 8 bp, Unknown
  misc_feature (1)..( 8): Result.005 file - promoters50/3598610
attggatt

SEQ ID NO: 185304 - DNA, 8 bp, Unknown
  misc_feature (1)..( 8): Result.005 file - promoters50/3598610
attggatc

SEQ ID NO: 185305 - DNA, 6 bp, Unknown
  misc_feature (1)..( 6): Result.005 file - promoters50/3600084
tccaaa

SEQ ID NO: 185306 - DNA, 6 bp, Unknown
  misc_feature (1)..( 6): Result.005 file - promoters50/3600084
tccaaa

SEQ ID NO: 185307 - DNA, 7 bp, Unknown
  misc_feature (1)..( 7): Result.005 file - promoters50/3600084
tcctaaa

SEQ ID NO: 185308 - DNA, 7 bp, Unknown
  misc_feature (1)..( 7): Result.005 file - promoters50/3600084
ttacaaa

SEQ ID NO: 185309 - DNA, 7 bp, Unknown
  misc_feature (1)..( 7): Result.005 file - promoters50/3600084
ttaaaaa

SEQ ID NO: 185310 - DNA, 7 bp, Unknown
  misc_feature (1)..( 7): Result.005 file - promoters50/3600084
ctaaaaa

SEQ ID NO: 185311 - DNA, 10 bp, Unknown
  misc_feature (1)..( 10): Result.005 file - promoters50/3611292
aaacataaaa

SEQ ID NO: 185312 - DNA, 10 bp, Unknown
  misc_feature (1)..( 10): Result.005 file - promoters50/3611292
ttacaaaaaa

SEQ ID NO: 185313 - DNA, 10 bp, Unknown
  misc_feature (1)..( 10): Result.005 file - promoters50/3611292
ttactaaaag

SEQ ID NO: 185314 - DNA, 10 bp, Unknown
  misc_feature (1)..( 10): Result.005 file - promoters50/3611292
gaactaaact

SEQ ID NO: 185315 - DNA, 10 bp, Unknown
  misc_feature (1)..( 10): Result.005 file - promoters50/3611292
ttactaaggt

SEQ ID NO: 185316 - DNA, 10 bp, Unknown
  misc_feature (1)..( 10): Result.005 file - promoters50/3611292
aaactaagct

SEQ ID NO: 185317 - DNA, 11 bp, Unknown
  misc_feature (1)..( 11): Result.005 file - promoters50/3611292
ttaaaatcatc

SEQ ID NO: 185318 - DNA, 11 bp, Unknown
  misc_feature (1)..( 11): Result.005 file - promoters50/3611292
ataaaatttca

SEQ ID NO: 185319 - DNA, 11 bp, Unknown
  misc_feature (1)..( 11): Result.005 file - promoters50/3611292
ttaaaagtaaa

SEQ ID NO: 185320 - DNA, 11 bp, Unknown
  misc_feature (1)..( 11): Result.005 file - promoters50/3611292
ataaaatacaa

SEQ ID NO: 185321 - DNA, 11 bp, Unknown
  misc_feature (1)..( 11): Result.005 file - promoters50/3611292
atataatcaag

SEQ ID NO: 185322 - DNA, 11 bp, Unknown
  misc_feature (1)..( 11): Result.005 file - promoters50/3611292
ataacagttgt

SEQ ID NO: 185323 - DNA, 11 bp, Unknown
  misc_feature (1)..( 11): Result.005 file - promoters50/3611292
tcaaactttca

SEQ ID NO: 185324 - DNA, 13 bp, Unknown
  misc_feature (1)..( 13): Result.005 file - promoters50/3611292
ccaagaaattcat

SEQ ID NO: 185325 - DNA, 13 bp, Unknown
  misc_feature (1)..( 13): Result.005 file - promoters50/3611292
gcaaaaaaatcaa

SEQ ID NO: 185326 - DNA, 13 bp, Unknown
  misc_feature (1)..( 13): Result.005 file - promoters50/3611292
aaaaaaaggaaaa

SEQ ID NO: 185327 - DNA, 13 bp, Unknown
  misc_feature (1)..( 13): Result.005 file - promoters50/3611292
ggaaaaaagaaat

SEQ ID NO: 185328 - DNA, 13 bp, Unknown
  misc_feature (1)..( 13): Result.005 file - promoters50/3611292
tcaaaaaattatt

SEQ ID NO: 185329 - DNA, 14 bp, Unknown
  misc_feature (1)..( 14): Result.005 file - promoters50/3611292
ttaaacaaacgaca

SEQ ID NO: 185330 - DNA, 14 bp, Unknown
  misc_feature (1)..( 14): Result.005 file - promoters50/3611292
ggtgataaatattc

SEQ ID NO: 185331 - DNA, 8 bp, Unknown
  misc_feature (1)..( 8): Result.005 file - promoters50/3629913
tactgaat

SEQ ID NO: 185332 - DNA, 8 bp, Unknown
  misc_feature (1)..( 8): Result.005 file - promoters50/3629913
tacagaat

SEQ ID NO: 185333 - DNA, 8 bp, Unknown
  misc_feature (1)..( 8): Result.005 file - promoters50/3629913
aactgaag

SEQ ID NO: 185334 - DNA, 7 bp, Unknown
  misc_feature (1)..( 7): Result.005 file - promoters50/3629913
caaatgt

SEQ ID NO: 185335 - DNA, 7 bp, Unknown
  misc_feature (1)..( 7): Result.005 file - promoters50/3629913
caaatgc

SEQ ID NO: 185336 - DNA, 7 bp, Unknown
  misc_feature (1)..( 7): Result.005 file - promoters50/3629913
aaaatgt

SEQ ID NO: 185337 - DNA, 11 bp, Unknown
  misc_feature (1)..( 11): Result.005 file - promoters50/3631200
agaagatggct

SEQ ID NO: 185338 - DNA, 11 bp, Unknown
  misc_feature (1)..( 11): Result.005 file - promoters50/3631200
agaatatgata

SEQ ID NO: 185339 - DNA, 11 bp, Unknown
  misc_feature (1)..( 11): Result.005 file - promoters50/3631200
ctaatctgata

SEQ ID NO: 185340 - DNA, 8 bp, Unknown
  misc_feature (1)..( 8): Result.005 file - promoters50/3631200
aagctata

SEQ ID NO: 185341 - DNA, 8 bp, Unknown
  misc_feature (1)..( 8): Result.005 file - promoters50/3631200
tagctata

SEQ ID NO: 185342 - DNA, 8 bp, Unknown
  misc_feature (1)..( 8): Result.005 file - promoters50/3631200
aagctaga

SEQ ID NO: 185343 - DNA, 9 bp, Unknown
  misc_feature (1)..( 9): Result.005 file - promoters50/3631200
cttagattg

SEQ ID NO: 185344 - DNA, 9 bp, Unknown
  misc_feature (1)..( 9): Result.005 file - promoters50/3631200
ctttgatga

SEQ ID NO: 185345 - DNA, 9 bp, Unknown
  misc_feature (1)..( 9): Result.005 file - promoters50/3631200
cttacattg

SEQ ID NO: 185346 - DNA, 8 bp, Unknown
  misc_feature (1)..( 8): Result.005 file - promoters50/3659211
ataaatta

SEQ ID NO: 185347 - DNA, 8 bp, Unknown
  misc_feature (1)..( 8): Result.005 file - promoters50/3659211
ataaatag

SEQ ID NO: 185348 - DNA, 8 bp, Unknown
  misc_feature (1)..( 8): Result.005 file - promoters50/3659211
ataaatta

SEQ ID NO: 185349 - DNA, 11 bp, Unknown
  misc_feature (1)..( 11): Result.005 file - promoters50/4254292
attaattaaat

SEQ ID NO: 185350 - DNA, 11 bp, Unknown
  misc_feature (1)..( 11): Result.005 file - promoters50/4254292
gaggattaaag

SEQ ID NO: 185351 - DNA, 11 bp, Unknown
  misc_feature (1)..( 11): Result.005 file - promoters50/4254292
actaattaatg

SEQ ID NO: 185352 - DNA, 11 bp, Unknown
  misc_feature (1)..( 11): Result.005 file - promoters50/4254292
aacaattaagt

SEQ ID NO: 185353 - DNA, 11 bp, Unknown
  misc_feature (1)..( 11): Result.005 file - promoters50/4254292
gccgatgaaag

SEQ ID NO: 185354 - DNA, 11 bp, Unknown
  misc_feature (1)..( 11): Result.005 file - promoters50/4254292
actgatttttc

SEQ ID NO: 185355 - DNA, 12 bp, Unknown
  misc_feature (1)..( 12): Result.005 file - promoters50/4254292
tttttatttttt

SEQ ID NO: 185356 - DNA, 12 bp, Unknown
  misc_feature (1)..( 12): Result.005 file - promoters50/4254292
ctttgattagca

SEQ ID NO: 185357 - DNA, 13 bp, Unknown
  misc_feature (1)..( 13): Result.005 file - promoters50/4254292
ccattactttact

SEQ ID NO: 185358 - DNA, 13 bp, Unknown
  misc_feature (1)..( 13): Result.005 file - promoters50/4254292
tttttagtttgtg

SEQ ID NO: 185359 - DNA, 14 bp, Unknown
  misc_feature (1)..( 14): Result.005 file - promoters50/4254292
aatttatattttta

SEQ ID NO: 185360 - DNA, 14 bp, Unknown
  misc_feature (1)..( 14): Result.005 file - promoters50/4254292
ccaacaactataca

SEQ ID NO: 185361 - DNA, 14 bp, Unknown
  misc_feature (1)..( 14): Result.005 file - promoters50/4254292
tcacaacattgctt

SEQ ID NO: 185362 - DNA, 9 bp, Unknown
  misc_feature (1)..( 9): Result.005 file - promoters50/4254292
ctaaaagcg

SEQ ID NO: 185363 - DNA, 9 bp, Unknown
  misc_feature (1)..( 9): Result.005 file - promoters50/4254292
ctaaaaaaa

SEQ ID NO: 185364 - DNA, 9 bp, Unknown
  misc_feature (1)..( 9): Result.005 file - promoters50/4254292
ttaaaaaag

SEQ ID NO: 185365 - DNA, 9 bp, Unknown
  misc_feature (1)..( 9): Result.005 file - promoters50/4254292
ataagaaat

SEQ ID NO: 185366 - DNA, 9 bp, Unknown
  misc_feature (1)..( 9): Result.005 file - promoters50/4254292
acaaaaaga

SEQ ID NO: 185367 - DNA, 9 bp, Unknown
  misc_feature (1)..( 9): Result.005 file - promoters50/4254292
tcaagaaaa

SEQ ID NO: 185368 - DNA, 12 bp, Unknown
  misc_feature (1)..( 12): Result.005 file - promoters50/4254299
attttttttctt

SEQ ID NO: 185369 - DNA, 12 bp, Unknown
  misc_feature (1)..( 12): Result.005 file - promoters50/4254299
tttttctttctt

SEQ ID NO: 185370 - DNA, 12 bp, Unknown
  misc_feature (1)..( 12): Result.005 file - promoters50/4254299
atttttacattg

SEQ ID NO: 185371 - DNA, 12 bp, Unknown
  misc_feature (1)..( 12): Result.005 file - promoters50/4254299
cttttctcgagg

SEQ ID NO: 185372 - DNA, 10 bp, Unknown
  misc_feature (1)..( 10): Result.005 file - promoters50/4254299
ttaatttgaa

SEQ ID NO: 185373 - DNA, 10 bp, Unknown
  misc_feature (1)..( 10): Result.005 file - promoters50/4254299
ctaatttaac

SEQ ID NO: 185374 - DNA, 10 bp, Unknown
  misc_feature (1)..( 10): Result.005 file - promoters50/4254299
ttaatttttc

SEQ ID NO: 185375 - DNA, 10 bp, Unknown
  misc_feature (1)..( 10): Result.005 file - promoters50/4254299
ttaacttaac

SEQ ID NO: 185376 - DNA, 12 bp, Unknown
  misc_feature (1)..( 12): Result.005 file - promoters50/4254299
ttcatttgattt

SEQ ID NO: 185377 - DNA, 12 bp, Unknown
  misc_feature (1)..( 12): Result.005 file - promoters50/4254299
ataatttaattt

SEQ ID NO: 185378 - DNA, 12 bp, Unknown
  misc_feature (1)..( 12): Result.005 file - promoters50/4254299
gttatttaaacc

SEQ ID NO: 185379 - DNA, 12 bp, Unknown
  misc_feature (1)..( 12): Result.005 file - promoters50/4254299
ataaattaatac

SEQ ID NO: 185380 - DNA, 13 bp, Unknown
  misc_feature (1)..( 13): Result.005 file - promoters50/4254299
aaaaagttaactt

SEQ ID NO: 185381 - DNA, 13 bp, Unknown
  misc_feature (1)..( 13): Result.005 file - promoters50/4254299
aaaaatttattaa

SEQ ID NO: 185382 - DNA, 13 bp, Unknown
  misc_feature (1)..( 13): Result.005 file - promoters50/4254299
cctaatttaacct

SEQ ID NO: 185383 - DNA, 13 bp, Unknown
  misc_feature (1)..( 13): Result.005 file - promoters50/4254299
ctctattcaacct

SEQ ID NO: 185384 - DNA, 10 bp, Unknown
  misc_feature (1)..( 10): Result.005 file - promoters50/4254307
cgattttttg

SEQ ID NO: 185385 - DNA, 10 bp, Unknown
  misc_feature (1)..( 10): Result.005 file - promoters50/4254307
aagtttgttg

SEQ ID NO: 185386 - DNA, 10 bp, Unknown
  misc_feature (1)..( 10): Result.005 file - promoters50/4254307
tgattctttg

SEQ ID NO: 185387 - DNA, 10 bp, Unknown
  misc_feature (1)..( 10): Result.005 file - promoters50/4254307
tgactctctt

SEQ ID NO: 185388 - DNA, 10 bp, Unknown
  misc_feature (1)..( 10): Result.005 file - promoters50/4254307
tgattctttg

SEQ ID NO: 185389 - DNA, 10 bp, Unknown
  misc_feature (1)..( 10): Result.005 file - promoters50/4254307
tgactcatca

SEQ ID NO: 185390 - DNA, 14 bp, Unknown
  misc_feature (1)..( 14): Result.005 file - promoters50/4254307
ttaatttttttatt

SEQ ID NO: 185391 - DNA, 14 bp, Unknown
  misc_feature (1)..( 14): Result.005 file - promoters50/4254307
atgattctttgacc

SEQ ID NO: 185392 - DNA, 14 bp, Unknown
  misc_feature (1)..( 14): Result.005 file - promoters50/4254307
aatatttttaatat

SEQ ID NO: 185393 - DNA, 14 bp, Unknown
  misc_feature (1)..( 14): Result.005 file - promoters50/4254307
ttggttttgatagt

SEQ ID NO: 185394 - DNA, 14 bp, Unknown
  misc_feature (1)..( 14): Result.005 file - promoters50/4254307
tcagacttgactct

SEQ ID NO: 185395 - DNA, 14 bp, Unknown
  misc_feature (1)..( 14): Result.005 file - promoters50/4254307
aatactttatttta

SEQ ID NO: 185396 - DNA, 9 bp, Unknown
  misc_feature (1)..( 9): Result.005 file - promoters50/4254426
aacttctaa

SEQ ID NO: 185397 - DNA, 9 bp, Unknown
  misc_feature (1)..( 9): Result.005 file - promoters50/4254426
tccttataa

SEQ ID NO: 185398 - DNA, 9 bp, Unknown
  misc_feature (1)..( 9): Result.005 file - promoters50/4254426
ttcttctat

SEQ ID NO: 185399 - DNA, 9 bp, Unknown
  misc_feature (1)..( 9): Result.005 file - promoters50/4254426
tccctatct

SEQ ID NO: 185400 - DNA, 12 bp, Unknown
  misc_feature (1)..( 12): Result.005 file - promoters50/4254505
ctcttctacact

SEQ ID NO: 185401 - DNA, 12 bp, Unknown
  misc_feature (1)..( 12): Result.005 file - promoters50/4254505
tcactctaaact

SEQ ID NO: 185402 - DNA, 12 bp, Unknown
  misc_feature (1)..( 12): Result.005 file - promoters50/4254505
tcactataataa

SEQ ID NO: 185403 - DNA, 7 bp, Unknown
  misc_feature (1)..( 7): Result.005 file - promoters50/4254505
acagttt

SEQ ID NO: 185404 - DNA, 7 bp, Unknown
  misc_feature (1)..( 7): Result.005 file - promoters50/4254505
gcagttt

SEQ ID NO: 185405 - DNA, 7 bp, Unknown
  misc_feature (1)..( 7): Result.005 file - promoters50/4254505
acaattt

SEQ ID NO: 185406 - DNA, 10 bp, Unknown
  misc_feature (1)..( 10): Result.005 file - promoters50/4254505
atcaaaaaat

SEQ ID NO: 185407 - DNA, 10 bp, Unknown
  misc_feature (1)..( 10): Result.005 file - promoters50/4254505
cacaataaat

SEQ ID NO: 185408 - DNA, 10 bp, Unknown
  misc_feature (1)..( 10): Result.005 file - promoters50/4254505
tataaaaaaa

SEQ ID NO: 185409 - DNA, 8 bp, Unknown
  misc_feature (1)..( 8): Result.005 file - promoters50/4254505
agtatttt

SEQ ID NO: 185410 - DNA, 8 bp, Unknown
  misc_feature (1)..( 8): Result.005 file - promoters50/4254505
agtgtttc

SEQ ID NO: 185411 - DNA, 8 bp, Unknown
  misc_feature (1)..( 8): Result.005 file - promoters50/4254505
cttgtttc

SEQ ID NO: 185412 - DNA, 8 bp, Unknown
  misc_feature (1)..( 8): Result.005 file - promoters50/4254505
aaagtata

SEQ ID NO: 185413 - DNA, 8 bp, Unknown
  misc_feature (1)..( 8): Result.005 file - promoters50/4254505
aaaatatt

SEQ ID NO: 185414 - DNA, 8 bp, Unknown
  misc_feature (1)..( 8): Result.005 file - promoters50/4254505
ataatatt

SEQ ID NO: 185415 - DNA, 13 bp, Unknown
  misc_feature (1)..( 13): Result.005 file - promoters50/4254505
gaatatatgtgtt

SEQ ID NO: 185416 - DNA, 13 bp, Unknown
  misc_feature (1)..( 13): Result.005 file - promoters50/4254505
taatttataattc

SEQ ID NO: 185417 - DNA, 13 bp, Unknown
  misc_feature (1)..( 13): Result.005 file - promoters50/4254505
aaatttgttattt

SEQ ID NO: 185418 - DNA, 9 bp, Unknown
  misc_feature (1)..( 9): Result.005 file - promoters50/4262398
ccattctcg

SEQ ID NO: 185419 - DNA, 9 bp, Unknown
  misc_feature (1)..( 9): Result.005 file - promoters50/4262398
cttttctcg

SEQ ID NO: 185420 - DNA, 9 bp, Unknown
  misc_feature (1)..( 9): Result.005 file - promoters50/4262398
cttgtctcc

SEQ ID NO: 185421 - DNA, 11 bp, Unknown
  misc_feature (1)..( 11): Result.005 file - promoters50/4262420
aaaaagaaaaa

SEQ ID NO: 185422 - DNA, 11 bp, Unknown
  misc_feature (1)..( 11): Result.005 file - promoters50/4262420
aaaaagaaaag

SEQ ID NO: 185423 - DNA, 11 bp, Unknown
  misc_feature (1)..( 11): Result.005 file - promoters50/4262420
gataagtaaag

SEQ ID NO: 185424 - DNA, 11 bp, Unknown
  misc_feature (1)..( 11): Result.005 file - promoters50/4262420
acaaacaaaaa

SEQ ID NO: 185425 - DNA, 11 bp, Unknown
  misc_feature (1)..( 11): Result.005 file - promoters50/4262420
gtatacaaaca

SEQ ID NO: 185426 - DNA, 11 bp, Unknown
  misc_feature (1)..( 11): Result.005 file - promoters50/4262420
agaaccaaaat

SEQ ID NO: 185427 - DNA, 11 bp, Unknown
  misc_feature (1)..( 11): Result.005 file - promoters50/4262420
accgaaaaaac

SEQ ID NO: 185428 - DNA, 11 bp, Unknown
  misc_feature (1)..( 11): Result.005 file - promoters50/4262420
ttagaaaaatg

SEQ ID NO: 185429 - DNA, 12 bp, Unknown
  misc_feature (1)..( 12): Result.005 file - promoters50/4262420
tgagaacaaagc

SEQ ID NO: 185430 - DNA, 12 bp, Unknown
  misc_feature (1)..( 12): Result.005 file - promoters50/4262420
aaagaacaaggt

SEQ ID NO: 185431 - DNA, 12 bp, Unknown
  misc_feature (1)..( 12): Result.005 file - promoters50/4262420
accgaaaaaaca

SEQ ID NO: 185432 - DNA, 12 bp, Unknown
  misc_feature (1)..( 12): Result.005 file - promoters50/4262420
ggagaacattgt

SEQ ID NO: 185433 - DNA, 14 bp, Unknown
  misc_feature (1)..( 14): Result.005 file - promoters50/4262420
aattttgattcagg

SEQ ID NO: 185434 - DNA, 14 bp, Unknown
  misc_feature (1)..( 14): Result.005 file - promoters50/4262420
gattttgatttttg

SEQ ID NO: 185435 - DNA, 14 bp, Unknown
  misc_feature (1)..( 14): Result.005 file - promoters50/4262420
gtttttgaatcgat

SEQ ID NO: 185436 - DNA, 14 bp, Unknown
  misc_feature (1)..( 14): Result.005 file - promoters50/4262420
aatgttgcaaacga

SEQ ID NO: 185437 - DNA, 14 bp, Unknown
  misc_feature (1)..( 14): Result.005 file - promoters50/4262420
aagtttcaatcttc

SEQ ID NO: 185438 - DNA, 14 bp, Unknown
  misc_feature (1)..( 14): Result.005 file - promoters50/4262420
aaaactgattattg

SEQ ID NO: 185439 - DNA, 10 bp, Unknown
  misc_feature (1)..( 10): Result.005 file - promoters50/4262422
atgataagag

SEQ ID NO: 185440 - DNA, 10 bp, Unknown
  misc_feature (1)..( 10): Result.005 file - promoters50/4262422
gcgattagaa

SEQ ID NO: 185441 - DNA, 10 bp, Unknown
  misc_feature (1)..( 10): Result.005 file - promoters50/4262422
tggataagtt

SEQ ID NO: 185442 - DNA, 10 bp, Unknown
  misc_feature (1)..( 10): Result.005 file - promoters50/4262422
gtgataatga

SEQ ID NO: 185443 - DNA, 10 bp, Unknown
  misc_feature (1)..( 10): Result.005 file - promoters50/4262422
tggataaaac

SEQ ID NO: 185444 - DNA, 10 bp, Unknown
  misc_feature (1)..( 10): Result.005 file - promoters50/4262422
cagatgatga

SEQ ID NO: 185445 - DNA, 13 bp, Unknown
  misc_feature (1)..( 13): Result.005 file - promoters50/4262422
tggtttaatcatt

SEQ ID NO: 185446 - DNA, 13 bp, Unknown
  misc_feature (1)..( 13): Result.005 file - promoters50/4262422
taatttaatttgt

SEQ ID NO: 185447 - DNA, 13 bp, Unknown
  misc_feature (1)..( 13): Result.005 file - promoters50/4262422
taatttcatttga

SEQ ID NO: 185448 - DNA, 13 bp, Unknown
  misc_feature (1)..( 13): Result.005 file - promoters50/4262422
tgagttgattata

SEQ ID NO: 185449 - DNA, 13 bp, Unknown
  misc_feature (1)..( 13): Result.005 file - promoters50/4262422
acatttgagtcct

SEQ ID NO: 185450 - DNA, 13 bp, Unknown
  misc_feature (1)..( 13): Result.005 file - promoters50/4262422
gatgtgaattgtg

SEQ ID NO: 185451 - DNA, 13 bp, Unknown
  misc_feature (1)..( 13): Result.005 file - promoters50/4262422
gacagtgatttgt

SEQ ID NO: 185452 - DNA, 10 bp, Unknown
  misc_feature (1)..( 10): Result.005 file - promoters50/4262428
attatgttaa

SEQ ID NO: 185453 - DNA, 10 bp, Unknown
  misc_feature (1)..( 10): Result.005 file - promoters50/4262428
cttatgtctt

SEQ ID NO: 185454 - DNA, 10 bp, Unknown
  misc_feature (1)..( 10): Result.005 file - promoters50/4262428
gttaagtttt

SEQ ID NO: 185455 - DNA, 10 bp, Unknown
  misc_feature (1)..( 10): Result.005 file - promoters50/4262428
attatgtcat

SEQ ID NO: 185456 - DNA, 10 bp, Unknown
  misc_feature (1)..( 10): Result.005 file - promoters50/4262428
aagaagtttg

SEQ ID NO: 185457 - DNA, 10 bp, Unknown
  misc_feature (1)..( 10): Result.005 file - promoters50/4262428
attttgtcat

SEQ ID NO: 185458 - DNA, 12 bp, Unknown
  misc_feature (1)..( 12): Result.005 file - promoters50/4262428
tgtcataaatag

SEQ ID NO: 185459 - DNA, 12 bp, Unknown
  misc_feature (1)..( 12): Result.005 file - promoters50/4262428
caatataaatgt

SEQ ID NO: 185460 - DNA, 12 bp, Unknown
  misc_feature (1)..( 12): Result.005 file - promoters50/4262428
tgtaataaacga

SEQ ID NO: 185461 - DNA, 12 bp, Unknown
  misc_feature (1)..( 12): Result.005 file - promoters50/4262428
taaaataaaaat

SEQ ID NO: 185462 - DNA, 12 bp, Unknown
  misc_feature (1)..( 12): Result.005 file - promoters50/4262428
aaatttaaattt

SEQ ID NO: 185463 - DNA, 12 bp, Unknown
  misc_feature (1)..( 12): Result.005 file - promoters50/4262428
caccaaaaatac

SEQ ID NO: 185464 - DNA, 11 bp, Unknown
  misc_feature (1)..( 11): Result.005 file - promoters50/4262428
atgttaacgac

SEQ ID NO: 185465 - DNA, 11 bp, Unknown
  misc_feature (1)..( 11): Result.005 file - promoters50/4262428
atgttaaataa

SEQ ID NO: 185466 - DNA, 11 bp, Unknown
  misc_feature (1)..( 11): Result.005 file - promoters50/4262428
ttgttaacagg

SEQ ID NO: 185467 - DNA, 11 bp, Unknown
  misc_feature (1)..( 11): Result.005 file - promoters50/4262428
gtgtaaaatgg

SEQ ID NO: 185468 - DNA, 11 bp, Unknown
  misc_feature (1)..( 11): Result.005 file - promoters50/4262428
aagttatataa

SEQ ID NO: 185469 - DNA, 11 bp, Unknown
  misc_feature (1)..( 11): Result.005 file - promoters50/4262428
gtgtaagagga

SEQ ID NO: 185470 - DNA, 13 bp, Unknown
  misc_feature (1)..( 13): Result.005 file - promoters50/4262446
ctactaaaaaaat

SEQ ID NO: 185471 - DNA, 13 bp, Unknown
  misc_feature (1)..( 13): Result.005 file - promoters50/4262446
acctcaaacaaat

SEQ ID NO: 185472 - DNA, 13 bp, Unknown
  misc_feature (1)..( 13): Result.005 file - promoters50/4262446
ctaccaaaaatga

SEQ ID NO: 185473 - DNA, 13 bp, Unknown
  misc_feature (1)..( 13): Result.005 file - promoters50/4262446
cacacaaaaaact

SEQ ID NO: 185474 - DNA, 13 bp, Unknown
  misc_feature (1)..( 13): Result.005 file - promoters50/4262446
tgaataaaaaaac

SEQ ID NO: 185475 - DNA, 13 bp, Unknown
  misc_feature (1)..( 13): Result.005 file - promoters50/4262446
gttagaaataaaa

SEQ ID NO: 185476 - DNA, 13 bp, Unknown
  misc_feature (1)..( 13): Result.005 file - promoters50/4262446
tctagataaaagt

SEQ ID NO: 185477 - DNA, 11 bp, Unknown
  misc_feature (1)..( 11): Result.005 file - promoters50/4262446
ccaataataat

SEQ ID NO: 185478 - DNA, 11 bp, Unknown
  misc_feature (1)..( 11): Result.005 file - promoters50/4262446
aaaataatgaa

SEQ ID NO: 185479 - DNA, 11 bp, Unknown
  misc_feature (1)..( 11): Result.005 file - promoters50/4262446
tcaaaaattaa

SEQ ID NO: 185480 - DNA, 11 bp, Unknown
  misc_feature (1)..( 11): Result.005 file - promoters50/4262446
taaataattgg

SEQ ID NO: 185481 - DNA, 11 bp, Unknown
  misc_feature (1)..( 11): Result.005 file - promoters50/4262446
tcttaaattta

SEQ ID NO: 185482 - DNA, 11 bp, Unknown
  misc_feature (1)..( 11): Result.005 file - promoters50/4262446
cttatattatg

SEQ ID NO: 185483 - DNA, 14 bp, Unknown
  misc_feature (1)..( 14): Result.005 file - promoters50/4262446
caatatacatcata

SEQ ID NO: 185484 - DNA, 14 bp, Unknown
  misc_feature (1)..( 14): Result.005 file - promoters50/4262446
attttgacatcata

SEQ ID NO: 185485 - DNA, 14 bp, Unknown
  misc_feature (1)..( 14): Result.005 file - promoters50/4262446
tccaaccaatcata

SEQ ID NO: 185486 - DNA, 14 bp, Unknown
  misc_feature (1)..( 14): Result.005 file - promoters50/4262446
attttgaaatcatg

SEQ ID NO: 185487 - DNA, 14 bp, Unknown
  misc_feature (1)..( 14): Result.005 file - promoters50/4262446
ctatcaaaataatg

SEQ ID NO: 185488 - DNA, 14 bp, Unknown
  misc_feature (1)..( 14): Result.005 file - promoters50/4262446
ctttgcaaatttta

SEQ ID NO: 185489 - DNA, 15 bp, Unknown
  misc_feature (1)..( 15): Result.005 file - promoters50/4262446
ttattctgataaatc

SEQ ID NO: 185490 - DNA, 15 bp, Unknown
  misc_feature (1)..( 15): Result.005 file - promoters50/4262446
tcattttgacatcat

SEQ ID NO: 185491 - DNA, 15 bp, Unknown
  misc_feature (1)..( 15): Result.005 file - promoters50/4262446
aaattttgaaatcat

SEQ ID NO: 185492 - DNA, 15 bp, Unknown
  misc_feature (1)..( 15): Result.005 file - promoters50/4262446
aaataatgaatttat

SEQ ID NO: 185493 - DNA, 15 bp, Unknown
  misc_feature (1)..( 15): Result.005 file - promoters50/4262446
aaattttattgcttg

SEQ ID NO: 185494 - DNA, 15 bp, Unknown
  misc_feature (1)..( 15): Result.005 file - promoters50/4262446
acttttttaaagttc

SEQ ID NO: 185495 - DNA, 15 bp, Unknown
  misc_feature (1)..( 15): Result.005 file - promoters50/4262446
aaagttttaagataa

SEQ ID NO: 185496 - DNA, 11 bp, Unknown
  misc_feature (1)..( 11): Result.005 file - promoters50/4262480
ctgtttggact

SEQ ID NO: 185497 - DNA, 11 bp, Unknown
  misc_feature (1)..( 11): Result.005 file - promoters50/4262480
atggttgaact

SEQ ID NO: 185498 - DNA, 11 bp, Unknown
  misc_feature (1)..( 11): Result.005 file - promoters50/4262480
atggctgaatc

SEQ ID NO: 185499 - DNA, 9 bp, Unknown
  misc_feature (1)..( 9): Result.005 file - promoters50/4262480
gctgctgaa

SEQ ID NO: 185500 - DNA, 9 bp, Unknown
  misc_feature (1)..( 9): Result.005 file - promoters50/4262480
atggctgaa

SEQ ID NO: 185501 - DNA, 9 bp, Unknown
  misc_feature (1)..( 9): Result.005 file - promoters50/4262480
atggttgaa

SEQ ID NO: 185502 - DNA, 13 bp, Unknown
  misc_feature (1)..( 13): Result.005 file - promoters50/4262496
actaattatagtt

SEQ ID NO: 185503 - DNA, 13 bp, Unknown
  misc_feature (1)..( 13): Result.005 file - promoters50/4262496
tctatttaaagtt

SEQ ID NO: 185504 - DNA, 13 bp, Unknown
  misc_feature (1)..( 13): Result.005 file - promoters50/4262496
actaatttaacaa

SEQ ID NO: 185505 - DNA, 13 bp, Unknown
  misc_feature (1)..( 13): Result.005 file - promoters50/4262496
cctaatttactac

SEQ ID NO: 185506 - DNA, 8 bp, Unknown
  misc_feature (1)..( 8): Result.005 file - promoters50/4262503
aacacaaa

SEQ ID NO: 185507 - DNA, 8 bp, Unknown
  misc_feature (1)..( 8): Result.005 file - promoters50/4262503
aactcaag

SEQ ID NO: 185508 - DNA, 8 bp, Unknown
  misc_feature (1)..( 8): Result.005 file - promoters50/4262503
gacagaaa

SEQ ID NO: 185509 - DNA, 9 bp, Unknown
  misc_feature (1)..( 9): Result.005 file - promoters50/4262503
acattttgt

SEQ ID NO: 185510 - DNA, 9 bp, Unknown
  misc_feature (1)..( 9): Result.005 file - promoters50/4262503
acatttgtt

SEQ ID NO: 185511 - DNA, 9 bp, Unknown
  misc_feature (1)..( 9): Result.005 file - promoters50/4262503
ccattcgtt

SEQ ID NO: 185512 - DNA, 15 bp, Unknown
  misc_feature (1)..( 15): Result.005 file - promoters50/4262562
gagttttgacttttc

SEQ ID NO: 185513 - DNA, 15 bp, Unknown
  misc_feature (1)..( 15): Result.005 file - promoters50/4262562
ataatttaacttttt

SEQ ID NO: 185514 - DNA, 15 bp, Unknown
  misc_feature (1)..( 15): Result.005 file - promoters50/4262562
ctaattaaacttggt

SEQ ID NO: 185515 - DNA, 15 bp, Unknown
  misc_feature (1)..( 15): Result.005 file - promoters50/4262562
ctaattagattatta

SEQ ID NO: 185516 - DNA, 15 bp, Unknown
  misc_feature (1)..( 15): Result.005 file - promoters50/4262562
gggttggaacctggc

SEQ ID NO: 185517 - DNA, 15 bp, Unknown
  misc_feature (1)..( 15): Result.005 file - promoters50/4262562
tggatatttcttttt

SEQ ID NO: 185518 - DNA, 9 bp, Unknown
  misc_feature (1)..( 9): Result.005 file - promoters50/4265060
agaagttaa

SEQ ID NO: 185519 - DNA, 9 bp, Unknown
  misc_feature (1)..( 9): Result.005 file - promoters50/4265060
agaagttga

SEQ ID NO: 185520 - DNA, 9 bp, Unknown
  misc_feature (1)..( 9): Result.005 file - promoters50/4265060
gtaagataa

SEQ ID NO: 185521 - DNA, 9 bp, Unknown
  misc_feature (1)..( 9): Result.005 file - promoters50/4265060
caaagatat

SEQ ID NO: 185522 - DNA, 8 bp, Unknown
  misc_feature (1)..( 8): Result.005 file - promoters50/4265060
aatctctc

SEQ ID NO: 185523 - DNA, 8 bp, Unknown
  misc_feature (1)..( 8): Result.005 file - promoters50/4265060
gttctctc

SEQ ID NO: 185524 - DNA, 8 bp, Unknown
  misc_feature (1)..( 8): Result.005 file - promoters50/4265060
aatttctt

SEQ ID NO: 185525 - DNA, 7 bp, Unknown
  misc_feature (1)..( 7): Result.005 file - promoters50/4265060
agaaatg

SEQ ID NO: 185526 - DNA, 7 bp, Unknown
  misc_feature (1)..( 7): Result.005 file - promoters50/4265060
agagatg

SEQ ID NO: 185527 - DNA, 7 bp, Unknown
  misc_feature (1)..( 7): Result.005 file - promoters50/4265060
agaaaga

SEQ ID NO: 185528 - DNA, 9 bp, Unknown
  misc_feature (1)..( 9): Result.005 file - promoters50/4265060
taaacagta

SEQ ID NO: 185529 - DNA, 9 bp, Unknown
  misc_feature (1)..( 9): Result.005 file - promoters50/4265060
taaacatat

SEQ ID NO: 185530 - DNA, 9 bp, Unknown
  misc_feature (1)..( 9): Result.005 file - promoters50/4265060
caaagatat

SEQ ID NO: 185531 - DNA, 9 bp, Unknown
  misc_feature (1)..( 9): Result.005 file - promoters50/4265060
tcagagaaa

SEQ ID NO: 185532 - DNA, 9 bp, Unknown
  misc_feature (1)..( 9): Result.005 file - promoters50/4265060
tttgagaaa

SEQ ID NO: 185533 - DNA, 9 bp, Unknown
  misc_feature (1)..( 9): Result.005 file - promoters50/4265060
tcagagaaa

SEQ ID NO: 185534 - DNA, 8 bp, Unknown
  misc_feature (1)..( 8): Result.005 file - promoters50/4265699
ttaagcaa

SEQ ID NO: 185535 - DNA, 8 bp, Unknown
  misc_feature (1)..( 8): Result.005 file - promoters50/4265699
ttaatcaa

SEQ ID NO: 185536 - DNA, 8 bp, Unknown
  misc_feature (1)..( 8): Result.005 file - promoters50/4265699
caaatcaa

SEQ ID NO: 185537 - DNA, 8 bp, Unknown
  misc_feature (1)..( 8): Result.005 file - promoters50/4265699
taaaacaa

SEQ ID NO: 185538 - DNA, 8 bp, Unknown
  misc_feature (1)..( 8): Result.005 file - promoters50/4265699
aaagaaaa

SEQ ID NO: 185539 - DNA, 8 bp, Unknown
  misc_feature (1)..( 8): Result.005 file - promoters50/4265699
aaataaat

SEQ ID NO: 185540 - DNA, 8 bp, Unknown
  misc_feature (1)..( 8): Result.005 file - promoters50/4265699
aaagaaaa

SEQ ID NO: 185541 - DNA, 8 bp, Unknown
  misc_feature (1)..( 8): Result.005 file - promoters50/4265699
atataaat

SEQ ID NO: 185542 - DNA, 8 bp, Unknown
  misc_feature (1)..( 8): Result.005 file - promoters50/4266227
ttggaaga

SEQ ID NO: 185543 - DNA, 8 bp, Unknown
  misc_feature (1)..( 8): Result.005 file - promoters50/4266227
ttggaact

SEQ ID NO: 185544 - DNA, 8 bp, Unknown
  misc_feature (1)..( 8): Result.005 file - promoters50/4266227
ttgggaga

SEQ ID NO: 185545 - DNA, 10 bp, Unknown
  misc_feature (1)..( 10): Result.005 file - promoters50/4266608
aagtaaacgc

SEQ ID NO: 185546 - DNA, 10 bp, Unknown
  misc_feature (1)..( 10): Result.005 file - promoters50/4266608
aagaaaaagg

SEQ ID NO: 185547 - DNA, 10 bp, Unknown
  misc_feature (1)..( 10): Result.005 file - promoters50/4266608
gagtcaacat

SEQ ID NO: 185548 - DNA, 10 bp, Unknown
  misc_feature (1)..( 10): Result.005 file - promoters50/4266608
aagtaaaagt

SEQ ID NO: 185549 - DNA, 10 bp, Unknown
  misc_feature (1)..( 10): Result.005 file - promoters50/4266608
agttcaacac

SEQ ID NO: 185550 - DNA, 10 bp, Unknown
  misc_feature (1)..( 10): Result.005 file - promoters50/4266608
tatgcaacac

SEQ ID NO: 185551 - DNA, 11 bp, Unknown
  misc_feature (1)..( 11): Result.005 file - promoters50/4266608
agataaaaata

SEQ ID NO: 185552 - DNA, 11 bp, Unknown
  misc_feature (1)..( 11): Result.005 file - promoters50/4266608
atctaaaaata

SEQ ID NO: 185553 - DNA, 11 bp, Unknown
  misc_feature (1)..( 11): Result.005 file - promoters50/4266608
acttaaaaaca

SEQ ID NO: 185554 - DNA, 11 bp, Unknown
  misc_feature (1)..( 11): Result.005 file - promoters50/4266608
gattaaaaatc

SEQ ID NO: 185555 - DNA, 11 bp, Unknown
  misc_feature (1)..( 11): Result.005 file - promoters50/4266608
ctctagaaaca

SEQ ID NO: 185556 - DNA, 11 bp, Unknown
  misc_feature (1)..( 11): Result.005 file - promoters50/4266608
agatacaaatg

SEQ ID NO: 185557 - DNA, 15 bp, Unknown
  misc_feature (1)..( 15): Result.005 file - promoters50/4267125
gttttatttgtgtga

SEQ ID NO: 185558 - DNA, 15 bp, Unknown
  misc_feature (1)..( 15): Result.005 file - promoters50/4267125
tacttacttgacgcc

SEQ ID NO: 185559 - DNA, 15 bp, Unknown
  misc_feature (1)..( 15): Result.005 file - promoters50/4267125
gttttgtttgtggag

SEQ ID NO: 185560 - DNA, 15 bp, Unknown
  misc_feature (1)..( 15): Result.005 file - promoters50/4267125
gtacgatttgttagg

SEQ ID NO: 185561 - DNA, 15 bp, Unknown
  misc_feature (1)..( 15): Result.005 file - promoters50/4267125
taattatatgtatat

SEQ ID NO: 185562 - DNA, 15 bp, Unknown
  misc_feature (1)..( 15): Result.005 file - promoters50/4267125
cttttgtttttggta

SEQ ID NO: 185563 - DNA, 15 bp, Unknown
  misc_feature (1)..( 15): Result.005 file - promoters50/4267125
ttggaatttggaaaa

SEQ ID NO: 185564 - DNA, 12 bp, Unknown
  misc_feature (1)..( 12): Result.005 file - promoters50/4267125
attgagcatagg

SEQ ID NO: 185565 - DNA, 12 bp, Unknown
  misc_feature (1)..( 12): Result.005 file - promoters50/4267125
attgaccatctt

SEQ ID NO: 185566 - DNA, 12 bp, Unknown
  misc_feature (1)..( 12): Result.005 file - promoters50/4267125
aatgaacatcaa

SEQ ID NO: 185567 - DNA, 12 bp, Unknown
  misc_feature (1)..( 12): Result.005 file - promoters50/4267125
taagaacattgg

SEQ ID NO: 185568 - DNA, 12 bp, Unknown
  misc_feature (1)..( 12): Result.005 file - promoters50/4267125
aaagaccatctt

SEQ ID NO: 185569 - DNA, 12 bp, Unknown
  misc_feature (1)..( 12): Result.005 file - promoters50/4267125
tgagatcataat

SEQ ID NO: 185570 - DNA, 19 bp, Unknown
  misc_feature (1)..( 19): Result.005 file - promoters50/4267125
ttgtataatatttgttttc

SEQ ID NO: 185571 - DNA, 19 bp, Unknown
  misc_feature (1)..( 19): Result.005 file - promoters50/4267125
ttagccacattttgttttt

SEQ ID NO: 185572 - DNA, 19 bp, Unknown
  misc_feature (1)..( 19): Result.005 file - promoters50/4267125
ttaaccacattttgtcgaa

SEQ ID NO: 185573 - DNA, 19 bp, Unknown
  misc_feature (1)..( 19): Result.005 file - promoters50/4267125
tcattaacgtttggttttg

SEQ ID NO: 185574 - DNA, 19 bp, Unknown
  misc_feature (1)..( 19): Result.005 file - promoters50/4267125
cccaccggcgttggatttg

SEQ ID NO: 185575 - DNA, 19 bp, Unknown
  misc_feature (1)..( 19): Result.005 file - promoters50/4267125
aaagctttaattagctcac

SEQ ID NO: 185576 - DNA, 10 bp, Unknown
  misc_feature (1)..( 10): Result.005 file - promoters50/4267125
cattttgttt

SEQ ID NO: 185577 - DNA, 10 bp, Unknown
  misc_feature (1)..( 10): Result.005 file - promoters50/4267125
ctttttgttt

SEQ ID NO: 185578 - DNA, 10 bp, Unknown
  misc_feature (1)..( 10): Result.005 file - promoters50/4267125
gtttttgtcc

SEQ ID NO: 185579 - DNA, 10 bp, Unknown
  misc_feature (1)..( 10): Result.005 file - promoters50/4267125
gttttttctc

SEQ ID NO: 185580 - DNA, 10 bp, Unknown
  misc_feature (1)..( 10): Result.005 file - promoters50/4267125
tgtttagtct

SEQ ID NO: 185581 - DNA, 10 bp, Unknown
  misc_feature (1)..( 10): Result.005 file - promoters50/4267125
ctttttgatg

SEQ ID NO: 185582 - DNA, 8 bp, Unknown
  misc_feature (1)..( 8): Result.005 file - promoters50/4268705
ttgaattt

SEQ ID NO: 185583 - DNA, 8 bp, Unknown
  misc_feature (1)..( 8): Result.005 file - promoters50/4268705
ttgaattc

SEQ ID NO: 185584 - DNA, 8 bp, Unknown
  misc_feature (1)..( 8): Result.005 file - promoters50/4268705
atgagttt

SEQ ID NO: 185585 - DNA, 12 bp, Unknown
  misc_feature (1)..( 12): Result.005 file - promoters50/4268705
ataaatgggcct

SEQ ID NO: 185586 - DNA, 12 bp, Unknown
  misc_feature (1)..( 12): Result.005 file - promoters50/4268705
ataaatgggcta

SEQ ID NO: 185587 - DNA, 12 bp, Unknown
  misc_feature (1)..( 12): Result.005 file - promoters50/4268705
aaatctggtcta

SEQ ID NO: 185588 - DNA, 8 bp, Unknown
  misc_feature (1)..( 8): Result.005 file - promoters50/4270131
ttaataac

SEQ ID NO: 185589 - DNA, 8 bp, Unknown
  misc_feature (1)..( 8): Result.005 file - promoters50/4270131
ataataat

SEQ ID NO: 185590 - DNA, 8 bp, Unknown
  misc_feature (1)..( 8): Result.005 file - promoters50/4270131
ttaataac

SEQ ID NO: 185591 - DNA, 11 bp, Unknown
  misc_feature (1)..( 11): Result.005 file - promoters50/4270131
tttgtttcttt

SEQ ID NO: 185592 - DNA, 11 bp, Unknown
  misc_feature (1)..( 11): Result.005 file - promoters50/4270131
cctgtttcgcg

SEQ ID NO: 185593 - DNA, 11 bp, Unknown
  misc_feature (1)..( 11): Result.005 file - promoters50/4270131
tttttttcttt

SEQ ID NO: 185594 - DNA, 8 bp, Unknown
  misc_feature (1)..( 8): Result.005 file - promoters50/4281568
taaacaag

SEQ ID NO: 185595 - DNA, 8 bp, Unknown
  misc_feature (1)..( 8): Result.005 file - promoters50/4281568
taaaaaag

SEQ ID NO: 185596 - DNA, 8 bp, Unknown
  misc_feature (1)..( 8): Result.005 file - promoters50/4281568
gaaaaaaa

SEQ ID NO: 185597 - DNA, 10 bp, Unknown
  misc_feature (1)..( 10): Result.005 file - promoters50/4281576
taataaaata

SEQ ID NO: 185598 - DNA, 10 bp, Unknown
  misc_feature (1)..( 10): Result.005 file - promoters50/4281576
taacaaaact

SEQ ID NO: 185599 - DNA, 10 bp, Unknown
  misc_feature (1)..( 10): Result.005 file - promoters50/4281576
tcataaaaaa

SEQ ID NO: 185600 - DNA, 10 bp, Unknown
  misc_feature (1)..( 10): Result.005 file - promoters50/4281576
cttcaaaacc

SEQ ID NO: 185601 - DNA, 11 bp, Unknown
  misc_feature (1)..( 11): Result.005 file - promoters50/4281576
atcagaaaacc

SEQ ID NO: 185602 - DNA, 11 bp, Unknown
  misc_feature (1)..( 11): Result.005 file - promoters50/4281576
caatagaaatg

SEQ ID NO: 185603 - DNA, 8 bp, Unknown
  misc_feature (1)..( 8): Result.005 file - promoters50/4281645
aatgtgat

SEQ ID NO: 185604 - DNA, 8 bp, Unknown
  misc_feature (1)..( 8): Result.005 file - promoters50/4281645
aatatgat

SEQ ID NO: 185605 - DNA, 8 bp, Unknown
  misc_feature (1)..( 8): Result.005 file - promoters50/4281645
aatatgcc

SEQ ID NO: 185606 - DNA, 8 bp, Unknown
  misc_feature (1)..( 8): Result.005 file - promoters50/4281659
cttcatta

SEQ ID NO: 185607 - DNA, 8 bp, Unknown
  misc_feature (1)..( 8): Result.005 file - promoters50/4281659
tttcttta

SEQ ID NO: 185608 - DNA, 8 bp, Unknown
  misc_feature (1)..( 8): Result.005 file - promoters50/4281659
cttaattt

SEQ ID NO: 185609 - DNA, 8 bp, Unknown
  misc_feature (1)..( 8): Result.005 file - promoters50/4281659
aaatttgt

SEQ ID NO: 185610 - DNA, 8 bp, Unknown
  misc_feature (1)..( 8): Result.005 file - promoters50/4281659
aaatatgt

SEQ ID NO: 185611 - DNA, 8 bp, Unknown
  misc_feature (1)..( 8): Result.005 file - promoters50/4281659
caatatgc

SEQ ID NO: 185612 - DNA, 8 bp, Unknown
  misc_feature (1)..( 8): Result.005 file - promoters50/4281676
attttttg

SEQ ID NO: 185613 - DNA, 8 bp, Unknown
  misc_feature (1)..( 8): Result.005 file - promoters50/4281676
attgtttg

SEQ ID NO: 185614 - DNA, 8 bp, Unknown
  misc_feature (1)..( 8): Result.005 file - promoters50/4281676
attctttc

SEQ ID NO: 185615 - DNA, 13 bp, Unknown
  misc_feature (1)..( 13): Result.005 file - promoters50/4281690
aacaaacaaacaa

SEQ ID NO: 185616 - DNA, 13 bp, Unknown
  misc_feature (1)..( 13): Result.005 file - promoters50/4281690
ctcaatcaaactc

SEQ ID NO: 185617 - DNA, 13 bp, Unknown
  misc_feature (1)..( 13): Result.005 file - promoters50/4281690
aacaaaaaaaata

SEQ ID NO: 185618 - DNA, 13 bp, Unknown
  misc_feature (1)..( 13): Result.005 file - promoters50/4281690
accaatcacaaca

SEQ ID NO: 185619 - DNA, 13 bp, Unknown
  misc_feature (1)..( 13): Result.005 file - promoters50/4281690
caaaatcaaattt

SEQ ID NO: 185620 - DNA, 13 bp, Unknown
  misc_feature (1)..( 13): Result.005 file - promoters50/4281690
aagtgtcaatttt

SEQ ID NO: 185621 - DNA, 14 bp, Unknown
  misc_feature (1)..( 14): Result.005 file - promoters50/4281690
caaacaaacaactc

SEQ ID NO: 185622 - DNA, 14 bp, Unknown
  misc_feature (1)..( 14): Result.005 file - promoters50/4281690
ttttaatacatctc

SEQ ID NO: 185623 - DNA, 14 bp, Unknown
  misc_feature (1)..( 14): Result.005 file - promoters50/4281690
gtaataaaaaactc

SEQ ID NO: 185624 - DNA, 14 bp, Unknown
  misc_feature (1)..( 14): Result.005 file - promoters50/4281690
atccacgacatctg

SEQ ID NO: 185625 - DNA, 14 bp, Unknown
  misc_feature (1)..( 14): Result.005 file - promoters50/4281690
gtaagaaaaaagtg

SEQ ID NO: 185626 - DNA, 14 bp, Unknown
  misc_feature (1)..( 14): Result.005 file - promoters50/4281690
ttaacaaaaaaaat

SEQ ID NO: 185627 - DNA, 14 bp, Unknown
  misc_feature (1)..( 14): Result.005 file - promoters50/4281690
aagacaaaaaacca

SEQ ID NO: 185628 - DNA, 12 bp, Unknown
  misc_feature (1)..( 12): Result.005 file - promoters50/4281690
atttttattcta

SEQ ID NO: 185629 - DNA, 12 bp, Unknown
  misc_feature (1)..( 12): Result.005 file - promoters50/4281690
tgtttgattgaa

SEQ ID NO: 185630 - DNA, 12 bp, Unknown
  misc_feature (1)..( 12): Result.005 file - promoters50/4281690
agatttatttcg

SEQ ID NO: 185631 - DNA, 12 bp, Unknown
  misc_feature (1)..( 12): Result.005 file - promoters50/4281690
caattaatctca

SEQ ID NO: 185632 - DNA, 12 bp, Unknown
  misc_feature (1)..( 12): Result.005 file - promoters50/4281690
atttttaccata

SEQ ID NO: 185633 - DNA, 12 bp, Unknown
  misc_feature (1)..( 12): Result.005 file - promoters50/4281690
acagaaatgtca

SEQ ID NO: 185634 - DNA, 8 bp, Unknown
  misc_feature (1)..( 8): Result.005 file - promoters50/4281690
aaaaaaga

SEQ ID NO: 185635 - DNA, 8 bp, Unknown
  misc_feature (1)..( 8): Result.005 file - promoters50/4281690
caaaaaga

SEQ ID NO: 185636 - DNA, 9 bp, Unknown
  misc_feature (1)..( 9): Result.005 file - promoters50/4281690
taataaatg

SEQ ID NO: 185637 - DNA, 9 bp, Unknown
  misc_feature (1)..( 9): Result.005 file - promoters50/4281690
taagaaatt

SEQ ID NO: 185638 - DNA, 9 bp, Unknown
  misc_feature (1)..( 9): Result.005 file - promoters50/4281690
gcaaaaagt

SEQ ID NO: 185639 - DNA, 9 bp, Unknown
  misc_feature (1)..( 9): Result.005 file - promoters50/4281690
ctaattaga

SEQ ID NO: 185640 - DNA, 8 bp, Unknown
  misc_feature (1)..( 8): Result.005 file - promoters50/4281698
aaaggctt

SEQ ID NO: 185641 - DNA, 8 bp, Unknown
  misc_feature (1)..( 8): Result.005 file - promoters50/4281698
aaaggcaa

SEQ ID NO: 185642 - DNA, 8 bp, Unknown
  misc_feature (1)..( 8): Result.005 file - promoters50/4281698
aaagtctt

SEQ ID NO: 185643 - DNA, 12 bp, Unknown
  misc_feature (1)..( 12): Result.005 file - promoters50/4281698
tgtcttcgattc

SEQ ID NO: 185644 - DNA, 12 bp, Unknown
  misc_feature (1)..( 12): Result.005 file - promoters50/4281698
tgtattcgattt

SEQ ID NO: 185645 - DNA, 12 bp, Unknown
  misc_feature (1)..( 12): Result.005 file - promoters50/4281698
ttcgttcgtttt

SEQ ID NO: 185646 - DNA, 20 bp, Unknown
  misc_feature (1)..( 20): Result.005 file - promoters50/4281711
cttttttaaaaaactatata

SEQ ID NO: 185647 - DNA, 20 bp, Unknown
  misc_feature (1)..( 20): Result.005 file - promoters50/4281711
cttatttaattgttatgaca

SEQ ID NO: 185648 - DNA, 21 bp, Unknown
  misc_feature (1)..( 21): Result.005 file - promoters50/4281711
attcatttgagtaaacaggtc

SEQ ID NO: 185649 - DNA, 21 bp, Unknown
  misc_feature (1)..( 21): Result.005 file - promoters50/4281711
ccaattttaagaaagtatata

SEQ ID NO: 185650 - DNA, 21 bp, Unknown
  misc_feature (1)..( 21): Result.005 file - promoters50/4281711
agagatttagaaagagatgtg

SEQ ID NO: 185651 - DNA, 21 bp, Unknown
  misc_feature (1)..( 21): Result.005 file - promoters50/4281711
ggagatttagggtagattcga

SEQ ID NO: 185652 - DNA, 7 bp, Unknown
  misc_feature (1)..( 7): Result.005 file - promoters50/4281711
gaataaa

SEQ ID NO: 185653 - DNA, 7 bp, Unknown
  misc_feature (1)..( 7): Result.005 file - promoters50/4281711
taataaa

SEQ ID NO: 185654 - DNA, 7 bp, Unknown
  misc_feature (1)..( 7): Result.005 file - promoters50/4281711
gaagaaa

SEQ ID NO: 185655 - DNA, 7 bp, Unknown
  misc_feature (1)..( 7): Result.005 file - promoters50/4281711
taataaa

SEQ ID NO: 185656 - DNA, 8 bp, Unknown
  misc_feature (1)..( 8): Result.005 file - promoters50/4281711
taattaaa

SEQ ID NO: 185657 - DNA, 8 bp, Unknown
  misc_feature (1)..( 8): Result.005 file - promoters50/4281711
tttattaa

SEQ ID NO: 185658 - DNA, 10 bp, Unknown
  misc_feature (1)..( 10): Result.005 file - promoters50/4281737
acctaaaaca

SEQ ID NO: 185659 - DNA, 10 bp, Unknown
  misc_feature (1)..( 10): Result.005 file - promoters50/4281737
atataaaacc

SEQ ID NO: 185660 - DNA, 10 bp, Unknown
  misc_feature (1)..( 10): Result.005 file - promoters50/4281737
ctataaaaaa

SEQ ID NO: 185661 - DNA, 10 bp, Unknown
  misc_feature (1)..( 10): Result.005 file - promoters50/4281737
atatacaaaa

SEQ ID NO: 185662 - DNA, 10 bp, Unknown
  misc_feature (1)..( 10): Result.005 file - promoters50/4281737
ctattaaagt

SEQ ID NO: 185663 - DNA, 10 bp, Unknown
  misc_feature (1)..( 10): Result.005 file - promoters50/4281737
taagaaaaaa

SEQ ID NO: 185664 - DNA, 13 bp, Unknown
  misc_feature (1)..( 13): Result.005 file - promoters50/4281744
attgtgttttacg

SEQ ID NO: 185665 - DNA, 13 bp, Unknown
  misc_feature (1)..( 13): Result.005 file - promoters50/4281744
aatgtgatttacg

SEQ ID NO: 185666 - DNA, 13 bp, Unknown
  misc_feature (1)..( 13): Result.005 file - promoters50/4281744
ttaatgatttcat

SEQ ID NO: 185667 - DNA, 13 bp, Unknown
  misc_feature (1)..( 13): Result.005 file - promoters50/4281744
tatccgaattatt

SEQ ID NO: 185668 - DNA, 13 bp, Unknown
  misc_feature (1)..( 13): Result.005 file - promoters50/4281744
ttattgatttcac

SEQ ID NO: 185669 - DNA, 13 bp, Unknown
  misc_feature (1)..( 13): Result.005 file - promoters50/4281744
aatatgaatttgc

SEQ ID NO: 185670 - DNA, 15 bp, Unknown
  misc_feature (1)..( 15): Result.005 file - promoters50/4281773
atgcatagtttatgg

SEQ ID NO: 185671 - DNA, 15 bp, Unknown
  misc_feature (1)..( 15): Result.005 file - promoters50/4281773
atgtatagttttgtg

SEQ ID NO: 185672 - DNA, 15 bp, Unknown
  misc_feature (1)..( 15): Result.005 file - promoters50/4281773
ttctgaagtttctgg

SEQ ID NO: 185673 - DNA, 15 bp, Unknown
  misc_feature (1)..( 15): Result.005 file - promoters50/4281773
acacattgttttgga

SEQ ID NO: 185674 - DNA, 15 bp, Unknown
  misc_feature (1)..( 15): Result.005 file - promoters50/4281773
gacctaagtttaagt

SEQ ID NO: 185675 - DNA, 15 bp, Unknown
  misc_feature (1)..( 15): Result.005 file - promoters50/4281773
ccgggaactttggtt

SEQ ID NO: 185676 - DNA, 9 bp, Unknown
  misc_feature (1)..( 9): Result.005 file - promoters50/4281773
aaagaaaaa

SEQ ID NO: 185677 - DNA, 9 bp, Unknown
  misc_feature (1)..( 9): Result.005 file - promoters50/4281773
caaggaaag

SEQ ID NO: 185678 - DNA, 10 bp, Unknown
  misc_feature (1)..( 10): Result.005 file - promoters50/4281773
caagaagaag

SEQ ID NO: 185679 - DNA, 10 bp, Unknown
  misc_feature (1)..( 10): Result.005 file - promoters50/4281773
aaaaaaaaag

SEQ ID NO: 185680 - DNA, 10 bp, Unknown
  misc_feature (1)..( 10): Result.005 file - promoters50/4281773
ggagaaaaaa

SEQ ID NO: 185681 - DNA, 10 bp, Unknown
  misc_feature (1)..( 10): Result.005 file - promoters50/4281773
acaaaaaagg

SEQ ID NO: 185682 - DNA, 11 bp, Unknown
  misc_feature (1)..( 11): Result.005 file - promoters50/4281830
caaacgtataa

SEQ ID NO: 185683 - DNA, 11 bp, Unknown
  misc_feature (1)..( 11): Result.005 file - promoters50/4281830
caaaagtaaat

SEQ ID NO: 185684 - DNA, 11 bp, Unknown
  misc_feature (1)..( 11): Result.005 file - promoters50/4281830
atgacgtttaa

SEQ ID NO: 185685 - DNA, 9 bp, Unknown
  misc_feature (1)..( 9): Result.005 file - promoters50/4281830
aaatatata

SEQ ID NO: 185686 - DNA, 9 bp, Unknown
  misc_feature (1)..( 9): Result.005 file - promoters50/4281830
tcatatata

SEQ ID NO: 185687 - DNA, 9 bp, Unknown
  misc_feature (1)..( 9): Result.005 file - promoters50/4281830
aaacatatc

SEQ ID NO: 185688 - DNA, 8 bp, Unknown
  misc_feature (1)..( 8): Result.005 file - promoters50/4281845
gaaaaaac

SEQ ID NO: 185689 - DNA, 8 bp, Unknown
  misc_feature (1)..( 8): Result.005 file - promoters50/4281845
taaaaaat

SEQ ID NO: 185690 - DNA, 8 bp, Unknown
  misc_feature (1)..( 8): Result.005 file - promoters50/4281845
taacaaat

SEQ ID NO: 185691 - DNA, 8 bp, Unknown
  misc_feature (1)..( 8): Result.005 file - promoters50/4281845
aaacaaat

SEQ ID NO: 185692 - DNA, 10 bp, Unknown
  misc_feature (1)..( 10): Result.005 file - promoters50/4281876
aatatacttt

SEQ ID NO: 185693 - DNA, 10 bp, Unknown
  misc_feature (1)..( 10): Result.005 file - promoters50/4281876
agtattctta

SEQ ID NO: 185694 - DNA, 10 bp, Unknown
  misc_feature (1)..( 10): Result.005 file - promoters50/4281876
ctcattatta

SEQ ID NO: 185695 - DNA, 10 bp, Unknown
  misc_feature (1)..( 10): Result.005 file - promoters50/4281876
agttttcttc

SEQ ID NO: 185696 - DNA, 10 bp, Unknown
  misc_feature (1)..( 10): Result.005 file - promoters50/4281876
cgttttctgt

SEQ ID NO: 185697 - DNA, 10 bp, Unknown
  misc_feature (1)..( 10): Result.005 file - promoters50/4281876
tttttttttc

SEQ ID NO: 185698 - DNA, 11 bp, Unknown
  misc_feature (1)..( 11): Result.005 file - promoters50/4281876
ttttgttttct

SEQ ID NO: 185699 - DNA, 11 bp, Unknown
  misc_feature (1)..( 11): Result.005 file - promoters50/4281876
cagcgttttct

SEQ ID NO: 185700 - DNA, 11 bp, Unknown
  misc_feature (1)..( 11): Result.005 file - promoters50/4281876
tttagttttct

SEQ ID NO: 185701 - DNA, 11 bp, Unknown
  misc_feature (1)..( 11): Result.005 file - promoters50/4281876
tttttttttca

SEQ ID NO: 185702 - DNA, 11 bp, Unknown
  misc_feature (1)..( 11): Result.005 file - promoters50/4281876
agaatttttgt

SEQ ID NO: 185703 - DNA, 11 bp, Unknown
  misc_feature (1)..( 11): Result.005 file - promoters50/4281876
ccattttatgt

SEQ ID NO: 185704 - DNA, 11 bp, Unknown
  misc_feature (1)..( 11): Result.005 file - promoters50/4281880
gatgagagtgc

SEQ ID NO: 185705 - DNA, 11 bp, Unknown
  misc_feature (1)..( 11): Result.005 file - promoters50/4281880
gattagatttt

SEQ ID NO: 185706 - DNA, 11 bp, Unknown
  misc_feature (1)..( 11): Result.005 file - promoters50/4281880
tatgagagatg

SEQ ID NO: 185707 - DNA, 11 bp, Unknown
  misc_feature (1)..( 11): Result.005 file - promoters50/4281880
tcttatatttt

SEQ ID NO: 185708 - DNA, 11 bp, Unknown
  misc_feature (1)..( 11): Result.005 file - promoters50/4281880
cattttacacc

SEQ ID NO: 185709 - DNA, 11 bp, Unknown
  misc_feature (1)..( 11): Result.005 file - promoters50/4281880
tatagtataat

SEQ ID NO: 185710 - DNA, 11 bp, Unknown
  misc_feature (1)..( 11): Result.005 file - promoters50/4281880
aatagtacaat

SEQ ID NO: 185711 - DNA, 11 bp, Unknown
  misc_feature (1)..( 11): Result.005 file - promoters50/4281880
tatagtaaatt

SEQ ID NO: 185712 - DNA, 11 bp, Unknown
  misc_feature (1)..( 11): Result.005 file - promoters50/4281880
catactaatta

SEQ ID NO: 185713 - DNA, 11 bp, Unknown
  misc_feature (1)..( 11): Result.005 file - promoters50/4281880
attagcataat

SEQ ID NO: 185714 - DNA, 12 bp, Unknown
  misc_feature (1)..( 12): Result.005 file - promoters50/4281896
tcgatttttaaa

SEQ ID NO: 185715 - DNA, 12 bp, Unknown
  misc_feature (1)..( 12): Result.005 file - promoters50/4281896
tttattattact

SEQ ID NO: 185716 - DNA, 12 bp, Unknown
  misc_feature (1)..( 12): Result.005 file - promoters50/4281896
tcgactttatct

SEQ ID NO: 185717 - DNA, 12 bp, Unknown
  misc_feature (1)..( 12): Result.005 file - promoters50/4281896
agcttttttaga

SEQ ID NO: 185718 - DNA, 12 bp, Unknown
  misc_feature (1)..( 12): Result.005 file - promoters50/4281896
aaaattaatatt

SEQ ID NO: 185719 - DNA, 12 bp, Unknown
  misc_feature (1)..( 12): Result.005 file - promoters50/4281925
tgcaataaaaat

SEQ ID NO: 185720 - DNA, 12 bp, Unknown
  misc_feature (1)..( 12): Result.005 file - promoters50/4281925
aaaaattaaaac

SEQ ID NO: 185721 - DNA, 12 bp, Unknown
  misc_feature (1)..( 12): Result.005 file - promoters50/4281925
actaatcaaact

SEQ ID NO: 185722 - DNA, 12 bp, Unknown
  misc_feature (1)..( 12): Result.005 file - promoters50/4281925
taaaataacaca

SEQ ID NO: 185723 - DNA, 12 bp, Unknown
  misc_feature (1)..( 12): Result.005 file - promoters50/4281925
tataatatattc

SEQ ID NO: 185724 - DNA, 12 bp, Unknown
  misc_feature (1)..( 12): Result.005 file - promoters50/4281925
ttaaattattat

SEQ ID NO: 185725 - DNA, 12 bp, Unknown
  misc_feature (1)..( 12): Result.005 file - promoters50/4281925
aaaaattatact

SEQ ID NO: 185726 - DNA, 12 bp, Unknown
  misc_feature (1)..( 12): Result.005 file - promoters50/4281925
catactattaga

SEQ ID NO: 185727 - DNA, 14 bp, Unknown
  misc_feature (1)..( 14): Result.005 file - promoters50/4281925
atatctaaaagtag

SEQ ID NO: 185728 - DNA, 14 bp, Unknown
  misc_feature (1)..( 14): Result.005 file - promoters50/4281925
atttataaatgtat

SEQ ID NO: 185729 - DNA, 14 bp, Unknown
  misc_feature (1)..( 14): Result.005 file - promoters50/4281925
ttgaatgaaactag

SEQ ID NO: 185730 - DNA, 14 bp, Unknown
  misc_feature (1)..( 14): Result.005 file - promoters50/4281925
tatatacaaaatag

SEQ ID NO: 185731 - DNA, 14 bp, Unknown
  misc_feature (1)..( 14): Result.005 file - promoters50/4281925
aagactataaatat

SEQ ID NO: 185732 - DNA, 14 bp, Unknown
  misc_feature (1)..( 14): Result.005 file - promoters50/4281925
taatctaaatgcca

SEQ ID NO: 185733 - DNA, 14 bp, Unknown
  misc_feature (1)..( 14): Result.005 file - promoters50/4281925
aagattataaaaaa

SEQ ID NO: 185734 - DNA, 10 bp, Unknown
  misc_feature (1)..( 10): Result.005 file - promoters50/4281925
tgaattttta

SEQ ID NO: 185735 - DNA, 10 bp, Unknown
  misc_feature (1)..( 10): Result.005 file - promoters50/4281925
tgaagtttgg

SEQ ID NO: 185736 - DNA, 11 bp, Unknown
  misc_feature (1)..( 11): Result.005 file - promoters50/4281925
taaattattat

SEQ ID NO: 185737 - DNA, 11 bp, Unknown
  misc_feature (1)..( 11): Result.005 file - promoters50/4281925
ctaagttagtt

SEQ ID NO: 185738 - DNA, 11 bp, Unknown
  misc_feature (1)..( 11): Result.005 file - promoters50/4281925
aaaaattaaaa

SEQ ID NO: 185739 - DNA, 11 bp, Unknown
  misc_feature (1)..( 11): Result.005 file - promoters50/4281925
acaaaaattat

SEQ ID NO: 185740 - DNA, 9 bp, Unknown
  misc_feature (1)..( 9): Result.005 file - promoters50/4281961
aaagattgt

SEQ ID NO: 185741 - DNA, 9 bp, Unknown
  misc_feature (1)..( 9): Result.005 file - promoters50/4281961
gaagattga

SEQ ID NO: 185742 - DNA, 9 bp, Unknown
  misc_feature (1)..( 9): Result.005 file - promoters50/4281961
aaagattcc

SEQ ID NO: 185743 - DNA, 9 bp, Unknown
  misc_feature (1)..( 9): Result.005 file - promoters50/4281961
aaagcttgg

SEQ ID NO: 185744 - DNA, 9 bp, Unknown
  misc_feature (1)..( 9): Result.005 file - promoters50/4281961
agagattgt

SEQ ID NO: 185745 - DNA, 9 bp, Unknown
  misc_feature (1)..( 9): Result.005 file - promoters50/4281961
aaaaattta

SEQ ID NO: 185746 - DNA, 7 bp, Unknown
  misc_feature (1)..( 7): Result.005 file - promoters50/4281994
tatattt

SEQ ID NO: 185747 - DNA, 7 bp, Unknown
  misc_feature (1)..( 7): Result.005 file - promoters50/4281994
aatattt

SEQ ID NO: 185748 - DNA, 7 bp, Unknown
  misc_feature (1)..( 7): Result.005 file - promoters50/4281994
aatatta

SEQ ID NO: 185749 - DNA, 9 bp, Unknown
  misc_feature (1)..( 9): Result.005 file - promoters50/4281994
ataaaatta

SEQ ID NO: 185750 - DNA, 9 bp, Unknown
  misc_feature (1)..( 9): Result.005 file - promoters50/4281994
ataaaaatt

SEQ ID NO: 185751 - DNA, 9 bp, Unknown
  misc_feature (1)..( 9): Result.005 file - promoters50/4281994
ataatatta

SEQ ID NO: 185752 - DNA, 9 bp, Unknown
  misc_feature (1)..( 9): Result.005 file - promoters50/4281994
ataaaatta

SEQ ID NO: 185753 - DNA, 9 bp, Unknown
  misc_feature (1)..( 9): Result.005 file - promoters50/4281994
taaaaattt

SEQ ID NO: 185754 - DNA, 9 bp, Unknown
  misc_feature (1)..( 9): Result.005 file - promoters50/4281994
ataatatta

SEQ ID NO: 185755 - DNA, 10 bp, Unknown
  misc_feature (1)..( 10): Result.005 file - promoters50/4281994
attttaattt

SEQ ID NO: 185756 - DNA, 10 bp, Unknown
  misc_feature (1)..( 10): Result.005 file - promoters50/4281994
attttaaagt

SEQ ID NO: 185757 - DNA, 10 bp, Unknown
  misc_feature (1)..( 10): Result.005 file - promoters50/4281994
ttttcaattt

SEQ ID NO: 185758 - DNA, 9 bp, Unknown
  misc_feature (1)..( 9): Result.005 file - promoters50/4281994
tataactta

SEQ ID NO: 185759 - DNA, 9 bp, Unknown
  misc_feature (1)..( 9): Result.005 file - promoters50/4281994
attaaatta

SEQ ID NO: 185760 - DNA, 9 bp, Unknown
  misc_feature (1)..( 9): Result.005 file - promoters50/4281994
tataaaact

SEQ ID NO: 185761 - DNA, 15 bp, Unknown
  misc_feature (1)..( 15): Result.005 file - promoters50/4281997
agtttagggaaaatg

SEQ ID NO: 185762 - DNA, 15 bp, Unknown
  misc_feature (1)..( 15): Result.005 file - promoters50/4281997
agtttagggaaaatg

SEQ ID NO: 185763 - DNA, 15 bp, Unknown
  misc_feature (1)..( 15): Result.005 file - promoters50/4281997
ttagagcagaaaatg

SEQ ID NO: 185764 - DNA, 7 bp, Unknown
  misc_feature (1)..( 7): Result.005 file - promoters50/4281997
aattatc

SEQ ID NO: 185765 - DNA, 7 bp, Unknown
  misc_feature (1)..( 7): Result.005 file - promoters50/4281997
cattatc

SEQ ID NO: 185766 - DNA, 7 bp, Unknown
  misc_feature (1)..( 7): Result.005 file - promoters50/4281997
aattatc

SEQ ID NO: 185767 - DNA, 7 bp, Unknown
  misc_feature (1)..( 7): Result.005 file - promoters50/4281997
cattata

SEQ ID NO: 185768 - DNA, 8 bp, Unknown
  misc_feature (1)..( 8): Result.005 file - promoters50/4281997
aatgtttt

SEQ ID NO: 185769 - DNA, 8 bp, Unknown
  misc_feature (1)..( 8): Result.005 file - promoters50/4281997
aatatttt

SEQ ID NO: 185770 - DNA, 8 bp, Unknown
  misc_feature (1)..( 8): Result.005 file - promoters50/4281997
aatgtttt

SEQ ID NO: 185771 - DNA, 6 bp, Unknown
  misc_feature (1)..( 6): Result.005 file - promoters50/4281997
ttttac

SEQ ID NO: 185772 - DNA, 6 bp, Unknown
  misc_feature (1)..( 6): Result.005 file - promoters50/4281997
ttttac

SEQ ID NO: 185773 - DNA, 6 bp, Unknown
  misc_feature (1)..( 6): Result.005 file - promoters50/4281997
ttttac

SEQ ID NO: 185774 - DNA, 9 bp, Unknown
  misc_feature (1)..( 9): Result.005 file - promoters50/4281997
acattcaat

SEQ ID NO: 185775 - DNA, 9 bp, Unknown
  misc_feature (1)..( 9): Result.005 file - promoters50/4281997
acatttaat

SEQ ID NO: 185776 - DNA, 9 bp, Unknown
  misc_feature (1)..( 9): Result.005 file - promoters50/4281997
acattcaat

SEQ ID NO: 185777 - DNA, 6 bp, Unknown
  misc_feature (1)..( 6): Result.005 file - promoters50/4281997
cattat

SEQ ID NO: 185778 - DNA, 6 bp, Unknown
  misc_feature (1)..( 6): Result.005 file - promoters50/4281997
cattat

SEQ ID NO: 185779 - DNA, 6 bp, Unknown
  misc_feature (1)..( 6): Result.005 file - promoters50/4281997
cattat

SEQ ID NO: 185780 - DNA, 7 bp, Unknown
  misc_feature (1)..( 7): Result.005 file - promoters50/4281997
acgcaaa

SEQ ID NO: 185781 - DNA, 7 bp, Unknown
  misc_feature (1)..( 7): Result.005 file - promoters50/4281997
acggaaa

SEQ ID NO: 185782 - DNA, 7 bp, Unknown
  misc_feature (1)..( 7): Result.005 file - promoters50/4281997
acgcaaa

SEQ ID NO: 185783 - DNA, 7 bp, Unknown
  misc_feature (1)..( 7): Result.005 file - promoters50/4282012
aaattat

SEQ ID NO: 185784 - DNA, 7 bp, Unknown
  misc_feature (1)..( 7): Result.005 file - promoters50/4282012
aaattat

SEQ ID NO: 185785 - DNA, 7 bp, Unknown
  misc_feature (1)..( 7): Result.005 file - promoters50/4282012
caattat

SEQ ID NO: 185786 - DNA, 9 bp, Unknown
  misc_feature (1)..( 9): Result.005 file - promoters50/4282059
cgaaacttc

SEQ ID NO: 185787 - DNA, 9 bp, Unknown
  misc_feature (1)..( 9): Result.005 file - promoters50/4282059
aaaaacttt

SEQ ID NO: 185788 - DNA, 9 bp, Unknown
  misc_feature (1)..( 9): Result.005 file - promoters50/4282059
aaaaacttt

SEQ ID NO: 185789 - DNA, 8 bp, Unknown
  misc_feature (1)..( 8): Result.005 file - promoters50/4282066
gataaaga

SEQ ID NO: 185790 - DNA, 8 bp, Unknown
  misc_feature (1)..( 8): Result.005 file - promoters50/4282066
gataaaga

SEQ ID NO: 185791 - DNA, 8 bp, Unknown
  misc_feature (1)..( 8): Result.005 file - promoters50/4282066
gattaaga

SEQ ID NO: 185792 - DNA, 8 bp, Unknown
  misc_feature (1)..( 8): Result.005 file - promoters50/4282066
gataaaat

SEQ ID NO: 185793 - DNA, 8 bp, Unknown
  misc_feature (1)..( 8): Result.005 file - promoters50/4282066
gaagttga

SEQ ID NO: 185794 - DNA, 8 bp, Unknown
  misc_feature (1)..( 8): Result.005 file - promoters50/4282066
gaagttga

SEQ ID NO: 185795 - DNA, 8 bp, Unknown
  misc_feature (1)..( 8): Result.005 file - promoters50/4282066
gaatttgt

SEQ ID NO: 185796 - DNA, 11 bp, Unknown
  misc_feature (1)..( 11): Result.005 file - promoters50/4282066
tgaagttgact

SEQ ID NO: 185797 - DNA, 11 bp, Unknown
  misc_feature (1)..( 11): Result.005 file - promoters50/4282066
gggagttcact

SEQ ID NO: 185798 - DNA, 11 bp, Unknown
  misc_feature (1)..( 11): Result.005 file - promoters50/4282066
tgaatttgtac

SEQ ID NO: 185799 - DNA, 10 bp, Unknown
  misc_feature (1)..( 10): Result.005 file - promoters50/4282066
cagttttttt

SEQ ID NO: 185800 - DNA, 10 bp, Unknown
  misc_feature (1)..( 10): Result.005 file - promoters50/4282066
gagtgttttt

SEQ ID NO: 185801 - DNA, 10 bp, Unknown
  misc_feature (1)..( 10): Result.005 file - promoters50/4282066
gagagtttta

SEQ ID NO: 185802 - DNA, 8 bp, Unknown
  misc_feature (1)..( 8): Result.005 file - promoters50/4282066
tggatcgg

SEQ ID NO: 185803 - DNA, 8 bp, Unknown
  misc_feature (1)..( 8): Result.005 file - promoters50/4282066
tggttcgg

SEQ ID NO: 185804 - DNA, 8 bp, Unknown
  misc_feature (1)..( 8): Result.005 file - promoters50/4282066
tggatcgg

SEQ ID NO: 185805 - DNA, 7 bp, Unknown
  misc_feature (1)..( 7): Result.005 file - promoters50/4282066
agtttga

SEQ ID NO: 185806 - DNA, 7 bp, Unknown
  misc_feature (1)..( 7): Result.005 file - promoters50/4282066
ggtttga

SEQ ID NO: 185807 - DNA, 7 bp, Unknown
  misc_feature (1)..( 7): Result.005 file - promoters50/4282066
ggtgtga

SEQ ID NO: 185808 - DNA, 7 bp, Unknown
  misc_feature (1)..( 7): Result.005 file - promoters50/4282072
caacaac

SEQ ID NO: 185809 - DNA, 7 bp, Unknown
  misc_feature (1)..( 7): Result.005 file - promoters50/4282072
caaaaac

SEQ ID NO: 185810 - DNA, 7 bp, Unknown
  misc_feature (1)..( 7): Result.005 file - promoters50/4282072
caacaat

SEQ ID NO: 185811 - DNA, 7 bp, Unknown
  misc_feature (1)..( 7): Result.005 file - promoters50/4282072
caaaaat

SEQ ID NO: 185812 - DNA, 9 bp, Unknown
  misc_feature (1)..( 9): Result.005 file - promoters50/4282072
aacaacatc

SEQ ID NO: 185813 - DNA, 9 bp, Unknown
  misc_feature (1)..( 9): Result.005 file - promoters50/4282072
ttcaaaatc

SEQ ID NO: 185814 - DNA, 9 bp, Unknown
  misc_feature (1)..( 9): Result.005 file - promoters50/4282072
ttcaaaaat

SEQ ID NO: 185815 - DNA, 9 bp, Unknown
  misc_feature (1)..( 9): Result.005 file - promoters50/4282072
ctcaaaaat

SEQ ID NO: 185816 - DNA, 9 bp, Unknown
  misc_feature (1)..( 9): Result.005 file - promoters50/4282072
ctttctttt

SEQ ID NO: 185817 - DNA, 9 bp, Unknown
  misc_feature (1)..( 9): Result.005 file - promoters50/4282072
atttgtttt

SEQ ID NO: 185818 - DNA, 9 bp, Unknown
  misc_feature (1)..( 9): Result.005 file - promoters50/4282072
acatgtttt

SEQ ID NO: 185819 - DNA, 9 bp, Unknown
  misc_feature (1)..( 9): Result.005 file - promoters50/4282072
atttgtgac

SEQ ID NO: 185820 - DNA, 10 bp, Unknown
  misc_feature (1)..( 10): Result.005 file - promoters50/4282086
gctctgcttt

SEQ ID NO: 185821 - DNA, 10 bp, Unknown
  misc_feature (1)..( 10): Result.005 file - promoters50/4282086
aatctgcttt

SEQ ID NO: 185822 - DNA, 10 bp, Unknown
  misc_feature (1)..( 10): Result.005 file - promoters50/4282086
aatttgctcc

SEQ ID NO: 185823 - DNA, 11 bp, Unknown
  misc_feature (1)..( 11): Result.005 file - promoters50/4282126
aatttatagtt

SEQ ID NO: 185824 - DNA, 11 bp, Unknown
  misc_feature (1)..( 11): Result.005 file - promoters50/4282126
aatttaaaaga

SEQ ID NO: 185825 - DNA, 11 bp, Unknown
  misc_feature (1)..( 11): Result.005 file - promoters50/4282126
aatttattgtt

SEQ ID NO: 185826 - DNA, 8 bp, Unknown
  misc_feature (1)..( 8): Result.005 file - promoters50/4282126
tttctaat

SEQ ID NO: 185827 - DNA, 8 bp, Unknown
  misc_feature (1)..( 8): Result.005 file - promoters50/4282126
tttgtaat

SEQ ID NO: 185828 - DNA, 8 bp, Unknown
  misc_feature (1)..( 8): Result.005 file - promoters50/4282126
tttgcaat

SEQ ID NO: 185829 - DNA, 8 bp, Unknown
  misc_feature (1)..( 8): Result.005 file - promoters50/4282145
gagacaaa

SEQ ID NO: 185830 - DNA, 8 bp, Unknown
  misc_feature (1)..( 8): Result.005 file - promoters50/4282145
ttgacaaa

SEQ ID NO: 185831 - DNA, 8 bp, Unknown
  misc_feature (1)..( 8): Result.005 file - promoters50/4282145
ttggcaat

SEQ ID NO: 185832 - DNA, 8 bp, Unknown
  misc_feature (1)..( 8): Result.005 file - promoters50/4282145
aatactaa

SEQ ID NO: 185833 - DNA, 8 bp, Unknown
  misc_feature (1)..( 8): Result.005 file - promoters50/4282145
tataataa

SEQ ID NO: 185834 - DNA, 8 bp, Unknown
  misc_feature (1)..( 8): Result.005 file - promoters50/4282145
tattatac

SEQ ID NO: 185835 - DNA, 11 bp, Unknown
  misc_feature (1)..( 11): Result.005 file - promoters50/4282145
aataaaagtaa

SEQ ID NO: 185836 - DNA, 11 bp, Unknown
  misc_feature (1)..( 11): Result.005 file - promoters50/4282145
aattaaatatt

SEQ ID NO: 185837 - DNA, 11 bp, Unknown
  misc_feature (1)..( 11): Result.005 file - promoters50/4282145
gctaaaagact

SEQ ID NO: 185838 - DNA, 11 bp, Unknown
  misc_feature (1)..( 11): Result.005 file - promoters50/4282145
gcaaaaagtaa

SEQ ID NO: 185839 - DNA, 10 bp, Unknown
  misc_feature (1)..( 10): Result.005 file - promoters50/4282145
agagatgatt

SEQ ID NO: 185840 - DNA, 10 bp, Unknown
  misc_feature (1)..( 10): Result.005 file - promoters50/4282145
gaaaatgatt

SEQ ID NO: 185841 - DNA, 10 bp, Unknown
  misc_feature (1)..( 10): Result.005 file - promoters50/4282145
gaaactgata

SEQ ID NO: 185842 - DNA, 10 bp, Unknown
  misc_feature (1)..( 10): Result.005 file - promoters50/4282145
gaagatgatt

SEQ ID NO: 185843 - DNA, 8 bp, Unknown
  misc_feature (1)..( 8): Result.005 file - promoters50/4282145
aaattaca

SEQ ID NO: 185844 - DNA, 8 bp, Unknown
  misc_feature (1)..( 8): Result.005 file - promoters50/4282145
aaattaac

SEQ ID NO: 185845 - DNA, 8 bp, Unknown
  misc_feature (1)..( 8): Result.005 file - promoters50/4282145
gaatgaca

SEQ ID NO: 185846 - DNA, 10 bp, Unknown
  misc_feature (1)..( 10): Result.005 file - promoters50/4282182
tgaatgaaac

SEQ ID NO: 185847 - DNA, 10 bp, Unknown
  misc_feature (1)..( 10): Result.005 file - promoters50/4282182
tgactgattt

SEQ ID NO: 185848 - DNA, 10 bp, Unknown
  misc_feature (1)..( 10): Result.005 file - promoters50/4282182
taaataaaag

SEQ ID NO: 185849 - DNA, 10 bp, Unknown
  misc_feature (1)..( 10): Result.005 file - promoters50/4282182
agaaagaaag

SEQ ID NO: 185850 - DNA, 10 bp, Unknown
  misc_feature (1)..( 10): Result.005 file - promoters50/4282182
tcactaattc

SEQ ID NO: 185851 - DNA, 10 bp, Unknown
  misc_feature (1)..( 10): Result.005 file - promoters50/4282182
gaaaacaaaa

SEQ ID NO: 185852 - DNA, 11 bp, Unknown
  misc_feature (1)..( 11): Result.005 file - promoters50/4282182
acaaaatttat

SEQ ID NO: 185853 - DNA, 11 bp, Unknown
  misc_feature (1)..( 11): Result.005 file - promoters50/4282182
acaacatttaa

SEQ ID NO: 185854 - DNA, 11 bp, Unknown
  misc_feature (1)..( 11): Result.005 file - promoters50/4282182
cgaaaaataaa

SEQ ID NO: 185855 - DNA, 11 bp, Unknown
  misc_feature (1)..( 11): Result.005 file - promoters50/4282182
gactgatttaa

SEQ ID NO: 185856 - DNA, 11 bp, Unknown
  misc_feature (1)..( 11): Result.005 file - promoters50/4282182
agaaaaaacca

SEQ ID NO: 185857 - DNA, 11 bp, Unknown
  misc_feature (1)..( 11): Result.005 file - promoters50/4282182
tggaaaacaaa

SEQ ID NO: 185858 - DNA, 11 bp, Unknown
  misc_feature (1)..( 11): Result.005 file - promoters50/4282182
agagaaagaaa

SEQ ID NO: 185859 - DNA, 10 bp, Unknown
  misc_feature (1)..( 10): Result.005 file - promoters50/4282182
accttttttt

SEQ ID NO: 185860 - DNA, 10 bp, Unknown
  misc_feature (1)..( 10): Result.005 file - promoters50/4282182
ttcttgtttg

SEQ ID NO: 185861 - DNA, 11 bp, Unknown
  misc_feature (1)..( 11): Result.005 file - promoters50/4282182
acctttatttt

SEQ ID NO: 185862 - DNA, 11 bp, Unknown
  misc_feature (1)..( 11): Result.005 file - promoters50/4282182
tatattgtata

SEQ ID NO: 185863 - DNA, 11 bp, Unknown
  misc_feature (1)..( 11): Result.005 file - promoters50/4282182
ccaaatgtttg

SEQ ID NO: 185864 - DNA, 11 bp, Unknown
  misc_feature (1)..( 11): Result.005 file - promoters50/4282182
gccattatctt

SEQ ID NO: 185865 - DNA, 10 bp, Unknown
  misc_feature (1)..( 10): Result.005 file - promoters50/4282186
attttgttaa

SEQ ID NO: 185866 - DNA, 10 bp, Unknown
  misc_feature (1)..( 10): Result.005 file - promoters50/4282186
tttttgtttt

SEQ ID NO: 185867 - DNA, 10 bp, Unknown
  misc_feature (1)..( 10): Result.005 file - promoters50/4282186
attttggtca

SEQ ID NO: 185868 - DNA, 10 bp, Unknown
  misc_feature (1)..( 10): Result.005 file - promoters50/4282186
tttttgttta

SEQ ID NO: 185869 - DNA, 10 bp, Unknown
  misc_feature (1)..( 10): Result.005 file - promoters50/4282186
tgtttatttg

SEQ ID NO: 185870 - DNA, 10 bp, Unknown
  misc_feature (1)..( 10): Result.005 file - promoters50/4282186
tttttatttc

SEQ ID NO: 185871 - DNA, 14 bp, Unknown
  misc_feature (1)..( 14): Result.005 file - promoters50/4282186
ctaaaattttcaat

SEQ ID NO: 185872 - DNA, 14 bp, Unknown
  misc_feature (1)..( 14): Result.005 file - promoters50/4282186
atcaaatttgttat

SEQ ID NO: 185873 - DNA, 14 bp, Unknown
  misc_feature (1)..( 14): Result.005 file - promoters50/4282186
atgaaatttttcgt

SEQ ID NO: 185874 - DNA, 14 bp, Unknown
  misc_feature (1)..( 14): Result.005 file - promoters50/4282186
caaaaatttatgta

SEQ ID NO: 185875 - DNA, 14 bp, Unknown
  misc_feature (1)..( 14): Result.005 file - promoters50/4282186
cgatcttttctcgt

SEQ ID NO: 185876 - DNA, 14 bp, Unknown
  misc_feature (1)..( 14): Result.005 file - promoters50/4282186
caaaaagcaaaaaa

SEQ ID NO: 185877 - DNA, 12 bp, Unknown
  misc_feature (1)..( 12): Result.005 file - promoters50/4282198
aaataaaatgaa

SEQ ID NO: 185878 - DNA, 12 bp, Unknown
  misc_feature (1)..( 12): Result.005 file - promoters50/4282198
acgtaaaaggaa

SEQ ID NO: 185879 - DNA, 12 bp, Unknown
  misc_feature (1)..( 12): Result.005 file - promoters50/4282198
aattaaacaaag

SEQ ID NO: 185880 - DNA, 14 bp, Unknown
  misc_feature (1)..( 14): Result.005 file - promoters50/4282198
ccactaatacaaca

SEQ ID NO: 185881 - DNA, 14 bp, Unknown
  misc_feature (1)..( 14): Result.005 file - promoters50/4282198
ccattaatacaaat

SEQ ID NO: 185882 - DNA, 14 bp, Unknown
  misc_feature (1)..( 14): Result.005 file - promoters50/4282198
ggaataacacaaca

SEQ ID NO: 185883 - DNA, 15 bp, Unknown
  misc_feature (1)..( 15): Result.005 file - promoters50/4282202
aaatagaaaacatac

SEQ ID NO: 185884 - DNA, 15 bp, Unknown
  misc_feature (1)..( 15): Result.005 file - promoters50/4282202
caaccaaaaccatac

SEQ ID NO: 185885 - DNA, 15 bp, Unknown
  misc_feature (1)..( 15): Result.005 file - promoters50/4282202
aaataaaaaacaaaa

SEQ ID NO: 185886 - DNA, 15 bp, Unknown
  misc_feature (1)..( 15): Result.005 file - promoters50/4282202
actacgaatacattc

SEQ ID NO: 185887 - DNA, 8 bp, Unknown
  misc_feature (1)..( 8): Result.005 file - promoters50/4282202
caaaacca

SEQ ID NO: 185888 - DNA, 8 bp, Unknown
  misc_feature (1)..( 8): Result.005 file - promoters50/4282202
caaaacat

SEQ ID NO: 185889 - DNA, 8 bp, Unknown
  misc_feature (1)..( 8): Result.005 file - promoters50/4282202
caagacat

SEQ ID NO: 185890 - DNA, 8 bp, Unknown
  misc_feature (1)..( 8): Result.005 file - promoters50/4282202
caaaacaa

SEQ ID NO: 185891 - DNA, 10 bp, Unknown
  misc_feature (1)..( 10): Result.005 file - promoters50/4282251
gaacaagaaa

SEQ ID NO: 185892 - DNA, 10 bp, Unknown
  misc_feature (1)..( 10): Result.005 file - promoters50/4282251
gttcaaaaaa

SEQ ID NO: 185893 - DNA, 10 bp, Unknown
  misc_feature (1)..( 10): Result.005 file - promoters50/4282251
gttcgaaact

SEQ ID NO: 185894 - DNA, 8 bp, Unknown
  misc_feature (1)..( 8): Result.005 file - promoters50/4282251
caaataag

SEQ ID NO: 185895 - DNA, 8 bp, Unknown
  misc_feature (1)..( 8): Result.005 file - promoters50/4282251
caaaaaag

SEQ ID NO: 185896 - DNA, 8 bp, Unknown
  misc_feature (1)..( 8): Result.005 file - promoters50/4282251
caaatatg

SEQ ID NO: 185897 - DNA, 8 bp, Unknown
  misc_feature (1)..( 8): Result.005 file - promoters50/4282251
tgaatgat

SEQ ID NO: 185898 - DNA, 8 bp, Unknown
  misc_feature (1)..( 8): Result.005 file - promoters50/4282251
agaaggat

SEQ ID NO: 185899 - DNA, 8 bp, Unknown
  misc_feature (1)..( 8): Result.005 file - promoters50/4282251
tgattgag

SEQ ID NO: 185900 - DNA, 12 bp, Unknown
  misc_feature (1)..( 12): Result.005 file - promoters50/4282251
gtagatttgtat

SEQ ID NO: 185901 - DNA, 12 bp, Unknown
  misc_feature (1)..( 12): Result.005 file - promoters50/4282251
gtacatttgtaa

SEQ ID NO: 185902 - DNA, 12 bp, Unknown
  misc_feature (1)..( 12): Result.005 file - promoters50/4282251
gttggtttgtat

SEQ ID NO: 185903 - DNA, 7 bp, Unknown
  misc_feature (1)..( 7): Result.005 file - promoters50/4282292
aaattag

SEQ ID NO: 185904 - DNA, 7 bp, Unknown
  misc_feature (1)..( 7): Result.005 file - promoters50/4282292
aaattaa

SEQ ID NO: 185905 - DNA, 7 bp, Unknown
  misc_feature (1)..( 7): Result.005 file - promoters50/4282292
aaaataa

SEQ ID NO: 185906 - DNA, 8 bp, Unknown
  misc_feature (1)..( 8): Result.005 file - promoters50/4282292
aaaacaaa

SEQ ID NO: 185907 - DNA, 8 bp, Unknown
  misc_feature (1)..( 8): Result.005 file - promoters50/4282292
aaagcaaa

SEQ ID NO: 185908 - DNA, 9 bp, Unknown
  misc_feature (1)..( 9): Result.005 file - promoters50/4282292
acagctaaa

SEQ ID NO: 185909 - DNA, 8 bp, Unknown
  misc_feature (1)..( 8): Result.005 file - promoters50/4282308
gttacaat

SEQ ID NO: 185910 - DNA, 8 bp, Unknown
  misc_feature (1)..( 8): Result.005 file - promoters50/4282308
gttccaat

SEQ ID NO: 185911 - DNA, 8 bp, Unknown
  misc_feature (1)..( 8): Result.005 file - promoters50/4282308
gttacaag

SEQ ID NO: 185912 - DNA, 10 bp, Unknown
  misc_feature (1)..( 10): Result.005 file - promoters50/4282308
caattaatac

SEQ ID NO: 185913 - DNA, 10 bp, Unknown
  misc_feature (1)..( 10): Result.005 file - promoters50/4282308
tgattattac

SEQ ID NO: 185914 - DNA, 10 bp, Unknown
  misc_feature (1)..( 10): Result.005 file - promoters50/4282308
tgattattgc

SEQ ID NO: 185915 - DNA, 14 bp, Unknown
  misc_feature (1)..( 14): Result.005 file - promoters50/4282308
aatgagtaatatac

SEQ ID NO: 185916 - DNA, 14 bp, Unknown
  misc_feature (1)..( 14): Result.005 file - promoters50/4282308
aataagttatatac

SEQ ID NO: 185917 - DNA, 14 bp, Unknown
  misc_feature (1)..( 14): Result.005 file - promoters50/4282308
cctaatttatcatt

SEQ ID NO: 185918 - DNA, 6 bp, Unknown
  misc_feature (1)..( 6): Result.005 file - promoters50/4282308
tcaaaa

SEQ ID NO: 185919 - DNA, 6 bp, Unknown
  misc_feature (1)..( 6): Result.005 file - promoters50/4282308
tcaaaa

SEQ ID NO: 185920 - DNA, 6 bp, Unknown
  misc_feature (1)..( 6): Result.005 file - promoters50/4282308
tcaaaa

SEQ ID NO: 185921 - DNA, 18 bp, Unknown
  misc_feature (1)..( 18): Result.005 file - promoters50/4282316
aaatgtttttaccataat

SEQ ID NO: 185922 - DNA, 18 bp, Unknown
  misc_feature (1)..( 18): Result.005 file - promoters50/4282316
caatattttactaatctc

SEQ ID NO: 185923 - DNA, 18 bp, Unknown
  misc_feature (1)..( 18): Result.005 file - promoters50/4282316
aaaagtttagggaaaatg

SEQ ID NO: 185924 - DNA, 15 bp, Unknown
  misc_feature (1)..( 15): Result.005 file - promoters50/4282316
agtttagggaaaatg

SEQ ID NO: 185925 - DNA, 7 bp, Unknown
  misc_feature (1)..( 7): Result.005 file - promoters50/4282316
cattata

SEQ ID NO: 185926 - DNA, 7 bp, Unknown
  misc_feature (1)..( 7): Result.005 file - promoters50/4282316
cattatc

SEQ ID NO: 185927 - DNA, 7 bp, Unknown
  misc_feature (1)..( 7): Result.005 file - promoters50/4282316
aattatc

SEQ ID NO: 185928 - DNA, 7 bp, Unknown
  misc_feature (1)..( 7): Result.005 file - promoters50/4282316
aattatc

SEQ ID NO: 185929 - DNA, 7 bp, Unknown
  misc_feature (1)..( 7): Result.005 file - promoters50/4282316
gaaaatg

SEQ ID NO: 185930 - DNA, 7 bp, Unknown
  misc_feature (1)..( 7): Result.005 file - promoters50/4282316
gaaaatg

SEQ ID NO: 185931 - DNA, 7 bp, Unknown
  misc_feature (1)..( 7): Result.005 file - promoters50/4282316
gaaaatg

SEQ ID NO: 185932 - DNA, 8 bp, Unknown
  misc_feature (1)..( 8): Result.005 file - promoters50/4282316
aatatttt

SEQ ID NO: 185933 - DNA, 8 bp, Unknown
  misc_feature (1)..( 8): Result.005 file - promoters50/4282316
aatgtttt

SEQ ID NO: 185934 - DNA, 8 bp, Unknown
  misc_feature (1)..( 8): Result.005 file - promoters50/4282316
aatgtttt

SEQ ID NO: 185935 - DNA, 6 bp, Unknown
  misc_feature (1)..( 6): Result.005 file - promoters50/4282316
ttttac

SEQ ID NO: 185936 - DNA, 6 bp, Unknown
  misc_feature (1)..( 6): Result.005 file - promoters50/4282316
ttttac

SEQ ID NO: 185937 - DNA, 6 bp, Unknown
  misc_feature (1)..( 6): Result.005 file - promoters50/4282316
ttttac

SEQ ID NO: 185938 - DNA, 9 bp, Unknown
  misc_feature (1)..( 9): Result.005 file - promoters50/4282316
acatttaat

SEQ ID NO: 185939 - DNA, 9 bp, Unknown
  misc_feature (1)..( 9): Result.005 file - promoters50/4282316
acattcaat

SEQ ID NO: 185940 - DNA, 9 bp, Unknown
  misc_feature (1)..( 9): Result.005 file - promoters50/4282316
acattcaat

SEQ ID NO: 185941 - DNA, 6 bp, Unknown
  misc_feature (1)..( 6): Result.005 file - promoters50/4282316
cattat

SEQ ID NO: 185942 - DNA, 6 bp, Unknown
  misc_feature (1)..( 6): Result.005 file - promoters50/4282316
cattat

SEQ ID NO: 185943 - DNA, 6 bp, Unknown
  misc_feature (1)..( 6): Result.005 file - promoters50/4282316
cattat

SEQ ID NO: 185944 - DNA, 7 bp, Unknown
  misc_feature (1)..( 7): Result.005 file - promoters50/4282316
acggaaa

SEQ ID NO: 185945 - DNA, 7 bp, Unknown
  misc_feature (1)..( 7): Result.005 file - promoters50/4282316
acgcaaa

SEQ ID NO: 185946 - DNA, 7 bp, Unknown
  misc_feature (1)..( 7): Result.005 file - promoters50/4282316
acgcaaa

SEQ ID NO: 185947 - DNA, 7 bp, Unknown
  misc_feature (1)..( 7): Result.005 file - promoters50/4282320
ctgaagt

SEQ ID NO: 185948 - DNA, 7 bp, Unknown
  misc_feature (1)..( 7): Result.005 file - promoters50/4282320
ttgaagt

SEQ ID NO: 185949 - DNA, 7 bp, Unknown
  misc_feature (1)..( 7): Result.005 file - promoters50/4282320
ttgaaga

SEQ ID NO: 185950 - DNA, 10 bp, Unknown
  misc_feature (1)..( 10): Result.005 file - promoters50/4282324
aataaaaatc

SEQ ID NO: 185951 - DNA, 10 bp, Unknown
  misc_feature (1)..( 10): Result.005 file - promoters50/4282324
aattaaaatt

SEQ ID NO: 185952 - DNA, 10 bp, Unknown
  misc_feature (1)..( 10): Result.005 file - promoters50/4282324
aacaaaaatg

SEQ ID NO: 185953 - DNA, 10 bp, Unknown
  misc_feature (1)..( 10): Result.005 file - promoters50/4282324
gatttaaatt

SEQ ID NO: 185954 - DNA, 10 bp, Unknown
  misc_feature (1)..( 10): Result.005 file - promoters50/4282324
ctttttaatt

SEQ ID NO: 185955 - DNA, 10 bp, Unknown
  misc_feature (1)..( 10): Result.005 file - promoters50/4282324
ggttttaatc

SEQ ID NO: 185956 - DNA, 10 bp, Unknown
  misc_feature (1)..( 10): Result.005 file - promoters50/4282324
aattttaaga

SEQ ID NO: 185957 - DNA, 19 bp, Unknown
  misc_feature (1)..( 19): Result.005 file - promoters50/4282324
gttaggtaaactaaagaca

SEQ ID NO: 185958 - DNA, 19 bp, Unknown
  misc_feature (1)..( 19): Result.005 file - promoters50/4282324
aaaatttctactaaaggga

SEQ ID NO: 185959 - DNA, 19 bp, Unknown
  misc_feature (1)..( 19): Result.005 file - promoters50/4282324
agattttttaccaaacaaa

SEQ ID NO: 185960 - DNA, 19 bp, Unknown
  misc_feature (1)..( 19): Result.005 file - promoters50/4282324
tttttcttgactaaaccaa

SEQ ID NO: 185961 - DNA, 19 bp, Unknown
  misc_feature (1)..( 19): Result.005 file - promoters50/4282324
agatttgttagagagaaag

SEQ ID NO: 185962 - DNA, 19 bp, Unknown
  misc_feature (1)..( 19): Result.005 file - promoters50/4282324
taatttgtttgaataattc

SEQ ID NO: 185963 - DNA, 19 bp, Unknown
  misc_feature (1)..( 19): Result.005 file - promoters50/4282324
atatacacatccaatcaaa

SEQ ID NO: 185964 - DNA, 19 bp, Unknown
  misc_feature (1)..( 19): Result.005 file - promoters50/4282324
agaacgtgaactaaatcaa

SEQ ID NO: 185965 - DNA, 15 bp, Unknown
  misc_feature (1)..( 15): Result.005 file - promoters50/4282324
ttaattataacgaat

SEQ ID NO: 185966 - DNA, 15 bp, Unknown
  misc_feature (1)..( 15): Result.005 file - promoters50/4282324
ttaattctatgtatt

SEQ ID NO: 185967 - DNA, 15 bp, Unknown
  misc_feature (1)..( 15): Result.005 file - promoters50/4282324
ttagttatatgactt

SEQ ID NO: 185968 - DNA, 15 bp, Unknown
  misc_feature (1)..( 15): Result.005 file - promoters50/4282324
ctaattttaagaaga

SEQ ID NO: 185969 - DNA, 15 bp, Unknown
  misc_feature (1)..( 15): Result.005 file - promoters50/4282324
ttcatttgaagtttt

SEQ ID NO: 185970 - DNA, 15 bp, Unknown
  misc_feature (1)..( 15): Result.005 file - promoters50/4282324
ctattttttttgatt

SEQ ID NO: 185971 - DNA, 11 bp, Unknown
  misc_feature (1)..( 11): Result.005 file - promoters50/4282324
ttaattataac

SEQ ID NO: 185972 - DNA, 11 bp, Unknown
  misc_feature (1)..( 11): Result.005 file - promoters50/4282324
taaattataaa

SEQ ID NO: 185973 - DNA, 11 bp, Unknown
  misc_feature (1)..( 11): Result.005 file - promoters50/4282324
ttagttatatg

SEQ ID NO: 185974 - DNA, 11 bp, Unknown
  misc_feature (1)..( 11): Result.005 file - promoters50/4282324
ctaattttaag

SEQ ID NO: 185975 - DNA, 11 bp, Unknown
  misc_feature (1)..( 11): Result.005 file - promoters50/4282324
ttcatttgaag

SEQ ID NO: 185976 - DNA, 11 bp, Unknown
  misc_feature (1)..( 11): Result.005 file - promoters50/4282324
ttctttttaat

SEQ ID NO: 185977 - DNA, 7 bp, Unknown
  misc_feature (1)..( 7): Result.005 file - promoters50/4282327
ttaaaaa

SEQ ID NO: 185978 - DNA, 7 bp, Unknown
  misc_feature (1)..( 7): Result.005 file - promoters50/4282327
ttaaaac

SEQ ID NO: 185979 - DNA, 7 bp, Unknown
  misc_feature (1)..( 7): Result.005 file - promoters50/4282327
ctaaaac

SEQ ID NO: 185980 - DNA, 9 bp, Unknown
  misc_feature (1)..( 9): Result.005 file - promoters50/4282327
acaataagt

SEQ ID NO: 185981 - DNA, 9 bp, Unknown
  misc_feature (1)..( 9): Result.005 file - promoters50/4282327
ttaattagt

SEQ ID NO: 185982 - DNA, 9 bp, Unknown
  misc_feature (1)..( 9): Result.005 file - promoters50/4282327
ttaattagc

SEQ ID NO: 185983 - DNA, 8 bp, Unknown
  misc_feature (1)..( 8): Result.005 file - promoters50/4282327
gaaaagtg

SEQ ID NO: 185984 - DNA, 8 bp, Unknown
  misc_feature (1)..( 8): Result.005 file - promoters50/4282327
gaaaagaa

SEQ ID NO: 185985 - DNA, 8 bp, Unknown
  misc_feature (1)..( 8): Result.005 file - promoters50/4282327
caaaagaa

SEQ ID NO: 185986 - DNA, 9 bp, Unknown
  misc_feature (1)..( 9): Result.005 file - promoters50/4282327
cttaataac

SEQ ID NO: 185987 - DNA, 9 bp, Unknown
  misc_feature (1)..( 9): Result.005 file - promoters50/4282327
cttaattag

SEQ ID NO: 185988 - DNA, 9 bp, Unknown
  misc_feature (1)..( 9): Result.005 file - promoters50/4282327
attaattag

SEQ ID NO: 185989 - DNA, 12 bp, Unknown
  misc_feature (1)..( 12): Result.005 file - promoters50/4282329
atactagctgac

SEQ ID NO: 185990 - DNA, 12 bp, Unknown
  misc_feature (1)..( 12): Result.005 file - promoters50/4282329
aaccttgctgac

SEQ ID NO: 185991 - DNA, 12 bp, Unknown
  misc_feature (1)..( 12): Result.005 file - promoters50/4282329
aacctttctgaa

SEQ ID NO: 185992 - DNA, 7 bp, Unknown
  misc_feature (1)..( 7): Result.005 file - promoters50/4282406
aaaaaaa

SEQ ID NO: 185993 - DNA, 7 bp, Unknown
  misc_feature (1)..( 7): Result.005 file - promoters50/4282406
aaataaa

SEQ ID NO: 185994 - DNA, 7 bp, Unknown
  misc_feature (1)..( 7): Result.005 file - promoters50/4282406
aaacaat

SEQ ID NO: 185995 - DNA, 10 bp, Unknown
  misc_feature (1)..( 10): Result.005 file - promoters50/4282406
ataatgtaat

SEQ ID NO: 185996 - DNA, 10 bp, Unknown
  misc_feature (1)..( 10): Result.005 file - promoters50/4282406
ataatataat

SEQ ID NO: 185997 - DNA, 10 bp, Unknown
  misc_feature (1)..( 10): Result.005 file - promoters50/4282406
gtaaagtact

SEQ ID NO: 185998 - DNA, 13 bp, Unknown
  misc_feature (1)..( 13): Result.005 file - promoters50/4282406
caaaaacaatttt

SEQ ID NO: 185999 - DNA, 13 bp, Unknown
  misc_feature (1)..( 13): Result.005 file - promoters50/4282406
caaaatcaaatag

SEQ ID NO: 186000 - DNA, 13 bp, Unknown
  misc_feature (1)..( 13): Result.005 file - promoters50/4282406
aaaaaactatttt

SEQ ID NO: 186001 - DNA, 8 bp, Unknown
  misc_feature (1)..( 8): Result.005 file - promoters50/4282406
tctagact

SEQ ID NO: 186002 - DNA, 8 bp, Unknown
  misc_feature (1)..( 8): Result.005 file - promoters50/4282406
tctatact

SEQ ID NO: 186003 - DNA, 8 bp, Unknown
  misc_feature (1)..( 8): Result.005 file - promoters50/4282406
actaaact

SEQ ID NO: 186004 - DNA, 8 bp, Unknown
  misc_feature (1)..( 8): Result.005 file - promoters50/4282414
atttctac

SEQ ID NO: 186005 - DNA, 8 bp, Unknown
  misc_feature (1)..( 8): Result.005 file - promoters50/4282414
ttttctat

SEQ ID NO: 186006 - DNA, 8 bp, Unknown
  misc_feature (1)..( 8): Result.005 file - promoters50/4282414
atttctta

SEQ ID NO: 186007 - DNA, 8 bp, Unknown
  misc_feature (1)..( 8): Result.005 file - promoters50/4282414
ttttctaa

SEQ ID NO: 186008 - DNA, 8 bp, Unknown
  misc_feature (1)..( 8): Result.005 file - promoters50/4282414
ctttctag

SEQ ID NO: 186009 - DNA, 8 bp, Unknown
  misc_feature (1)..( 8): Result.005 file - promoters50/4282414
gattctat

SEQ ID NO: 186010 - DNA, 12 bp, Unknown
  misc_feature (1)..( 12): Result.005 file - promoters50/4282414
aaggcagtaact

SEQ ID NO: 186011 - DNA, 12 bp, Unknown
  misc_feature (1)..( 12): Result.005 file - promoters50/4282414
caagcattaacc

SEQ ID NO: 186012 - DNA, 12 bp, Unknown
  misc_feature (1)..( 12): Result.005 file - promoters50/4282414
caaacatgaacc

SEQ ID NO: 186013 - DNA, 12 bp, Unknown
  misc_feature (1)..( 12): Result.005 file - promoters50/4282414
ctaagatgaaca

SEQ ID NO: 186014 - DNA, 12 bp, Unknown
  misc_feature (1)..( 12): Result.005 file - promoters50/4282414
gttatttcaaac

SEQ ID NO: 186015 - DNA, 12 bp, Unknown
  misc_feature (1)..( 12): Result.005 file - promoters50/4282414
aatattttaaaa

SEQ ID NO: 186016 - DNA, 11 bp, Unknown
  misc_feature (1)..( 11): Result.005 file - promoters50/4282414
agatggttttg

SEQ ID NO: 186017 - DNA, 11 bp, Unknown
  misc_feature (1)..( 11): Result.005 file - promoters50/4282414
acaaagttttg

SEQ ID NO: 186018 - DNA, 11 bp, Unknown
  misc_feature (1)..( 11): Result.005 file - promoters50/4282414
ataaaatttta

SEQ ID NO: 186019 - DNA, 11 bp, Unknown
  misc_feature (1)..( 11): Result.005 file - promoters50/4282414
gtgaaatttat

SEQ ID NO: 186020 - DNA, 11 bp, Unknown
  misc_feature (1)..( 11): Result.005 file - promoters50/4282414
ataagattaaa

SEQ ID NO: 186021 - DNA, 11 bp, Unknown
  misc_feature (1)..( 11): Result.005 file - promoters50/4282414
tcccaatttac

SEQ ID NO: 186022 - DNA, 10 bp, Unknown
  misc_feature (1)..( 10): Result.005 file - promoters50/4282414
aaaataaact

SEQ ID NO: 186023 - DNA, 10 bp, Unknown
  misc_feature (1)..( 10): Result.005 file - promoters50/4282414
taaacaaaat

SEQ ID NO: 186024 - DNA, 10 bp, Unknown
  misc_feature (1)..( 10): Result.005 file - promoters50/4282414
taaaaaaaga

SEQ ID NO: 186025 - DNA, 10 bp, Unknown
  misc_feature (1)..( 10): Result.005 file - promoters50/4282414
taaaaagctc

SEQ ID NO: 186026 - DNA, 10 bp, Unknown
  misc_feature (1)..( 10): Result.005 file - promoters50/4282414
aaaacataat

SEQ ID NO: 186027 - DNA, 10 bp, Unknown
  misc_feature (1)..( 10): Result.005 file - promoters50/4282414
caaacaacaa

SEQ ID NO: 186028 - DNA, 16 bp, Unknown
  misc_feature (1)..( 16): Result.005 file - promoters50/4282418
caaatgaaaaataaaa

SEQ ID NO: 186029 - DNA, 16 bp, Unknown
  misc_feature (1)..( 16): Result.005 file - promoters50/4282418
caaaaataaaataaaa

SEQ ID NO: 186030 - DNA, 16 bp, Unknown
  misc_feature (1)..( 16): Result.005 file - promoters50/4282418
tcagtcaaaaattaaa

SEQ ID NO: 186031 - DNA, 16 bp, Unknown
  misc_feature (1)..( 16): Result.005 file - promoters50/4282418
ttggtttaatatatta

SEQ ID NO: 186032 - DNA, 16 bp, Unknown
  misc_feature (1)..( 16): Result.005 file - promoters50/4282418
aagatttaatataagt

SEQ ID NO: 186033 - DNA, 16 bp, Unknown
  misc_feature (1)..( 16): Result.005 file - promoters50/4282418
aagttttaaaacatta

SEQ ID NO: 186034 - DNA, 11 bp, Unknown
  misc_feature (1)..( 11): Result.005 file - promoters50/4282418
gaaaaataata

SEQ ID NO: 186035 - DNA, 11 bp, Unknown
  misc_feature (1)..( 11): Result.005 file - promoters50/4282418
aaaaactaaga

SEQ ID NO: 186036 - DNA, 11 bp, Unknown
  misc_feature (1)..( 11): Result.005 file - promoters50/4282418
gaaaaaattaa

SEQ ID NO: 186037 - DNA, 11 bp, Unknown
  misc_feature (1)..( 11): Result.005 file - promoters50/4282418
gaaaacaaaaa

SEQ ID NO: 186038 - DNA, 11 bp, Unknown
  misc_feature (1)..( 11): Result.005 file - promoters50/4282418
gaaaaataata

SEQ ID NO: 186039 - DNA, 11 bp, Unknown
  misc_feature (1)..( 11): Result.005 file - promoters50/4282418
taaagaaactt

SEQ ID NO: 186040 - DNA, 14 bp, Unknown
  misc_feature (1)..( 14): Result.005 file - promoters50/4282418
aaaataatatcatc

SEQ ID NO: 186041 - DNA, 14 bp, Unknown
  misc_feature (1)..( 14): Result.005 file - promoters50/4282418
ttattaaaatcaat

SEQ ID NO: 186042 - DNA, 14 bp, Unknown
  misc_feature (1)..( 14): Result.005 file - promoters50/4282418
aaactaatatcatt

SEQ ID NO: 186043 - DNA, 14 bp, Unknown
  misc_feature (1)..( 14): Result.005 file - promoters50/4282418
ttgaaaaaattaat

SEQ ID NO: 186044 - DNA, 14 bp, Unknown
  misc_feature (1)..( 14): Result.005 file - promoters50/4282418
caggaaaaatatcg

SEQ ID NO: 186045 - DNA, 14 bp, Unknown
  misc_feature (1)..( 14): Result.005 file - promoters50/4282418
taaagaaacttagt

SEQ ID NO: 186046 - DNA, 8 bp, Unknown
  misc_feature (1)..( 8): Result.005 file - promoters50/4282421
ttttcata

SEQ ID NO: 186047 - DNA, 8 bp, Unknown
  misc_feature (1)..( 8): Result.005 file - promoters50/4282421
ttttcatt

SEQ ID NO: 186048 - DNA, 8 bp, Unknown
  misc_feature (1)..( 8): Result.005 file - promoters50/4282421
gtttgatt

SEQ ID NO: 186049 - DNA, 6 bp, Unknown
  misc_feature (1)..( 6): Result.005 file - promoters50/4282421
atttgt

SEQ ID NO: 186050 - DNA, 6 bp, Unknown
  misc_feature (1)..( 6): Result.005 file - promoters50/4282421
atttgt

SEQ ID NO: 186051 - DNA, 6 bp, Unknown
  misc_feature (1)..( 6): Result.005 file - promoters50/4282421
atttgt

SEQ ID NO: 186052 - DNA, 8 bp, Unknown
  misc_feature (1)..( 8): Result.005 file - promoters50/4282425
ttaaatta

SEQ ID NO: 186053 - DNA, 8 bp, Unknown
  misc_feature (1)..( 8): Result.005 file - promoters50/4282425
ttacattt

SEQ ID NO: 186054 - DNA, 8 bp, Unknown
  misc_feature (1)..( 8): Result.005 file - promoters50/4282425
caaaatat

SEQ ID NO: 186055 - DNA, 7 bp, Unknown
  misc_feature (1)..( 7): Result.005 file - promoters50/4282425
attataa

SEQ ID NO: 186056 - DNA, 7 bp, Unknown
  misc_feature (1)..( 7): Result.005 file - promoters50/4282425
tttataa

SEQ ID NO: 186057 - DNA, 8 bp, Unknown
  misc_feature (1)..( 8): Result.005 file - promoters50/4282425
attaatag

SEQ ID NO: 186058 - DNA, 13 bp, Unknown
  misc_feature (1)..( 13): Result.005 file - promoters50/4282425
tcctagccaaaaa

SEQ ID NO: 186059 - DNA, 13 bp, Unknown
  misc_feature (1)..( 13): Result.005 file - promoters50/4282425
gtgacatcaaaaa

SEQ ID NO: 186060 - DNA, 13 bp, Unknown
  misc_feature (1)..( 13): Result.005 file - promoters50/4282425
gtgacatcgaaag

SEQ ID NO: 186061 - DNA, 9 bp, Unknown
  misc_feature (1)..( 9): Result.005 file - promoters50/4282425
atatataat

SEQ ID NO: 186062 - DNA, 9 bp, Unknown
  misc_feature (1)..( 9): Result.005 file - promoters50/4282425
atatttaaa

SEQ ID NO: 186063 - DNA, 9 bp, Unknown
  misc_feature (1)..( 9): Result.005 file - promoters50/4282425
ttatagaat

SEQ ID NO: 186064 - DNA, 8 bp, Unknown
  misc_feature (1)..( 8): Result.005 file - promoters50/4282425
tatgaatg

SEQ ID NO: 186065 - DNA, 8 bp, Unknown
  misc_feature (1)..( 8): Result.005 file - promoters50/4282425
tattaata

SEQ ID NO: 186066 - DNA, 8 bp, Unknown
  misc_feature (1)..( 8): Result.005 file - promoters50/4282425
catttata

SEQ ID NO: 186067 - DNA, 8 bp, Unknown
  misc_feature (1)..( 8): Result.005 file - promoters50/4282425
atataaat

SEQ ID NO: 186068 - DNA, 8 bp, Unknown
  misc_feature (1)..( 8): Result.005 file - promoters50/4282425
atataaaa

SEQ ID NO: 186069 - DNA, 8 bp, Unknown
  misc_feature (1)..( 8): Result.005 file - promoters50/4282425
taataaaa

SEQ ID NO: 186070 - DNA, 8 bp, Unknown
  misc_feature (1)..( 8): Result.005 file - promoters50/4282425
gtcactaa

SEQ ID NO: 186071 - DNA, 8 bp, Unknown
  misc_feature (1)..( 8): Result.005 file - promoters50/4282425
atcaataa

SEQ ID NO: 186072 - DNA, 8 bp, Unknown
  misc_feature (1)..( 8): Result.005 file - promoters50/4282425
atcaatgg

SEQ ID NO: 186073 - DNA, 8 bp, Unknown
  misc_feature (1)..( 8): Result.005 file - promoters50/4282428
attgatgt

SEQ ID NO: 186074 - DNA, 8 bp, Unknown
  misc_feature (1)..( 8): Result.005 file - promoters50/4282428
gttgctgt

SEQ ID NO: 186075 - DNA, 8 bp, Unknown
  misc_feature (1)..( 8): Result.005 file - promoters50/4282428
attgataa

SEQ ID NO: 186076 - DNA, 31 bp, Unknown; identical to SEQ ID NO: 72331
  misc_feature (1)..( 31): Result.005 file - promoters50/4282436

SEQ ID NO: 186077 - DNA, 31 bp, Unknown
  misc_feature (1)..( 31): Result.005 file - promoters50/4282436
cacgtgtcattttattattagctattgcttc

SEQ ID NO: 186078 - DNA, 31 bp, Unknown
  misc_feature (1)..( 31): Result.005 file - promoters50/4282436
tacgtgtcaagctttggttggttattgcttc

SEQ ID NO: 186079 - DNA, 15 bp, Unknown
  misc_feature (1)..( 15): Result.005 file - promoters50/4282436
cgccttagctttctc

SEQ ID NO: 186080 - DNA, 15 bp, Unknown
  misc_feature (1)..( 15): Result.005 file - promoters50/4282436
cgccttagctttctc

SEQ ID NO: 186081 - DNA, 15 bp, Unknown
  misc_feature (1)..( 15): Result.005 file - promoters50/4282436
cgccttagctttctc

SEQ ID NO: 186082 - DNA, 22 bp, Unknown
  misc_feature (1)..( 22): Result.005 file - promoters50/4282436
gaccgagtcgtcctcgtctttt

SEQ ID NO: 186083 - DNA, 22 bp, Unknown
  misc_feature (1)..( 22): Result.005 file - promoters50/4282436
gacctagtcgtcctcgtctttt

SEQ ID NO: 186084 - DNA, 22 bp, Unknown
  misc_feature (1)..( 22): Result.005 file - promoters50/4282436
gaccgactcgtcctcgtctttt

SEQ ID NO: 186085 - DNA, 19 bp, Unknown
  misc_feature (1)..( 19): Result.005 file - promoters50/4282436
ttttgcttctataaatcaa

SEQ ID NO: 186086 - DNA, 19 bp, Unknown
  misc_feature (1)..( 19): Result.005 file - promoters50/4282436
ttcttcttctataaaacaa

SEQ ID NO: 186087 - DNA, 19 bp, Unknown
  misc_feature (1)..( 19): Result.005 file - promoters50/4282436
ttcttcttctataaattaa

SEQ ID NO: 186088 - DNA, 13 bp, Unknown
  misc_feature (1)..( 13): Result.005 file - promoters50/4282477
atattgaacaaaa

SEQ ID NO: 186089 - DNA, 13 bp, Unknown
  misc_feature (1)..( 13): Result.005 file - promoters50/4282477
ttatttaacaaat

SEQ ID NO: 186090 - DNA, 13 bp, Unknown
  misc_feature (1)..( 13): Result.005 file - promoters50/4282477
acacaaaacaaaa

SEQ ID NO: 186091 - DNA, 13 bp, Unknown
  misc_feature (1)..( 13): Result.005 file - promoters50/4282477
ttatttattaatt

SEQ ID NO: 186092 - DNA, 10 bp, Unknown
  misc_feature (1)..( 10): Result.005 file - promoters50/4282477
taagatttga

SEQ ID NO: 186093 - DNA, 10 bp, Unknown
  misc_feature (1)..( 10): Result.005 file - promoters50/4282477
tttaatttga

SEQ ID NO: 186094 - DNA, 10 bp, Unknown
  misc_feature (1)..( 10): Result.005 file - promoters50/4282477
taaaatttga

SEQ ID NO: 186095 - DNA, 10 bp, Unknown
  misc_feature (1)..( 10): Result.005 file - promoters50/4282477
taacattcat

SEQ ID NO: 186096 - DNA, 10 bp, Unknown
  misc_feature (1)..( 10): Result.005 file - promoters50/4282477
ttaaatttgt

SEQ ID NO: 186097 - DNA, 9 bp, Unknown
  misc_feature (1)..( 9): Result.005 file - promoters50/4282477
ataaaattt

SEQ ID NO: 186098 - DNA, 9 bp, Unknown
  misc_feature (1)..( 9): Result.005 file - promoters50/4282477
ataaaatct

SEQ ID NO: 186099 - DNA, 9 bp, Unknown
  misc_feature (1)..( 9): Result.005 file - promoters50/4282477
aaaaaatta

SEQ ID NO: 186100 - DNA, 9 bp, Unknown
  misc_feature (1)..( 9): Result.005 file - promoters50/4282477
gataaatta

SEQ ID NO: 186101 - DNA, 11 bp, Unknown
  misc_feature (1)..( 11): Result.005 file - promoters50/4282477
gctaaatcgcg

SEQ ID NO: 186102 - DNA, 11 bp, Unknown
  misc_feature (1)..( 11): Result.005 file - promoters50/4282477
aataattcgaa

SEQ ID NO: 186103 - DNA, 11 bp, Unknown
  misc_feature (1)..( 11): Result.005 file - promoters50/4282477
aataatttgga

SEQ ID NO: 186104 - DNA, 11 bp, Unknown
  misc_feature (1)..( 11): Result.005 file - promoters50/4282477
aataaattatt

SEQ ID NO: 186105 - DNA, 10 bp, Unknown
  misc_feature (1)..( 10): Result.005 file - promoters50/4282477
cataaattta

SEQ ID NO: 186106 - DNA, 10 bp, Unknown
  misc_feature (1)..( 10): Result.005 file - promoters50/4282477
cattaatata

SEQ ID NO: 186107 - DNA, 10 bp, Unknown
  misc_feature (1)..( 10): Result.005 file - promoters50/4282477
cttaaatttg

SEQ ID NO: 186108 - DNA, 10 bp, Unknown
  misc_feature (1)..( 10): Result.005 file - promoters50/4282477
ttaaaatttg

SEQ ID NO: 186109 - DNA, 11 bp, Unknown
  misc_feature (1)..( 11): Result.005 file - promoters50/4282487
tcttttaattg

SEQ ID NO: 186110 - DNA, 11 bp, Unknown
  misc_feature (1)..( 11): Result.005 file - promoters50/4282487
gcttttgattt

SEQ ID NO: 186111 - DNA, 11 bp, Unknown
  misc_feature (1)..( 11): Result.005 file - promoters50/4282487
tgttttgtttt

SEQ ID NO: 186112 - DNA, 11 bp, Unknown
  misc_feature (1)..( 11): Result.005 file - promoters50/4282487
tatttcgatgt

SEQ ID NO: 186113 - DNA, 9 bp, Unknown
  misc_feature (1)..( 9): Result.005 file - promoters50/4282487
gtttagtta

SEQ ID NO: 186114 - DNA, 9 bp, Unknown
  misc_feature (1)..( 9): Result.005 file - promoters50/4282487
atttagttt

SEQ ID NO: 186115 - DNA, 9 bp, Unknown
  misc_feature (1)..( 9): Result.005 file - promoters50/4282487
ttttagtgg

SEQ ID NO: 186116 - DNA, 9 bp, Unknown
  misc_feature (1)..( 9): Result.005 file - promoters50/4282487
tcttatttt

SEQ ID NO: 186117 - DNA, 9 bp, Unknown
  misc_feature (1)..( 9): Result.005 file - promoters50/4282487
ttttagatt

SEQ ID NO: 186118 - DNA, 7 bp, Unknown
  misc_feature (1)..( 7): Result.005 file - promoters50/4282487
aatgttt

SEQ ID NO: 186119 - DNA, 7 bp, Unknown
  misc_feature (1)..( 7): Result.005 file - promoters50/4282487
aatgttt

SEQ ID NO: 186120 - DNA, 7 bp, Unknown
  misc_feature (1)..( 7): Result.005 file - promoters50/4282487
aatattt

SEQ ID NO: 186121 - DNA, 7 bp, Unknown
  misc_feature (1)..( 7): Result.005 file - promoters50/4282487
aatatta

SEQ ID NO: 186122 - DNA, 13 bp, Unknown
  misc_feature (1)..( 13): Result.005 file - promoters50/4282487
aggttaattacgt

SEQ ID NO: 186123 - DNA, 13 bp, Unknown
  misc_feature (1)..( 13): Result.005 file - promoters50/4282487
tagttaatgtttt

SEQ ID NO: 186124 - DNA, 13 bp, Unknown
  misc_feature (1)..( 13): Result.005 file - promoters50/4282487
ctattaatatttt

SEQ ID NO: 186125 - DNA, 13 bp, Unknown
  misc_feature (1)..( 13): Result.005 file - promoters50/4282487
tagctaaacatct

SEQ ID NO: 186126 - DNA, 13 bp, Unknown
  misc_feature (1)..( 13): Result.005 file - promoters50/4282487
atattaatgggcc

SEQ ID NO: 186127 - DNA, 10 bp, Unknown
  misc_feature (1)..( 10): Result.005 file - promoters50/4282487
ttttgatttg

SEQ ID NO: 186128 - DNA, 10 bp, Unknown
  misc_feature (1)..( 10): Result.005 file - promoters50/4282487
tttcgatgta

SEQ ID NO: 186129 - DNA, 10 bp, Unknown
  misc_feature (1)..( 10): Result.005 file - promoters50/4282487
ctttgctttg

SEQ ID NO: 186130 - DNA, 10 bp, Unknown
  misc_feature (1)..( 10): Result.005 file - promoters50/4282487
ttttgatttg

SEQ ID NO: 186131 - DNA, 12 bp, Unknown
  misc_feature (1)..( 12): Result.005 file - promoters50/4282487
aacttttaagta

SEQ ID NO: 186132 - DNA, 12 bp, Unknown
  misc_feature (1)..( 12): Result.005 file - promoters50/4282487
ttattttcagta

SEQ ID NO: 186133 - DNA, 12 bp, Unknown
  misc_feature (1)..( 12): Result.005 file - promoters50/4282487
aacctttatgta

SEQ ID NO: 186134 - DNA, 12 bp, Unknown
  misc_feature (1)..( 12): Result.005 file - promoters50/4282487
cgggtttatgtt

SEQ ID NO: 186135 - DNA, 10 bp, Unknown
  misc_feature (1)..( 10): Result.005 file - promoters50/4282503
tttgaatgcc

SEQ ID NO: 186136 - DNA, 10 bp, Unknown
  misc_feature (1)..( 10): Result.005 file - promoters50/4282503
ttttaataac

SEQ ID NO: 186137 - DNA, 10 bp, Unknown
  misc_feature (1)..( 10): Result.005 file - promoters50/4282503
ttttactaac

SEQ ID NO: 186138 - DNA, 11 bp, Unknown
  misc_feature (1)..( 11): Result.005 file - promoters50/4282503
ccaattatatg

SEQ ID NO: 186139 - DNA, 11 bp, Unknown
  misc_feature (1)..( 11): Result.005 file - promoters50/4282503
tttattaaatg

SEQ ID NO: 186140 - DNA, 11 bp, Unknown
  misc_feature (1)..( 11): Result.005 file - promoters50/4282503
tttactaactt

SEQ ID NO: 186141 - DNA, 7 bp, Unknown
  misc_feature (1)..( 7): Result.005 file - promoters50/4282503
taaaatt

SEQ ID NO: 186142 - DNA, 7 bp, Unknown
  misc_feature (1)..( 7): Result.005 file - promoters50/4282503
taaaatc

SEQ ID NO: 186143 - DNA, 7 bp, Unknown
  misc_feature (1)..( 7): Result.005 file - promoters50/4282503
caaaatc

SEQ ID NO: 186144 - DNA, 10 bp, Unknown
  misc_feature (1)..( 10): Result.005 file - promoters50/4282506
caataaactt

SEQ ID NO: 186145 - DNA, 10 bp, Unknown
  misc_feature (1)..( 10): Result.005 file - promoters50/4282506
caataaccaa

SEQ ID NO: 186146 - DNA, 10 bp, Unknown
  misc_feature (1)..( 10): Result.005 file - promoters50/4282506
aaattaccaa

SEQ ID NO: 186147 - DNA, 10 bp, Unknown
  misc_feature (1)..( 10): Result.005 file - promoters50/4282510
aataaatttt

SEQ ID NO: 186148 - DNA, 10 bp, Unknown
  misc_feature (1)..( 10): Result.005 file - promoters50/4282510
aataaattaa

SEQ ID NO: 186149 - DNA, 10 bp, Unknown
  misc_feature (1)..( 10): Result.005 file - promoters50/4282510
cctaatttaa

SEQ ID NO: 186150 - DNA, 7 bp, Unknown
  misc_feature (1)..( 7): Result.005 file - promoters50/4282510
aaaaacg

SEQ ID NO: 186151 - DNA, 7 bp, Unknown
  misc_feature (1)..( 7): Result.005 file - promoters50/4282510
aaaaaca

SEQ ID NO: 186152 - DNA, 7 bp, Unknown
  misc_feature (1)..( 7): Result.005 file - promoters50/4282510
taaaaca

SEQ ID NO: 186153 - DNA, 11 bp, Unknown
  misc_feature (1)..( 11): Result.005 file - promoters50/4282560
tatgaacaaat

SEQ ID NO: 186154 - DNA, 11 bp, Unknown
  misc_feature (1)..( 11): Result.005 file - promoters50/4282560
agggtacaaat

SEQ ID NO: 186155 - DNA, 11 bp, Unknown
  misc_feature (1)..( 11): Result.005 file - promoters50/4282560
tataaactaat

SEQ ID NO: 186156 - DNA, 11 bp, Unknown
  misc_feature (1)..( 11): Result.005 file - promoters50/4282560
actgtaaaaaa

SEQ ID NO: 186157 - DNA, 9 bp, Unknown
  misc_feature (1)..( 9): Result.005 file - promoters50/4282560
atttcttac

SEQ ID NO: 186158 - DNA, 9 bp, Unknown
  misc_feature (1)..( 9): Result.005 file - promoters50/4282560
atttctaca

SEQ ID NO: 186159 - DNA, 9 bp, Unknown
  misc_feature (1)..( 9): Result.005 file - promoters50/4282560
ttttcgtac

SEQ ID NO: 186160 - DNA, 9 bp, Unknown
  misc_feature (1)..( 9): Result.005 file - promoters50/4282560
attcctttg

SEQ ID NO: 186161 - DNA, 9 bp, Unknown
  misc_feature (1)..( 9): Result.005 file - promoters50/4282560
cttacaaaa

SEQ ID NO: 186162 - DNA, 9 bp, Unknown
  misc_feature (1)..( 9): Result.005 file - promoters50/4282560
tctacaaaa

SEQ ID NO: 186163 - DNA, 9 bp, Unknown
  misc_feature (1)..( 9): Result.005 file - promoters50/4282560
tttacaacc

SEQ ID NO: 186164 - DNA, 9 bp, Unknown
  misc_feature (1)..( 9): Result.005 file - promoters50/4282560
tttgcaaat

SEQ ID NO: 186165 - DNA, 9 bp, Unknown
  misc_feature (1)..( 9): Result.005 file - promoters50/4282560
agcttatta

SEQ ID NO: 186166 - DNA, 9 bp, Unknown
  misc_feature (1)..( 9): Result.005 file - promoters50/4282560
agcttttta

SEQ ID NO: 186167 - DNA, 9 bp, Unknown
  misc_feature (1)..( 9): Result.005 file - promoters50/4282560
tatttatta

SEQ ID NO: 186168 - DNA, 9 bp, Unknown
  misc_feature (1)..( 9): Result.005 file - promoters50/4282560
ggtttatta

SEQ ID NO: 186169 - DNA, 12 bp, Unknown
  misc_feature (1)..( 12): Result.005 file - promoters50/4282560
aacaaatttgac

SEQ ID NO: 186170 - DNA, 12 bp, Unknown
  misc_feature (1)..( 12): Result.005 file - promoters50/4282560
agtatatttgaa

SEQ ID NO: 186171 - DNA, 12 bp, Unknown
  misc_feature (1)..( 12): Result.005 file - promoters50/4282560
agtaaatttgac

SEQ ID NO: 186172 - DNA, 12 bp, Unknown
  misc_feature (1)..( 12): Result.005 file - promoters50/4282560
agtaactttaga

SEQ ID NO: 186173 - DNA, 9 bp, Unknown
  misc_feature (1)..( 9): Result.005 file - promoters50/4282580
ccacaaaaa

SEQ ID NO: 186174 - DNA, 9 bp, Unknown
  misc_feature (1)..( 9): Result.005 file - promoters50/4282580
agacagaaa

SEQ ID NO: 186175 - DNA, 9 bp, Unknown
  misc_feature (1)..( 9): Result.005 file - promoters50/4282580
aaacaatta

SEQ ID NO: 186176 - DNA, 9 bp, Unknown
  misc_feature (1)..( 9): Result.005 file - promoters50/4282580
acacagaat

SEQ ID NO: 186177 - DNA, 9 bp, Unknown
  misc_feature (1)..( 9): Result.005 file - promoters50/4282580
aaacgattc

SEQ ID NO: 186178 - DNA, 9 bp, Unknown
  misc_feature (1)..( 9): Result.005 file - promoters50/4282580
atacgcttc

SEQ ID NO: 186179 - DNA, 11 bp, Unknown
  misc_feature (1)..( 11): Result.005 file - promoters50/4282580
ctgattttgta

SEQ ID NO: 186180 - DNA, 11 bp, Unknown
  misc_feature (1)..( 11): Result.005 file - promoters50/4282580
tcaattttgct

SEQ ID NO: 186181 - DNA, 11 bp, Unknown
  misc_feature (1)..( 11): Result.005 file - promoters50/4282580
ttgattttgat

SEQ ID NO: 186182 - DNA, 11 bp, Unknown
  misc_feature (1)..( 11): Result.005 file - promoters50/4282580
ccaattttgat

SEQ ID NO: 186183 - DNA, 11 bp, Unknown
  misc_feature (1)..( 11): Result.005 file - promoters50/4282580
atcattttttt

SEQ ID NO: 186184 - DNA, 11 bp, Unknown
  misc_feature (1)..( 11): Result.005 file - promoters50/4282580
ataatttattt

SEQ ID NO: 186185 - DNA, 18 bp, Unknown
  misc_feature (1)..( 18): Result.005 file - promoters50/4282580
ccgactatcatttttttc

SEQ ID NO: 186186 - DNA, 18 bp, Unknown
  misc_feature (1)..( 18): Result.005 file - promoters50/4282580
attagtatgattaagctt

SEQ ID NO: 186187 - DNA, 19 bp, Unknown
  misc_feature (1)..( 19): Result.005 file - promoters50/4282580
agagacatcaattttgcta

SEQ ID NO: 186188 - DNA, 19 bp, Unknown
  misc_feature (1)..( 19): Result.005 file - promoters50/4282580
agtctgatggataacttga

SEQ ID NO: 186189 - DNA, 19 bp, Unknown
  misc_feature (1)..( 19): Result.005 file - promoters50/4282580
agaattactaattttaata

SEQ ID NO: 186190 - DNA, 19 bp, Unknown
  misc_feature (1)..( 19): Result.005 file - promoters50/4282580
tttgatgacaattttgtag

SEQ ID NO: 186191 - DNA, 19 bp, Unknown
  misc_feature (1)..( 19): Result.005 file - promoters50/4282580
tgatgagagtgttttttag

SEQ ID NO: 186192 - DNA, 8 bp, Unknown
  misc_feature (1)..( 8): Result.005 file - promoters50/4282588
tttgaact

SEQ ID NO: 186193 - DNA, 8 bp, Unknown
  misc_feature (1)..( 8): Result.005 file - promoters50/4282588
tttaaact

SEQ ID NO: 186194 - DNA, 8 bp, Unknown
  misc_feature (1)..( 8): Result.005 file - promoters50/4282588
tttaaaaa

SEQ ID NO: 186195 - DNA, 7 bp, Unknown
  misc_feature (1)..( 7): Result.005 file - promoters50/4282588
cataata

SEQ ID NO: 186196 - DNA, 7 bp, Unknown
  misc_feature (1)..( 7): Result.005 file - promoters50/4282588
aataata

SEQ ID NO: 186197 - DNA, 7 bp, Unknown
  misc_feature (1)..( 7): Result.005 file - promoters50/4282588
aataatg

SEQ ID NO: 186198 - DNA, 11 bp, Unknown
  misc_feature (1)..( 11): Result.005 file - promoters50/4282588
caataataaag

SEQ ID NO: 186199 - DNA, 11 bp, Unknown
  misc_feature (1)..( 11): Result.005 file - promoters50/4282588
aaataataaag

SEQ ID NO: 186200 - DNA, 11 bp, Unknown
  misc_feature (1)..( 11): Result.005 file - promoters50/4282588
caataaaccaa

SEQ ID NO: 186201 - DNA, 11 bp, Unknown
  misc_feature (1)..( 11): Result.005 file - promoters50/4282588
aaaaaatataa

SEQ ID NO: 186202 - DNA, 11 bp, Unknown
  misc_feature (1)..( 11): Result.005 file - promoters50/4282588
aaaaaatatta

SEQ ID NO: 186203 - DNA, 11 bp, Unknown
  misc_feature (1)..( 11): Result.005 file - promoters50/4282588
gaaaaatcgag

SEQ ID NO: 186204 - DNA, 11 bp, Unknown
  misc_feature (1)..( 11): Result.005 file - promoters50/4282588
aagaaatataa

SEQ ID NO: 186205 - DNA, 9 bp, Unknown
  misc_feature (1)..( 9): Result.005 file - promoters50/4282588
ttgattttt

SEQ ID NO: 186206 - DNA, 9 bp, Unknown
  misc_feature (1)..( 9): Result.005 file - promoters50/4282588
ttgattttt

SEQ ID NO: 186207 - DNA, 10 bp, Unknown
  misc_feature (1)..( 10): Result.005 file - promoters50/4282588
aagatatttt

SEQ ID NO: 186208 - DNA, 9 bp, Unknown
  misc_feature (1)..( 9): Result.005 file - promoters50/4282588
ctatatata

SEQ ID NO: 186209 - DNA, 9 bp, Unknown
  misc_feature (1)..( 9): Result.005 file - promoters50/4282588
ctatataaa

SEQ ID NO: 186210 - DNA, 9 bp, Unknown
  misc_feature (1)..( 9): Result.005 file - promoters50/4282588
ctataaata

SEQ ID NO: 186211 - DNA, 11 bp, Unknown
  misc_feature (1)..( 11): Result.005 file - promoters50/4282588
gaaatatctaa

SEQ ID NO: 186212 - DNA, 11 bp, Unknown
  misc_feature (1)..( 11): Result.005 file - promoters50/4282588
gaaaaatctag

SEQ ID NO: 186213 - DNA, 11 bp, Unknown
  misc_feature (1)..( 11): Result.005 file - promoters50/4282588
ccaatatataa

SEQ ID NO: 186214 - DNA, 9 bp, Unknown
  misc_feature (1)..( 9): Result.005 file - promoters50/4282588
ttatttaac

SEQ ID NO: 186215 - DNA, 9 bp, Unknown
  misc_feature (1)..( 9): Result.005 file - promoters50/4282588
ttatttttt

SEQ ID NO: 186216 - DNA, 9 bp, Unknown
  misc_feature (1)..( 9): Result.005 file - promoters50/4282588
atatttttt

SEQ ID NO: 186217 - DNA, 7 bp, Unknown
  misc_feature (1)..( 7): Result.005 file - promoters50/4282588
tttgtaa

SEQ ID NO: 186218 - DNA, 7 bp, Unknown
  misc_feature (1)..( 7): Result.005 file - promoters50/4282588
tttttaa

SEQ ID NO: 186219 - DNA, 7 bp, Unknown
  misc_feature (1)..( 7): Result.005 file - promoters50/4282588
tttttat

SEQ ID NO: 186220 - DNA, 8 bp, Unknown
  misc_feature (1)..( 8): Result.005 file - promoters50/4282588
ataaaaac

SEQ ID NO: 186221 - DNA, 8 bp, Unknown
  misc_feature (1)..( 8): Result.005 file - promoters50/4282588
agaaaaac

SEQ ID NO: 186222 - DNA, 8 bp, Unknown
  misc_feature (1)..( 8): Result.005 file - promoters50/4282588
agaaaaaa

SEQ ID NO: 186223 - DNA, 10 bp, Unknown
  misc_feature (1)..( 10): Result.005 file - promoters50/4282588
ttcaaataaa

SEQ ID NO: 186224 - DNA, 10 bp, Unknown
  misc_feature (1)..( 10): Result.005 file - promoters50/4282588
aataaaaaaa

SEQ ID NO: 186225 - DNA, 10 bp, Unknown
  misc_feature (1)..( 10): Result.005 file - promoters50/4282588
ttcaaatatt

SEQ ID NO: 186226 - DNA, 8 bp, Unknown
  misc_feature (1)..( 8): Result.005 file - promoters50/4282588
atttaaaa

SEQ ID NO: 186227 - DNA, 8 bp, Unknown
  misc_feature (1)..( 8): Result.005 file - promoters50/4282588
ttttaaaa

SEQ ID NO: 186228 - DNA, 8 bp, Unknown
  misc_feature (1)..( 8): Result.005 file - promoters50/4282588
ttttaatc

SEQ ID NO: 186229 - DNA, 9 bp, Unknown
  misc_feature (1)..( 9): Result.005 file - promoters50/4282588
attatcaat

SEQ ID NO: 186230 - DNA, 9 bp, Unknown
  misc_feature (1)..( 9): Result.005 file - promoters50/4282588
attgtcaaa

SEQ ID NO: 186231 - DNA, 9 bp, Unknown
  misc_feature (1)..( 9): Result.005 file - promoters50/4282588
tttgtaaaa

SEQ ID NO: 186232 - DNA, 7 bp, Unknown
  misc_feature (1)..( 7): Result.005 file - promoters50/4282588
aaaaatt

SEQ ID NO: 186233 - DNA, 7 bp, Unknown
  misc_feature (1)..( 7): Result.005 file - promoters50/4282588
aaaaatc

SEQ ID NO: 186234 - DNA, 7 bp, Unknown
  misc_feature (1)..( 7): Result.005 file - promoters50/4282588
aaacatc

SEQ ID NO: 186235 - DNA, 10 bp, Unknown
  misc_feature (1)..( 10): Result.005 file - promoters50/4282611
tgttgcttca

SEQ ID NO: 186236 - DNA, 10 bp, Unknown
  misc_feature (1)..( 10): Result.005 file - promoters50/4282611
ttttggttct

SEQ ID NO: 186237 - DNA, 10 bp, Unknown
  misc_feature (1)..( 10): Result.005 file - promoters50/4282611
tttttgtttt

SEQ ID NO: 186238 - DNA, 10 bp, Unknown
  misc_feature (1)..( 10): Result.005 file - promoters50/4282611
ccatggctct

SEQ ID NO: 186239 - DNA, 14 bp, Unknown
  misc_feature (1)..( 14): Result.005 file - promoters50/4282614
ccgttaatttcatt

SEQ ID NO: 186240 - DNA, 14 bp, Unknown
  misc_feature (1)..( 14): Result.005 file - promoters50/4282614
gatataatctcatg

SEQ ID NO: 186241 - DNA, 14 bp, Unknown
  misc_feature (1)..( 14): Result.005 file - promoters50/4282614
aatcaaatttcatc

SEQ ID NO: 186242 - DNA, 14 bp, Unknown
  misc_feature (1)..( 14): Result.005 file - promoters50/4282614
catataatttattt

SEQ ID NO: 186243 - DNA, 14 bp, Unknown
  misc_feature (1)..( 14): Result.005 file - promoters50/4282614
gaaataattttcaa

SEQ ID NO: 186244 - DNA, 14 bp, Unknown
  misc_feature (1)..( 14): Result.005 file - promoters50/4282614
gttgtaatgattag

SEQ ID NO: 186245 - DNA, 14 bp, Unknown
  misc_feature (1)..( 14): Result.005 file - promoters50/4282614
cacgtgctgtcatg

SEQ ID NO: 186246 - DNA, 14 bp, Unknown
  misc_feature (1)..( 14): Result.005 file - promoters50/4282614
ctaagaaacatctc

SEQ ID NO: 186247 - DNA, 14 bp, Unknown
  misc_feature (1)..( 14): Result.005 file - promoters50/4282614
ttaataaatttatt

SEQ ID NO: 186248 - DNA, 14 bp, Unknown
  misc_feature (1)..( 14): Result.005 file - promoters50/4282614
ctaattaattttag

SEQ ID NO: 186249 - DNA, 14 bp, Unknown
  misc_feature (1)..( 14): Result.005 file - promoters50/4282614
gtgataaataccaa

SEQ ID NO: 186250 - DNA, 14 bp, Unknown
  misc_feature (1)..( 14): Result.005 file - promoters50/4282614
gagatttattcatc

SEQ ID NO: 186251 - DNA, 14 bp, Unknown
  misc_feature (1)..( 14): Result.005 file - promoters50/4282614
cttgttaatgttag

SEQ ID NO: 186252 - DNA, 14 bp, Unknown
  misc_feature (1)..( 14): Result.005 file - promoters50/4282614
gtgacaaaacattt

SEQ ID NO: 186253 - DNA, 14 bp, Unknown
  misc_feature (1)..( 14): Result.005 file - promoters50/4282614
ttgaaaaacagtat

SEQ ID NO: 186254 - DNA, 14 bp, Unknown
  misc_feature (1)..( 14): Result.005 file - promoters50/4282614
gaaatatctcacgc

SEQ ID NO: 186255 - DNA, 14 bp, Unknown
  misc_feature (1)..( 14): Result.005 file - promoters50/4282614
gaaatatttttaag

SEQ ID NO: 186256 - DNA, 14 bp, Unknown
  misc_feature (1)..( 14): Result.005 file - promoters50/4282614
agaatttcttcttc

SEQ ID NO: 186257 - DNA, 14 bp, Unknown
  misc_feature (1)..( 14): Result.005 file - promoters50/4282614
aaaatatccaatag

SEQ ID NO: 186258 - DNA, 14 bp, Unknown
  misc_feature (1)..( 14): Result.005 file - promoters50/4282614
gaattattttacaa

SEQ ID NO: 186259 - DNA, 14 bp, Unknown
  misc_feature (1)..( 14): Result.005 file - promoters50/4282614
attttatttgaaca

SEQ ID NO: 186260 - DNA, 14 bp, Unknown
  misc_feature (1)..( 14): Result.005 file - promoters50/4282614
attttattttattt

SEQ ID NO: 186261 - DNA, 14 bp, Unknown
  misc_feature (1)..( 14): Result.005 file - promoters50/4282614
aaagtatttttgat

SEQ ID NO: 186262 - DNA, 17 bp, Unknown
  misc_feature (1)..( 17): Result.005 file - promoters50/4282614
agtttaattctattttg

SEQ ID NO: 186263 - DNA, 17 bp, Unknown
  misc_feature (1)..( 17): Result.005 file - promoters50/4282614
ttttttattttatttga

SEQ ID NO: 186264 - DNA, 17 bp, Unknown
  misc_feature (1)..( 17): Result.005 file - promoters50/4282614
agtataagatgttttgg

SEQ ID NO: 186265 - DNA, 17 bp, Unknown
  misc_feature (1)..( 17): Result.005 file - promoters50/4282614
tattttattttatttct

SEQ ID NO: 186266 - DNA, 17 bp, Unknown
  misc_feature (1)..( 17): Result.005 file - promoters50/4282614
aaaagtatttttgatca

SEQ ID NO: 186267 - DNA, 17 bp, Unknown
  misc_feature (1)..( 17): Result.005 file - promoters50/4282614
ccacacattttacatgt

SEQ ID NO: 186268 - DNA, 18 bp, Unknown
  misc_feature (1)..( 18): Result.005 file - promoters50/4282614
tataatatgtttgaccat

SEQ ID NO: 186269 - DNA, 7 bp, Unknown
  misc_feature (1)..( 7): Result.005 file - promoters50/4282626
aaatttg

SEQ ID NO: 186270 - DNA, 7 bp, Unknown
  misc_feature (1)..( 7): Result.005 file - promoters50/4282626
taatttg

SEQ ID NO: 186271 - DNA, 7 bp, Unknown
  misc_feature (1)..( 7): Result.005 file - promoters50/4282626
atatttt

SEQ ID NO: 186272 - DNA, 7 bp, Unknown
  misc_feature (1)..( 7): Result.005 file - promoters50/4282626
atacatt

SEQ ID NO: 186273 - DNA, 7 bp, Unknown
  misc_feature (1)..( 7): Result.005 file - promoters50/4282626
ataaatt

SEQ ID NO: 186274 - DNA, 7 bp, Unknown
  misc_feature (1)..( 7): Result.005 file - promoters50/4282626
atatatt

SEQ ID NO: 186275 - DNA, 8 bp, Unknown
  misc_feature (1)..( 8): Result.005 file - promoters50/4282637
tttgagag

SEQ ID NO: 186276 - DNA, 8 bp, Unknown
  misc_feature (1)..( 8): Result.005 file - promoters50/4282637
tttgagaa

SEQ ID NO: 186277 - DNA, 8 bp, Unknown
  misc_feature (1)..( 8): Result.005 file - promoters50/4282637
actgagag

SEQ ID NO: 186278 - DNA, 9 bp, Unknown
  misc_feature (1)..( 9): Result.005 file - promoters50/4282647
tataaataa

SEQ ID NO: 186279 - DNA, 9 bp, Unknown
  misc_feature (1)..( 9): Result.005 file - promoters50/4282647
tatatataa

SEQ ID NO: 186280 - DNA, 9 bp, Unknown
  misc_feature (1)..( 9): Result.005 file - promoters50/4282647
tatataata

SEQ ID NO: 186281 - DNA, 9 bp, Unknown
  misc_feature (1)..( 9): Result.005 file - promoters50/4282647
tatataaac

SEQ ID NO: 186282 - DNA, 11 bp, Unknown
  misc_feature (1)..( 11): Result.005 file - promoters50/4282647
taaaaataaaa

SEQ ID NO: 186283 - DNA, 11 bp, Unknown
  misc_feature (1)..( 11): Result.005 file - promoters50/4282647
aagcaattaaa

SEQ ID NO: 186284 - DNA, 11 bp, Unknown
  misc_feature (1)..( 11): Result.005 file - promoters50/4282647
aaggaatcaaa

SEQ ID NO: 186285 - DNA, 11 bp, Unknown
  misc_feature (1)..( 11): Result.005 file - promoters50/4282647
tgtgaattaat

SEQ ID NO: 186286 - DNA, 8 bp, Unknown
  misc_feature (1)..( 8): Result.005 file - promoters50/4282647
aatataat

SEQ ID NO: 186287 - DNA, 8 bp, Unknown
  misc_feature (1)..( 8): Result.005 file - promoters50/4282647
tatataat

SEQ ID NO: 186288 - DNA, 8 bp, Unknown
  misc_feature (1)..( 8): Result.005 file - promoters50/4282647
tatataaa

SEQ ID NO: 186289 - DNA, 8 bp, Unknown
  misc_feature (1)..( 8): Result.005 file - promoters50/4282647
tatatata

SEQ ID NO: 186290 - DNA, 10 bp, Unknown
  misc_feature (1)..( 10): Result.005 file - promoters50/4282651
agatggaaac

SEQ ID NO: 186291 - DNA, 10 bp, Unknown
  misc_feature (1)..( 10): Result.005 file - promoters50/4282651
aaatgaaaag

SEQ ID NO: 186292 - DNA, 10 bp, Unknown
  misc_feature (1)..( 10): Result.005 file - promoters50/4282651
aaatggaatc

SEQ ID NO: 186293 - DNA, 10 bp, Unknown
  misc_feature (1)..( 10): Result.005 file - promoters50/4282651
aaataaaaac

SEQ ID NO: 186294 - DNA, 10 bp, Unknown
  misc_feature (1)..( 10): Result.005 file - promoters50/4282651
acatacaaac

SEQ ID NO: 186295 - DNA, 10 bp, Unknown
  misc_feature (1)..( 10): Result.005 file - promoters50/4282651
atcagaaaag

SEQ ID NO: 186296 - DNA, 11 bp, Unknown
  misc_feature (1)..( 11): Result.005 file - promoters50/4282667
tttatttatac

SEQ ID NO: 186297 - DNA, 11 bp, Unknown
  misc_feature (1)..( 11): Result.005 file - promoters50/4282667
attattttgta

SEQ ID NO: 186298 - DNA, 11 bp, Unknown
  misc_feature (1)..( 11): Result.005 file - promoters50/4282667
tttgtttacgt

SEQ ID NO: 186299 - DNA, 11 bp, Unknown
  misc_feature (1)..( 11): Result.005 file - promoters50/4282667
tttatttatta

SEQ ID NO: 186300 - DNA, 11 bp, Unknown
  misc_feature (1)..( 11): Result.005 file - promoters50/4282667
aatattttcga

SEQ ID NO: 186301 - DNA, 11 bp, Unknown
  misc_feature (1)..( 11): Result.005 file - promoters50/4282667
catattgatta

SEQ ID NO: 186302 - DNA, 12 bp, Unknown
  misc_feature (1)..( 12): Result.005 file - promoters50/4282681
tttaatatattt

SEQ ID NO: 186303 - DNA, 12 bp, Unknown
  misc_feature (1)..( 12): Result.005 file - promoters50/4282681
atgtttattttt

SEQ ID NO: 186304 - DNA, 12 bp, Unknown
  misc_feature (1)..( 12): Result.005 file - promoters50/4282681
tttgatatataa

SEQ ID NO: 186305 - DNA, 14 bp, Unknown
  misc_feature (1)..( 14): Result.005 file - promoters50/4282681
ttaaaatattaaaa

SEQ ID NO: 186306 - DNA, 14 bp, Unknown
  misc_feature (1)..( 14): Result.005 file - promoters50/4282681
ttaaaatctcacac

SEQ ID NO: 186307 - DNA, 14 bp, Unknown
  misc_feature (1)..( 14): Result.005 file - promoters50/4282681
acaaaatactaaaa

SEQ ID NO: 186308 - DNA, 7 bp, Unknown
  misc_feature (1)..( 7): Result.005 file - promoters50/4282681
gtaaatg

SEQ ID NO: 186309 - DNA, 7 bp, Unknown
  misc_feature (1)..( 7): Result.005 file - promoters50/4282681
ataaatg

SEQ ID NO: 186310 - DNA, 7 bp, Unknown
  misc_feature (1)..( 7): Result.005 file - promoters50/4282681
ataaata

SEQ ID NO: 186311 - DNA, 7 bp, Unknown
  misc_feature (1)..( 7): Result.005 file - promoters50/4282681
aaaaaaa

SEQ ID NO: 186312 - DNA, 7 bp, Unknown
  misc_feature (1)..( 7): Result.005 file - promoters50/4282681
aaaaaat

SEQ ID NO: 186313 - DNA, 7 bp, Unknown
  misc_feature (1)..( 7): Result.005 file - promoters50/4282681
aaaaaaa

SEQ ID NO: 186314 - DNA, 9 bp, Unknown
  misc_feature (1)..( 9): Result.005 file - promoters50/4282681
attttatct

SEQ ID NO: 186315 - DNA, 9 bp, Unknown
  misc_feature (1)..( 9): Result.005 file - promoters50/4282681
attttaaaa

SEQ ID NO: 186316 - DNA, 9 bp, Unknown
  misc_feature (1)..( 9): Result.005 file - promoters50/4282681
tttttaaaa

SEQ ID NO: 186317 - DNA, 7 bp, Unknown
  misc_feature (1)..( 7): Result.005 file - promoters50/4282681
tctcata

SEQ ID NO: 186318 - DNA, 7 bp, Unknown
  misc_feature (1)..( 7): Result.005 file - promoters50/4282681
tcttata

SEQ ID NO: 186319 - DNA, 7 bp, Unknown
  misc_feature (1)..( 7): Result.005 file - promoters50/4282681
ccttata

SEQ ID NO: 186320 - DNA, 14 bp, Unknown
  misc_feature (1)..( 14): Result.005 file - promoters50/4282695
gtgaatcaatgttt

SEQ ID NO: 186321 - DNA, 14 bp, Unknown
  misc_feature (1)..( 14): Result.005 file - promoters50/4282695
tataattaatgtca

SEQ ID NO: 186322 - DNA, 14 bp, Unknown
  misc_feature (1)..( 14): Result.005 file - promoters50/4282695
tcctcttaatctca

SEQ ID NO: 186323 - DNA, 14 bp, Unknown
  misc_feature (1)..( 14): Result.005 file - promoters50/4282695
tatacttacatgta

SEQ ID NO: 186324 - DNA, 14 bp, Unknown
  misc_feature (1)..( 14): Result.005 file - promoters50/4282695
cctaattactctaa

SEQ ID NO: 186325 - DNA, 9 bp, Unknown
  misc_feature (1)..( 9): Result.005 file - promoters50/4282695
aaaaaaatt

SEQ ID NO: 186326 - DNA, 9 bp, Unknown
  misc_feature (1)..( 9): Result.005 file - promoters50/4282695
caaaagatt

SEQ ID NO: 186327 - DNA, 9 bp, Unknown
  misc_feature (1)..( 9): Result.005 file - promoters50/4282695
taacaaatt

SEQ ID NO: 186328 - DNA, 9 bp, Unknown
  misc_feature (1)..( 9): Result.005 file - promoters50/4282695
taaaaaagc

SEQ ID NO: 186329 - DNA, 10 bp, Unknown
  misc_feature (1)..( 10): Result.005 file - promoters50/4282695
caatcaaaac

SEQ ID NO: 186330 - DNA, 10 bp, Unknown
  misc_feature (1)..( 10): Result.005 file - promoters50/4282695
taaccaatcc

SEQ ID NO: 186331 - DNA, 8 bp, Unknown
  misc_feature (1)..( 8): Result.005 file - promoters50/4282717
ctgatgct

SEQ ID NO: 186332 - DNA, 8 bp, Unknown
  misc_feature (1)..( 8): Result.005 file - promoters50/4282717
ctgatgga

SEQ ID NO: 186333 - DNA, 8 bp, Unknown
  misc_feature (1)..( 8): Result.005 file - promoters50/4282717
ttgaggct

SEQ ID NO: 186334 - DNA, 8 bp, Unknown
  misc_feature (1)..( 8): Result.005 file - promoters50/4282717
ttgtggct

SEQ ID NO: 186335 - DNA, 7 bp, Unknown
  misc_feature (1)..( 7): Result.005 file - promoters50/4282717
taaattt

SEQ ID NO: 186336 - DNA, 7 bp, Unknown
  misc_feature (1)..( 7): Result.005 file - promoters50/4282717
taaattg

SEQ ID NO: 186337 - DNA, 8 bp, Unknown
  misc_feature (1)..( 8): Result.005 file - promoters50/4282717
caaagtta

SEQ ID NO: 186338 - DNA, 12 bp, Unknown
  misc_feature (1)..( 12): Result.005 file - promoters50/4282717
cttagaataaaa

SEQ ID NO: 186339 - DNA, 12 bp, Unknown
  misc_feature (1)..( 12): Result.005 file - promoters50/4282717
agggaaatgaaa

SEQ ID NO: 186340 - DNA, 12 bp, Unknown
  misc_feature (1)..( 12): Result.005 file - promoters50/4282717
cttacaataata

SEQ ID NO: 186341 - DNA, 8 bp, Unknown
  misc_feature (1)..( 8): Result.005 file - promoters50/4282717
caaattga

SEQ ID NO: 186342 - DNA, 8 bp, Unknown
  misc_feature (1)..( 8): Result.005 file - promoters50/4282717
taaattga

SEQ ID NO: 186343 - DNA, 8 bp, Unknown
  misc_feature (1)..( 8): Result.005 file - promoters50/4282717
caaattaa

SEQ ID NO: 186344 - DNA, 12 bp, Unknown
  misc_feature (1)..( 12): Result.005 file - promoters50/4282717
ttgttaatattt

SEQ ID NO: 186345 - DNA, 12 bp, Unknown
  misc_feature (1)..( 12): Result.005 file - promoters50/4282717
ttgataacattt

SEQ ID NO: 186346 - DNA, 12 bp, Unknown
  misc_feature (1)..( 12): Result.005 file - promoters50/4282717
ggtaaaacattg

SEQ ID NO: 186347 - DNA, 10 bp, Unknown
  misc_feature (1)..( 10): Result.005 file - promoters50/4282717
taatattttt

SEQ ID NO: 186348 - DNA, 10 bp, Unknown
  misc_feature (1)..( 10): Result.005 file - promoters50/4282717
ttacattttt

SEQ ID NO: 186349 - DNA, 10 bp, Unknown
  misc_feature (1)..( 10): Result.005 file - promoters50/4282717
tacaattttg

SEQ ID NO: 186350 - DNA, 9 bp, Unknown
  misc_feature (1)..( 9): Result.005 file - promoters50/4282717
aaaacattg

SEQ ID NO: 186351 - DNA, 9 bp, Unknown
  misc_feature (1)..( 9): Result.005 file - promoters50/4282717
aaaacattg

SEQ ID NO: 186352 - DNA, 9 bp, Unknown
  misc_feature (1)..( 9): Result.005 file - promoters50/4282717
ataacattt

SEQ ID NO: 186353 - DNA, 8 bp, Unknown
  misc_feature (1)..( 8): Result.005 file - promoters50/4282744
atacataa

SEQ ID NO: 186354 - DNA, 8 bp, Unknown
  misc_feature (1)..( 8): Result.005 file - promoters50/4282744
atacatac

SEQ ID NO: 186355 - DNA, 8 bp, Unknown
  misc_feature (1)..( 8): Result.005 file - promoters50/4282744
aaacataa

SEQ ID NO: 186356 - DNA, 8 bp, Unknown
  misc_feature (1)..( 8): Result.005 file - promoters50/4282744
aaagatat

SEQ ID NO: 186357 - DNA, 9 bp, Unknown
  misc_feature (1)..( 9): Result.005 file - promoters50/4282748
cataaattt

SEQ ID NO: 186358 - DNA, 9 bp, Unknown
  misc_feature (1)..( 9): Result.005 file - promoters50/4282748
cataaattc

SEQ ID NO: 186359 - DNA, 9 bp, Unknown
  misc_feature (1)..( 9): Result.005 file - promoters50/4282748
tatatattt

SEQ ID NO: 186360 - DNA, 9 bp, Unknown
  misc_feature (1)..( 9): Result.005 file - promoters50/4282748
ttaaaattt

SEQ ID NO: 186361 - DNA, 9 bp, Unknown
  misc_feature (1)..( 9): Result.005 file - promoters50/4282748
cacaaaaaa

SEQ ID NO: 186362 - DNA, 8 bp, Unknown
  misc_feature (1)..( 8): Result.005 file - promoters50/4282760
taagaaat

SEQ ID NO: 186363 - DNA, 8 bp, Unknown
  misc_feature (1)..( 8): Result.005 file - promoters50/4282760
taaaaaaa

SEQ ID NO: 186364 - DNA, 9 bp, Unknown
  misc_feature (1)..( 9): Result.005 file - promoters50/4282760
taaataaaa

SEQ ID NO: 186365 - DNA, 9 bp, Unknown
  misc_feature (1)..( 9): Result.005 file - promoters50/4282760
taaaataca

SEQ ID NO: 186366 - DNA, 9 bp, Unknown
  misc_feature (1)..( 9): Result.005 file - promoters50/4282760
caaacttga

SEQ ID NO: 186367 - DNA, 9 bp, Unknown
  misc_feature (1)..( 9): Result.005 file - promoters50/4282760
aaaaattga

SEQ ID NO: 186368 - DNA, 9 bp, Unknown
  misc_feature (1)..( 9): Result.005 file - promoters50/4282760
taaaattaa

SEQ ID NO: 186369 - DNA, 9 bp, Unknown
  misc_feature (1)..( 9): Result.005 file - promoters50/4282760
taaaataca

SEQ ID NO: 186370 - DNA, 9 bp, Unknown
  misc_feature (1)..( 9): Result.005 file - promoters50/4282760
tttgactaa

SEQ ID NO: 186371 - DNA, 9 bp, Unknown
  misc_feature (1)..( 9): Result.005 file - promoters50/4282760
attgaataa

SEQ ID NO: 186372 - DNA, 9 bp, Unknown
  misc_feature (1)..( 9): Result.005 file - promoters50/4282760
gttgtataa

SEQ ID NO: 186373 - DNA, 9 bp, Unknown
  misc_feature (1)..( 9): Result.005 file - promoters50/4282760
gttttattt

SEQ ID NO: 186374 - DNA, 10 bp, Unknown
  misc_feature (1)..( 10): Result.005 file - promoters50/4282760
atttgatcga

SEQ ID NO: 186375 - DNA, 10 bp, Unknown
  misc_feature (1)..( 10): Result.005 file - promoters50/4282760
gttttatcat

SEQ ID NO: 186376 - DNA, 10 bp, Unknown
  misc_feature (1)..( 10): Result.005 file - promoters50/4282760
attttatata

SEQ ID NO: 186377 - DNA, 10 bp, Unknown
  misc_feature (1)..( 10): Result.005 file - promoters50/4282760
gttttaggag

SEQ ID NO: 186378 - DNA, 10 bp, Unknown
  misc_feature (1)..( 10): Result.005 file - promoters50/4282760
aacttaacat

SEQ ID NO: 186379 - DNA, 13 bp, Unknown
  misc_feature (1)..( 13): Result.005 file - promoters50/4282760
accaaaagtcata

SEQ ID NO: 186380 - DNA, 13 bp, Unknown
  misc_feature (1)..( 13): Result.005 file - promoters50/4282760
accaaaagtcgat

SEQ ID NO: 186381 - DNA, 13 bp, Unknown
  misc_feature (1)..( 13): Result.005 file - promoters50/4282760
ttctaaagtcttg

SEQ ID NO: 186382 - DNA, 13 bp, Unknown
  misc_feature (1)..( 13): Result.005 file - promoters50/4282760
gatttaagtagat

SEQ ID NO: 186383 - DNA, 7 bp, Unknown
  misc_feature (1)..( 7): Result.005 file - promoters50/4282760
attttat

SEQ ID NO: 186384 - DNA, 7 bp, Unknown
  misc_feature (1)..( 7): Result.005 file - promoters50/4282760
gttttat

SEQ ID NO: 186385 - DNA, 7 bp, Unknown
  misc_feature (1)..( 7): Result.005 file - promoters50/4282760
gttttat

SEQ ID NO: 186386 - DNA, 7 bp, Unknown
  misc_feature (1)..( 7): Result.005 file - promoters50/4282760
gttttag

SEQ ID NO: 186387 - DNA, 9 bp, Unknown
  misc_feature (1)..( 9): Result.005 file - promoters50/4282776
tttaacaca

SEQ ID NO: 186388 - DNA, 9 bp, Unknown
  misc_feature (1)..( 9): Result.005 file - promoters50/4282776
gataaaaca

SEQ ID NO: 186389 - DNA, 9 bp, Unknown
  misc_feature (1)..( 9): Result.005 file - promoters50/4282776
gataaaacc

SEQ ID NO: 186390 - DNA, 8 bp, Unknown
  misc_feature (1)..( 8): Result.005 file - promoters50/4282776
attgaaaa

SEQ ID NO: 186391 - DNA, 8 bp, Unknown
  misc_feature (1)..( 8): Result.005 file - promoters50/4282776
attaaaaa

SEQ ID NO: 186392 - DNA, 8 bp, Unknown
  misc_feature (1)..( 8): Result.005 file - promoters50/4282776
attaaata

SEQ ID NO: 186393 - DNA, 6 bp, Unknown
  misc_feature (1)..( 6): Result.005 file - promoters50/4282776
aaaatc

SEQ ID NO: 186394 - DNA, 6 bp, Unknown
  misc_feature (1)..( 6): Result.005 file - promoters50/4282776
aaaatc

SEQ ID NO: 186395 - DNA, 7 bp, Unknown
  misc_feature (1)..( 7): Result.005 file - promoters50/4282776
aaatatc

SEQ ID NO: 186396 - DNA, 8 bp, Unknown
  misc_feature (1)..( 8): Result.005 file - promoters50/4282776
actactta

SEQ ID NO: 186397 - DNA, 8 bp, Unknown
  misc_feature (1)..( 8): Result.005 file - promoters50/4282776
actacttc

SEQ ID NO: 186398 - DNA, 8 bp, Unknown
  misc_feature (1)..( 8): Result.005 file - promoters50/4282776
tgtacttc

SEQ ID NO: 186399 - DNA, 7 bp, Unknown
  misc_feature (1)..( 7): Result.005 file - promoters50/4282776
ataaaat

SEQ ID NO: 186400 - DNA, 7 bp, Unknown
  misc_feature (1)..( 7): Result.005 file - promoters50/4282776
ataaaat

SEQ ID NO: 186401 - DNA, 7 bp, Unknown
  misc_feature (1)..( 7): Result.005 file - promoters50/4282776
ttaaaat

SEQ ID NO: 186402 - DNA, 9 bp, Unknown
  misc_feature (1)..( 9): Result.005 file - promoters50/4282776
aaagtagaa

SEQ ID NO: 186403 - DNA, 9 bp, Unknown
  misc_feature (1)..( 9): Result.005 file - promoters50/4282776
gaaggagaa

SEQ ID NO: 186404 - DNA, 9 bp, Unknown
  misc_feature (1)..( 9): Result.005 file - promoters50/4282776
aaaatagaa

SEQ ID NO: 186405 - DNA, 9 bp, Unknown
  misc_feature (1)..( 9): Result.005 file - promoters50/4282776
caaatctct

SEQ ID NO: 186406 - DNA, 9 bp, Unknown
  misc_feature (1)..( 9): Result.005 file - promoters50/4282776
caattctct

SEQ ID NO: 186407 - DNA, 9 bp, Unknown
  misc_feature (1)..( 9): Result.005 file - promoters50/4282776
accttctct

SEQ ID NO: 186408 - DNA, 7 bp, Unknown
  misc_feature (1)..( 7): Result.005 file - promoters50/4282776
ttaagtc

SEQ ID NO: 186409 - DNA, 7 bp, Unknown
  misc_feature (1)..( 7): Result.005 file - promoters50/4282776
ttaggtc

SEQ ID NO: 186410 - DNA, 7 bp, Unknown
  misc_feature (1)..( 7): Result.005 file - promoters50/4282776
ttaggta

SEQ ID NO: 186411 - DNA, 8 bp, Unknown
  misc_feature (1)..( 8): Result.005 file - promoters50/4282788
gttgcttt

SEQ ID NO: 186412 - DNA, 8 bp, Unknown
  misc_feature (1)..( 8): Result.005 file - promoters50/4282788
tttgattt

SEQ ID NO: 186413 - DNA, 8 bp, Unknown
  misc_feature (1)..( 8): Result.005 file - promoters50/4282788
tttgattg

SEQ ID NO: 186414 - DNA, 8 bp, Unknown
  misc_feature (1)..( 8): Result.005 file - promoters50/4282788
tttgtttg

SEQ ID NO: 186415 - DNA, 8 bp, Unknown
  misc_feature (1)..( 8): Result.005 file - promoters50/4282788
cttgattc

SEQ ID NO: 186416 - DNA, 12 bp, Unknown
  misc_feature (1)..( 12): Result.005 file - promoters50/4282788
ctacttctctaa

SEQ ID NO: 186417 - DNA, 12 bp, Unknown
  misc_feature (1)..( 12): Result.005 file - promoters50/4282788
tatgctctgtaa

SEQ ID NO: 186418 - DNA, 12 bp, Unknown
  misc_feature (1)..( 12): Result.005 file - promoters50/4282788
acttatcttgat

SEQ ID NO: 186419 - DNA, 12 bp, Unknown
  misc_feature (1)..( 12): Result.005 file - promoters50/4282788
cttcttctgtag

SEQ ID NO: 186420 - DNA, 10 bp, Unknown
  misc_feature (1)..( 10): Result.005 file - promoters50/4282795
cttttgattt

SEQ ID NO: 186421 - DNA, 10 bp, Unknown
  misc_feature (1)..( 10): Result.005 file - promoters50/4282795
cttttaattg

SEQ ID NO: 186422 - DNA, 10 bp, Unknown
  misc_feature (1)..( 10): Result.005 file - promoters50/4282795
gttttgtttt

SEQ ID NO: 186423 - DNA, 10 bp, Unknown
  misc_feature (1)..( 10): Result.005 file - promoters50/4282795
atttcgatgt

SEQ ID NO: 186424 - DNA, 13 bp, Unknown
  misc_feature (1)..( 13): Result.005 file - promoters50/4282795
tttagtttattcg

SEQ ID NO: 186425 - DNA, 13 bp, Unknown
  misc_feature (1)..( 13): Result.005 file - promoters50/4282795
tttagttaatgtt

SEQ ID NO: 186426 - DNA, 13 bp, Unknown
  misc_feature (1)..( 13): Result.005 file - promoters50/4282795
aatagttgattcg

SEQ ID NO: 186427 - DNA, 13 bp, Unknown
  misc_feature (1)..( 13): Result.005 file - promoters50/4282795
cttatttttattt

SEQ ID NO: 186428 - DNA, 7 bp, Unknown
  misc_feature (1)..( 7): Result.005 file - promoters50/4282795
aatgttt

SEQ ID NO: 186429 - DNA, 7 bp, Unknown
  misc_feature (1)..( 7): Result.005 file - promoters50/4282795
aatgttt

SEQ ID NO: 186430 - DNA, 7 bp, Unknown
  misc_feature (1)..( 7): Result.005 file - promoters50/4282795
aatattt

SEQ ID NO: 186431 - DNA, 7 bp, Unknown
  misc_feature (1)..( 7): Result.005 file - promoters50/4282795
aatatta

SEQ ID NO: 186432 - DNA, 13 bp, Unknown
  misc_feature (1)..( 13): Result.005 file - promoters50/4282795
tagttaatgtttt

SEQ ID NO: 186433 - DNA, 13 bp, Unknown
  misc_feature (1)..( 13): Result.005 file - promoters50/4282795
aggttaattacgt

SEQ ID NO: 186434 - DNA, 13 bp, Unknown
  misc_feature (1)..( 13): Result.005 file - promoters50/4282795
atattaatgggcc

SEQ ID NO: 186435 - DNA, 13 bp, Unknown
  misc_feature (1)..( 13): Result.005 file - promoters50/4282795
tagctaaacatct

SEQ ID NO: 186436 - DNA, 13 bp, Unknown
  misc_feature (1)..( 13): Result.005 file - promoters50/4282795
ctattaatatttt

SEQ ID NO: 186437 - DNA, 9 bp, Unknown
  misc_feature (1)..( 9): Result.005 file - promoters50/4282795
tttaagact

SEQ ID NO: 186438 - DNA, 9 bp, Unknown
  misc_feature (1)..( 9): Result.005 file - promoters50/4282795
ttttagaaa

SEQ ID NO: 186439 - DNA, 10 bp, Unknown
  misc_feature (1)..( 10): Result.005 file - promoters50/4282795
tttgtataaa

SEQ ID NO: 186440 - DNA, 10 bp, Unknown
  misc_feature (1)..( 10): Result.005 file - promoters50/4282795
ataatataaa

SEQ ID NO: 186441 - DNA, 12 bp, Unknown
  misc_feature (1)..( 12): Result.005 file - promoters50/4282795
aacttttaagta

SEQ ID NO: 186442 - DNA, 12 bp, Unknown
  misc_feature (1)..( 12): Result.005 file - promoters50/4282795
aacctttatgta

SEQ ID NO: 186443 - DNA, 12 bp, Unknown
  misc_feature (1)..( 12): Result.005 file - promoters50/4282795
ttattttcagta

SEQ ID NO: 186444 - DNA, 12 bp, Unknown
  misc_feature (1)..( 12): Result.005 file - promoters50/4282795
cgggtttatgtt

SEQ ID NO: 186445 - DNA, 10 bp, Unknown
  misc_feature (1)..( 10): Result.005 file - promoters50/4282877
caaaagaaaa

SEQ ID NO: 186446 - DNA, 10 bp, Unknown
  misc_feature (1)..( 10): Result.005 file - promoters50/4282877
aaaaacaaaa

SEQ ID NO: 186447 - DNA, 10 bp, Unknown
  misc_feature (1)..( 10): Result.005 file - promoters50/4282877
gaaaggaatt

SEQ ID NO: 186448 - DNA, 10 bp, Unknown
  misc_feature (1)..( 10): Result.005 file - promoters50/4282877
tgaaagaaaa

SEQ ID NO: 186449 - DNA, 10 bp, Unknown
  misc_feature (1)..( 10): Result.005 file - promoters50/4282877
caaaataaaa

SEQ ID NO: 186450 - DNA, 10 bp, Unknown
  misc_feature (1)..( 10): Result.005 file - promoters50/4282877
gaaaataaat

SEQ ID NO: 186451 - DNA, 10 bp, Unknown
  misc_feature (1)..( 10): Result.005 file - promoters50/4282877
tgttcatggc

SEQ ID NO: 186452 - DNA, 10 bp, Unknown
  misc_feature (1)..( 10): Result.005 file - promoters50/4282877
agtttatgag

SEQ ID NO: 186453 - DNA, 10 bp, Unknown
  misc_feature (1)..( 10): Result.005 file - promoters50/4282877
atttcttggg

SEQ ID NO: 186454 - DNA, 10 bp, Unknown
  misc_feature (1)..( 10): Result.005 file - promoters50/4282877
aaatctaggg

SEQ ID NO: 186455 - DNA, 10 bp, Unknown
  misc_feature (1)..( 10): Result.005 file - promoters50/4282877
ttttcttatg

SEQ ID NO: 186456 - DNA, 10 bp, Unknown
  misc_feature (1)..( 10): Result.005 file - promoters50/4282877
ttttcttgtc

SEQ ID NO: 186457 - DNA, 9 bp, Unknown
  misc_feature (1)..( 9): Result.005 file - promoters50/4282877
tagtatttt

SEQ ID NO: 186458 - DNA, 9 bp, Unknown
  misc_feature (1)..( 9): Result.005 file - promoters50/4282877
gagtattat

SEQ ID NO: 186459 - DNA, 9 bp, Unknown
  misc_feature (1)..( 9): Result.005 file - promoters50/4282877
gagtgtttt

SEQ ID NO: 186460 - DNA, 9 bp, Unknown
  misc_feature (1)..( 9): Result.005 file - promoters50/4282877
tagcattta

SEQ ID NO: 186461 - DNA, 9 bp, Unknown
  misc_feature (1)..( 9): Result.005 file - promoters50/4282877
gagggtttt

SEQ ID NO: 186462 - DNA, 9 bp, Unknown
  misc_feature (1)..( 9): Result.005 file - promoters50/4282877
tagaattgg

SEQ ID NO: 186463 - DNA, 9 bp, Unknown
  misc_feature (1)..( 9): Result.005 file - promoters50/4282915
tttcacaat

SEQ ID NO: 186464 - DNA, 9 bp, Unknown
  misc_feature (1)..( 9): Result.005 file - promoters50/4282915
ttttacaaa

SEQ ID NO: 186465 - DNA, 9 bp, Unknown
  misc_feature (1)..( 9): Result.005 file - promoters50/4282915
tatcacaag

SEQ ID NO: 186466 - DNA, 9 bp, Unknown
  misc_feature (1)..( 9): Result.005 file - promoters50/4282915
cgttaaaaa

SEQ ID NO: 186467 - DNA, 9 bp, Unknown
  misc_feature (1)..( 9): Result.005 file - promoters50/4282915
gaatacaaa

SEQ ID NO: 186468 - DNA, 9 bp, Unknown
  misc_feature (1)..( 9): Result.005 file - promoters50/4282915
aatcacaca

SEQ ID NO: 186469 - DNA, 10 bp, Unknown
  misc_feature (1)..( 10): Result.005 file - promoters50/4282923
aacttataaa

SEQ ID NO: 186470 - DNA, 10 bp, Unknown
  misc_feature (1)..( 10): Result.005 file - promoters50/4282923
aacttatgac

SEQ ID NO: 186471 - DNA, 10 bp, Unknown
  misc_feature (1)..( 10): Result.005 file - promoters50/4282923
aactcataaa

SEQ ID NO: 186472 - DNA, 7 bp, Unknown
  misc_feature (1)..( 7): Result.005 file - promoters50/4282931
attaaaa

SEQ ID NO: 186473 - DNA, 7 bp, Unknown
  misc_feature (1)..( 7): Result.005 file - promoters50/4282931
cttaaaa

SEQ ID NO: 186474 - DNA, 7 bp, Unknown
  misc_feature (1)..( 7): Result.005 file - promoters50/4282931
attaaaa

SEQ ID NO: 186475 - DNA, 8 bp, Unknown
  misc_feature (1)..( 8): Result.005 file - promoters50/4282931
taaaccta

SEQ ID NO: 186476 - DNA, 8 bp, Unknown
  misc_feature (1)..( 8): Result.005 file - promoters50/4282931
aaaatcta

SEQ ID NO: 186477 - DNA, 8 bp, Unknown
  misc_feature (1)..( 8): Result.005 file - promoters50/4282931
aaaatcgt

SEQ ID NO: 186478 - DNA, 10 bp, Unknown
  misc_feature (1)..( 10): Result.005 file - promoters50/4282931
aaattcaaga

SEQ ID NO: 186479 - DNA, 10 bp, Unknown
  misc_feature (1)..( 10): Result.005 file - promoters50/4282931
aaaatcataa

SEQ ID NO: 186480 - DNA, 10 bp, Unknown
  misc_feature (1)..( 10): Result.005 file - promoters50/4282931
taattataaa

SEQ ID NO: 186481 - DNA, 9 bp, Unknown
  misc_feature (1)..( 9): Result.005 file - promoters50/4282931
attcataaa

SEQ ID NO: 186482 - DNA, 9 bp, Unknown
  misc_feature (1)..( 9): Result.005 file - promoters50/4282931
aatcataaa

SEQ ID NO: 186483 - DNA, 9 bp, Unknown
  misc_feature (1)..( 9): Result.005 file - promoters50/4282931
aattataaa

SEQ ID NO: 186484 - DNA, 10 bp, Unknown
  misc_feature (1)..( 10): Result.005 file - promoters50/4282931
caataattca

SEQ ID NO: 186485 - DNA, 10 bp, Unknown
  misc_feature (1)..( 10): Result.005 file - promoters50/4282931
caaaaattca

SEQ ID NO: 186486 - DNA, 10 bp, Unknown
  misc_feature (1)..( 10): Result.005 file - promoters50/4282931
ttataattat

SEQ ID NO: 186487 - DNA, 6 bp, Unknown
  misc_feature (1)..( 6): Result.005 file - promoters50/4282931
aaaatc

SEQ ID NO: 186488 - DNA, 6 bp, Unknown
  misc_feature (1)..( 6): Result.005 file - promoters50/4282931
aaaatc

SEQ ID NO: 186489 - DNA, 6 bp, Unknown
  misc_feature (1)..( 6): Result.005 file - promoters50/4282931
aaaatc

SEQ ID NO: 186490 - DNA, 8 bp, Unknown
  misc_feature (1)..( 8): Result.005 file - promoters50/4282939
attacaaa

SEQ ID NO: 186491 - DNA, 8 bp, Unknown
  misc_feature (1)..( 8): Result.005 file - promoters50/4282939
tttagaaa

SEQ ID NO: 186492 - DNA, 8 bp, Unknown
  misc_feature (1)..( 8): Result.005 file - promoters50/4282939
ttttgaat

SEQ ID NO: 186493 - DNA, 8 bp, Unknown
  misc_feature (1)..( 8): Result.005 file - promoters50/4282945
aatatata

SEQ ID NO: 186494 - DNA, 8 bp, Unknown
  misc_feature (1)..( 8): Result.005 file - promoters50/4282945
aatgtatg

SEQ ID NO: 186495 - DNA, 8 bp, Unknown
  misc_feature (1)..( 8): Result.005 file - promoters50/4282945
ggtatata

SEQ ID NO: 186496 - DNA, 9 bp, Unknown
  misc_feature (1)..( 9): Result.005 file - promoters50/4282945
tatgtacat

SEQ ID NO: 186497 - DNA, 9 bp, Unknown
  misc_feature (1)..( 9): Result.005 file - promoters50/4282945
aatgaacat

SEQ ID NO: 186498 - DNA, 9 bp, Unknown
  misc_feature (1)..( 9): Result.005 file - promoters50/4282945
aattaaccc

SEQ ID NO: 186499 - DNA, 8 bp, Unknown
  misc_feature (1)..( 8): Result.005 file - promoters50/4282945
atatcttt

SEQ ID NO: 186500 - DNA, 8 bp, Unknown
  misc_feature (1)..( 8): Result.005 file - promoters50/4282945
tcatcttt

SEQ ID NO: 186501 - DNA, 8 bp, Unknown
  misc_feature (1)..( 8): Result.005 file - promoters50/4282945
tcattttt

SEQ ID NO: 186502 - DNA, 8 bp, Unknown
  misc_feature (1)..( 8): Result.005 file - promoters50/4282945
ctttcttt

SEQ ID NO: 186503 - DNA, 8 bp, Unknown
  misc_feature (1)..( 8): Result.005 file - promoters50/4282945
attttttt

SEQ ID NO: 186504 - DNA, 8 bp, Unknown
  misc_feature (1)..( 8): Result.005 file - promoters50/4282945
tcatcttt

SEQ ID NO: 186505 - DNA, 7 bp, Unknown
  misc_feature (1)..( 7): Result.005 file - promoters50/4282957
gttttaa

SEQ ID NO: 186506 - DNA, 7 bp, Unknown
  misc_feature (1)..( 7): Result.005 file - promoters50/4282957
gttttac

SEQ ID NO: 186507 - DNA, 7 bp, Unknown
  misc_feature (1)..( 7): Result.005 file - promoters50/4282957
gttttaa

SEQ ID NO: 186508 - DNA, 10 bp, Unknown
  misc_feature (1)..( 10): Result.005 file - promoters50/4282957
aaactagctt

SEQ ID NO: 186509 - DNA, 10 bp, Unknown
  misc_feature (1)..( 10): Result.005 file - promoters50/4282957
ttactacctt

SEQ ID NO: 186510 - DNA, 10 bp, Unknown
  misc_feature (1)..( 10): Result.005 file - promoters50/4282957
ttactacgta

SEQ ID NO: 186511 - DNA, 13 bp, Unknown
  misc_feature (1)..( 13): Result.005 file - promoters50/4282957
gttgaaactatca

SEQ ID NO: 186512 - DNA, 13 bp, Unknown
  misc_feature (1)..( 13): Result.005 file - promoters50/4282957
aaagaaactatca

SEQ ID NO: 186513 - DNA, 13 bp, Unknown
  misc_feature (1)..( 13): Result.005 file - promoters50/4282957
aaaaaaacgtttc

SEQ ID NO: 186514 - DNA, 7 bp, Unknown
  misc_feature (1)..( 7): Result.005 file - promoters50/4282957
aaataac

SEQ ID NO: 186515 - DNA, 7 bp, Unknown
  misc_feature (1)..( 7): Result.005 file - promoters50/4282957
aaaaaac

SEQ ID NO: 186516 - DNA, 8 bp, Unknown
  misc_feature (1)..( 8): Result.005 file - promoters50/4282957
aaagaaac

SEQ ID NO: 186517 - DNA, 10 bp, Unknown
  misc_feature (1)..( 10): Result.005 file - promoters50/4282995
gagcttgaga

SEQ ID NO: 186518 - DNA, 10 bp, Unknown
  misc_feature (1)..( 10): Result.005 file - promoters50/4282995
gagtttgaat

SEQ ID NO: 186519 - DNA, 10 bp, Unknown
  misc_feature (1)..( 10): Result.005 file - promoters50/4282995
tagcttgaga

SEQ ID NO: 186520 - DNA, 7 bp, Unknown
  misc_feature (1)..( 7): Result.005 file - promoters50/4282995
aattgaa

SEQ ID NO: 186521 - DNA, 7 bp, Unknown
  misc_feature (1)..( 7): Result.005 file - promoters50/4282995
aattgaa

SEQ ID NO: 186522 - DNA, 7 bp, Unknown
  misc_feature (1)..( 7): Result.005 file - promoters50/4282995
tattgaa

SEQ ID NO: 186523 - DNA, 9 bp, Unknown
  misc_feature (1)..( 9): Result.005 file - promoters50/4282995
gaaaattga

SEQ ID NO: 186524 - DNA, 9 bp, Unknown
  misc_feature (1)..( 9): Result.005 file - promoters50/4282995
gaaaatcac

SEQ ID NO: 186525 - DNA, 9 bp, Unknown
  misc_feature (1)..( 9): Result.005 file - promoters50/4282995
ctaaattca

SEQ ID NO: 186526 - DNA, 11 bp, Unknown
  misc_feature (1)..( 11): Result.005 file - promoters50/4283003
aatattttagg

SEQ ID NO: 186527 - DNA, 11 bp, Unknown
  misc_feature (1)..( 11): Result.005 file - promoters50/4283003
aataatttgta

SEQ ID NO: 186528 - DNA, 11 bp, Unknown
  misc_feature (1)..( 11): Result.005 file - promoters50/4283003
aattattggta

SEQ ID NO: 186529 - DNA, 11 bp, Unknown
  misc_feature (1)..( 11): Result.005 file - promoters50/4283003
aatttataaag

SEQ ID NO: 186530 - DNA, 8 bp, Unknown
  misc_feature (1)..( 8): Result.005 file - promoters50/4283003
cactctta

SEQ ID NO: 186531 - DNA, 8 bp, Unknown
  misc_feature (1)..( 8): Result.005 file - promoters50/4283003
atctctta

SEQ ID NO: 186532 - DNA, 8 bp, Unknown
  misc_feature (1)..( 8): Result.005 file - promoters50/4283003
atctcatc

SEQ ID NO: 186533 - DNA, 8 bp, Unknown
  misc_feature (1)..( 8): Result.005 file - promoters50/4283003
atctcaac

SEQ ID NO: 186534 - DNA, 9 bp, Unknown
  misc_feature (1)..( 9): Result.005 file - promoters50/4283003
ctatatata

SEQ ID NO: 186535 - DNA, 9 bp, Unknown
  misc_feature (1)..( 9): Result.005 file - promoters50/4283003
ctataaata

SEQ ID NO: 186536 - DNA, 9 bp, Unknown
  misc_feature (1)..( 9): Result.005 file - promoters50/4283003
ttatataag

SEQ ID NO: 186537 - DNA, 9 bp, Unknown
  misc_feature (1)..( 9): Result.005 file - promoters50/4283003
gtaagtatg

SEQ ID NO: 186538 - DNA, 8 bp, Unknown
  misc_feature (1)..( 8): Result.005 file - promoters50/4283003
ggaacaaa

SEQ ID NO: 186539 - DNA, 8 bp, Unknown
  misc_feature (1)..( 8): Result.005 file - promoters50/4283003
agaaaaaa

SEQ ID NO: 186540 - DNA, 8 bp, Unknown
  misc_feature (1)..( 8): Result.005 file - promoters50/4283003
tgaaaaag

SEQ ID NO: 186541 - DNA, 8 bp, Unknown
  misc_feature (1)..( 8): Result.005 file - promoters50/4283003
agaaaaag

SEQ ID NO: 186542 - DNA, 8 bp, Unknown
  misc_feature (1)..( 8): Result.005 file - promoters50/4283003
taacattg

SEQ ID NO: 186543 - DNA, 8 bp, Unknown
  misc_feature (1)..( 8): Result.005 file - promoters50/4283003
aaacattt

SEQ ID NO: 186544 - DNA, 8 bp, Unknown
  misc_feature (1)..( 8): Result.005 file - promoters50/4283003
aaactttg

SEQ ID NO: 186545 - DNA, 9 bp, Unknown
  misc_feature (1)..( 9): Result.005 file - promoters50/4283003
caatcatca

SEQ ID NO: 186546 - DNA, 11 bp, Unknown
  misc_feature (1)..( 11): Result.005 file - promoters50/4283005
tcaaagagaag

SEQ ID NO: 186547 - DNA, 11 bp, Unknown
  misc_feature (1)..( 11): Result.005 file - promoters50/4283005
aaaaaaagaag

SEQ ID NO: 186548 - DNA, 11 bp, Unknown
  misc_feature (1)..( 11): Result.005 file - promoters50/4283005
ttgatgagaag

SEQ ID NO: 186549 - DNA, 11 bp, Unknown
  misc_feature (1)..( 11): Result.005 file - promoters50/4283005
ccaaataaaat

SEQ ID NO: 186550 - DNA, 11 bp, Unknown
  misc_feature (1)..( 11): Result.005 file - promoters50/4283005
tcaaaaaaaaa

SEQ ID NO: 186551 - DNA, 11 bp, Unknown
  misc_feature (1)..( 11): Result.005 file - promoters50/4283005
acaaaaaaaat

SEQ ID NO: 186552 - DNA, 13 bp, Unknown
  misc_feature (1)..( 13): Result.005 file - promoters50/4283041
aaaaaaagaaaaa

SEQ ID NO: 186553 - DNA, 13 bp, Unknown
  misc_feature (1)..( 13): Result.005 file - promoters50/4283041
aaaaaaagaaaaa

SEQ ID NO: 186554 - DNA, 13 bp, Unknown
  misc_feature (1)..( 13): Result.005 file - promoters50/4283041
gccaaaagagtaa

SEQ ID NO: 186555 - DNA, 7 bp, Unknown
  misc_feature (1)..( 7): Result.005 file - promoters50/4283057
gttataa

SEQ ID NO: 186556 - DNA, 7 bp, Unknown
  misc_feature (1)..( 7): Result.005 file - promoters50/4283057
gttttaa

SEQ ID NO: 186557 - DNA, 7 bp, Unknown
  misc_feature (1)..( 7): Result.005 file - promoters50/4283057
gttgtaa

SEQ ID NO: 186558 - DNA, 14 bp, Unknown
  misc_feature (1)..( 14): Result.005 file - promoters50/4283057
cttttgaaagtctc

SEQ ID NO: 186559 - DNA, 14 bp, Unknown
  misc_feature (1)..( 14): Result.005 file - promoters50/4283057
ctttggaaaagaaa

SEQ ID NO: 186560 - DNA, 14 bp, Unknown
  misc_feature (1)..( 14): Result.005 file - promoters50/4283057
taagggaaatgaaa

SEQ ID NO: 186561 - DNA, 8 bp, Unknown
  misc_feature (1)..( 8): Result.005 file - promoters50/4283191
atttttac

SEQ ID NO: 186562 - DNA, 8 bp, Unknown
  misc_feature (1)..( 8): Result.005 file - promoters50/4283191
atttttga

SEQ ID NO: 186563 - DNA, 8 bp, Unknown
  misc_feature (1)..( 8): Result.005 file - promoters50/4283191
atttgtga

SEQ ID NO: 186564 - DNA, 8 bp, Unknown
  misc_feature (1)..( 8): Result.005 file - promoters50/4283191
ttatgtta

SEQ ID NO: 186565 - DNA, 8 bp, Unknown
  misc_feature (1)..( 8): Result.005 file - promoters50/4283191
ttaggttg

SEQ ID NO: 186566 - DNA, 8 bp, Unknown
  misc_feature (1)..( 8): Result.005 file - promoters50/4283191
gtagattg

SEQ ID NO: 186567 - DNA, 8 bp, Unknown
  misc_feature (1)..( 8): Result.005 file - promoters50/4283191
taattaaa

SEQ ID NO: 186568 - DNA, 8 bp, Unknown
  misc_feature (1)..( 8): Result.005 file - promoters50/4283191
aaattaaa

SEQ ID NO: 186569 - DNA, 8 bp, Unknown
  misc_feature (1)..( 8): Result.005 file - promoters50/4283191
aaattatg

SEQ ID NO: 186570 - DNA, 11 bp, Unknown
  misc_feature (1)..( 11): Result.005 file - promoters50/4283191
tcgatatgttc

SEQ ID NO: 186571 - DNA, 11 bp, Unknown
  misc_feature (1)..( 11): Result.005 file - promoters50/4283191
tcgatttgtga

SEQ ID NO: 186572 - DNA, 11 bp, Unknown
  misc_feature (1)..( 11): Result.005 file - promoters50/4283191
tttatttttga

SEQ ID NO: 186573 - DNA, 10 bp, Unknown
  misc_feature (1)..( 10): Result.005 file - promoters50/4283218
gtttctcatt

SEQ ID NO: 186574 - DNA, 10 bp, Unknown
  misc_feature (1)..( 10): Result.005 file - promoters50/4283218
ttttttcatt

SEQ ID NO: 186575 - DNA, 10 bp, Unknown
  misc_feature (1)..( 10): Result.005 file - promoters50/4283218
gtttcttttt

SEQ ID NO: 186576 - DNA, 10 bp, Unknown
  misc_feature (1)..( 10): Result.005 file - promoters50/4283218
gattttcaca

SEQ ID NO: 186577 - DNA, 11 bp, Unknown
  misc_feature (1)..( 11): Result.005 file - promoters50/4283218
atttttacata

SEQ ID NO: 186578 - DNA, 11 bp, Unknown
  misc_feature (1)..( 11): Result.005 file - promoters50/4283218
tctcttacatg

SEQ ID NO: 186579 - DNA, 16 bp, Unknown
  misc_feature (1)..( 16): Result.005 file - promoters50/4283218
tctatataatagtagc

SEQ ID NO: 186580 - DNA, 16 bp, Unknown
  misc_feature (1)..( 16): Result.005 file - promoters50/4283218
actatataatggtagc

SEQ ID NO: 186581 - DNA, 16 bp, Unknown
  misc_feature (1)..( 16): Result.005 file - promoters50/4283218
tctatataaacctcca

SEQ ID NO: 186582 - DNA, 16 bp, Unknown
  misc_feature (1)..( 16): Result.005 file - promoters50/4283218
attatttaaacaccaa

SEQ ID NO: 186583 - DNA, 16 bp, Unknown
  misc_feature (1)..( 16): Result.005 file - promoters50/4283218
catatatatccgcctt

SEQ ID NO: 186584 - DNA, 16 bp, Unknown
  misc_feature (1)..( 16): Result.005 file - promoters50/4283218
tgtatatatacccttc

SEQ ID NO: 186585 - DNA, 9 bp, Unknown
  misc_feature (1)..( 9): Result.005 file - promoters50/4283218
aaaaatatc

SEQ ID NO: 186586 - DNA, 9 bp, Unknown
  misc_feature (1)..( 9): Result.005 file - promoters50/4283218
taaattatg

SEQ ID NO: 186587 - DNA, 9 bp, Unknown
  misc_feature (1)..( 9): Result.005 file - promoters50/4283218
aaaaattaa

SEQ ID NO: 186588 - DNA, 9 bp, Unknown
  misc_feature (1)..( 9): Result.005 file - promoters50/4283218
ccaaatatt

SEQ ID NO: 186589 - DNA, 9 bp, Unknown
  misc_feature (1)..( 9): Result.005 file - promoters50/4283218
aaaaaagtt

SEQ ID NO: 186590 - DNA, 10 bp, Unknown
  misc_feature (1)..( 10): Result.005 file - promoters50/4283222
caaatattta

SEQ ID NO: 186591 - DNA, 10 bp, Unknown
  misc_feature (1)..( 10): Result.005 file - promoters50/4283222
gaaatatttt

SEQ ID NO: 186592 - DNA, 10 bp, Unknown
  misc_feature (1)..( 10): Result.005 file - promoters50/4283222
aaaagatttt

SEQ ID NO: 186593 - DNA, 11 bp, Unknown
  misc_feature (1)..( 11): Result.005 file - promoters50/4283222
tgttttattta

SEQ ID NO: 186594 - DNA, 10 bp, Unknown
  misc_feature (1)..( 10): Result.005 file - promoters50/4283222
aaaatgtttg

SEQ ID NO: 186595 - DNA, 11 bp, Unknown
  misc_feature (1)..( 11): Result.005 file - promoters50/4283222
tctaataatta

SEQ ID NO: 186596 - DNA, 11 bp, Unknown
  misc_feature (1)..( 11): Result.005 file - promoters50/4283222
aaatatattta

SEQ ID NO: 186597 - DNA, 15 bp, Unknown
  misc_feature (1)..( 15): Result.005 file - promoters50/4283222
actaataatgtataa

SEQ ID NO: 186598 - DNA, 15 bp, Unknown
  misc_feature (1)..( 15): Result.005 file - promoters50/4283222
atgaataattttact

SEQ ID NO: 186599 - DNA, 15 bp, Unknown
  misc_feature (1)..( 15): Result.005 file - promoters50/4283222
taaaataatatataa

SEQ ID NO: 186600 - DNA, 15 bp, Unknown
  misc_feature (1)..( 15): Result.005 file - promoters50/4283222
atgaagaatctgatg

SEQ ID NO: 186601 - DNA, 15 bp, Unknown
  misc_feature (1)..( 15): Result.005 file - promoters50/4283222
ttggataatatgcaa

SEQ ID NO: 186602 - DNA, 15 bp, Unknown
  misc_feature (1)..( 15): Result.005 file - promoters50/4283222
gttaattatatacac

SEQ ID NO: 186603 - DNA, 15 bp, Unknown
  misc_feature (1)..( 15): Result.005 file - promoters50/4283222
ttaaataaatgaaat

SEQ ID NO: 186604 - DNA, 11 bp, Unknown
  misc_feature (1)..( 11): Result.005 file - promoters50/4283222
taaaataatta

SEQ ID NO: 186605 - DNA, 11 bp, Unknown
  misc_feature (1)..( 11): Result.005 file - promoters50/4283222
gaaaacaattt

SEQ ID NO: 186606 - DNA, 11 bp, Unknown
  misc_feature (1)..( 11): Result.005 file - promoters50/4283222
taaactaattt

SEQ ID NO: 186607 - DNA, 11 bp, Unknown
  misc_feature (1)..( 11): Result.005 file - promoters50/4283222
taaactattct

SEQ ID NO: 186608 - DNA, 11 bp, Unknown
  misc_feature (1)..( 11): Result.005 file - promoters50/4283222
gcaactaattt

SEQ ID NO: 186609 - DNA, 11 bp, Unknown
  misc_feature (1)..( 11): Result.005 file - promoters50/4283222
gaaactatata

SEQ ID NO: 186610 - DNA, 14 bp, Unknown
  misc_feature (1)..( 14): Result.005 file - promoters50/4283222
aaatatttttatgt

SEQ ID NO: 186611 - DNA, 14 bp, Unknown
  misc_feature (1)..( 14): Result.005 file - promoters50/4283222
aaaagattttataa

SEQ ID NO: 186612 - DNA, 14 bp, Unknown
  misc_feature (1)..( 14): Result.005 file - promoters50/4283222
taattgttttattt

SEQ ID NO: 186613 - DNA, 14 bp, Unknown
  misc_feature (1)..( 14): Result.005 file - promoters50/4283222
aaatatatttaatc

SEQ ID NO: 186614 - DNA, 14 bp, Unknown
  misc_feature (1)..( 14): Result.005 file - promoters50/4283222
gcggatttctaata

SEQ ID NO: 186615 - DNA, 14 bp, Unknown
  misc_feature (1)..( 14): Result.005 file - promoters50/4283222
tcgacaatgtatga

SEQ ID NO: 186616 - DNA, 12 bp, Unknown
  misc_feature (1)..( 12): Result.005 file - promoters50/4283222
aaatctattaac

SEQ ID NO: 186617 - DNA, 12 bp, Unknown
  misc_feature (1)..( 12): Result.005 file - promoters50/4283222
caatgtatgatc

SEQ ID NO: 186618 - DNA, 12 bp, Unknown
  misc_feature (1)..( 12): Result.005 file - promoters50/4283222
atttctaataat

SEQ ID NO: 186619 - DNA, 12 bp, Unknown
  misc_feature (1)..( 12): Result.005 file - promoters50/4283222
aaatatatttaa

SEQ ID NO: 186620 - DNA, 12 bp, Unknown
  misc_feature (1)..( 12): Result.005 file - promoters50/4283222
gattttataata

SEQ ID NO: 186621 - DNA, 12 bp, Unknown
  misc_feature (1)..( 12): Result.005 file - promoters50/4283222
tgatttataatt

SEQ ID NO: 186622 - DNA, 12 bp, Unknown
  misc_feature (1)..( 12): Result.005 file - promoters50/4283222
ggatgtatgcac

SEQ ID NO: 186623 - DNA, 9 bp, Unknown
  misc_feature (1)..( 9): Result.005 file - promoters50/4283230
aatatgaat

SEQ ID NO: 186624 - DNA, 9 bp, Unknown
  misc_feature (1)..( 9): Result.005 file - promoters50/4283230
tatataaat

SEQ ID NO: 186625 - DNA, 9 bp, Unknown
  misc_feature (1)..( 9): Result.005 file - promoters50/4283230
tatagaaat

SEQ ID NO: 186626 - DNA, 9 bp, Unknown
  misc_feature (1)..( 9): Result.005 file - promoters50/4283230
gataaaaaa

SEQ ID NO: 186627 - DNA, 9 bp, Unknown
  misc_feature (1)..( 9): Result.005 file - promoters50/4283230
gattaaacc

SEQ ID NO: 186628 - DNA, 9 bp, Unknown
  misc_feature (1)..( 9): Result.005 file - promoters50/4283230
gataaaaca

SEQ ID NO: 186629 - DNA, 16 bp, Unknown
  misc_feature (1)..( 16): Result.005 file - promoters50/4283230
aagtaaaaatacattc

SEQ ID NO: 186630 - DNA, 16 bp, Unknown
  misc_feature (1)..( 16): Result.005 file - promoters50/4283230
ctattaaaatactccg

SEQ ID NO: 186631 - DNA, 16 bp, Unknown
  misc_feature (1)..( 16): Result.005 file - promoters50/4283230
aagaaaaaataaatta

SEQ ID NO: 186632 - DNA, 16 bp, Unknown
  misc_feature (1)..( 16): Result.005 file - promoters50/4283230
atgggaaaataataat

SEQ ID NO: 186633 - DNA, 17 bp, Unknown
  misc_feature (1)..( 17): Result.005 file - promoters50/4283230
gatcaaaaatcaattgt

SEQ ID NO: 186634 - DNA, 17 bp, Unknown
  misc_feature (1)..( 17): Result.005 file - promoters50/4283230
ccactaaagtcacatcc

SEQ ID NO: 186635 - DNA, 17 bp, Unknown
  misc_feature (1)..( 17): Result.005 file - promoters50/4283230
aagaaaaaatgttaaag

SEQ ID NO: 186636 - DNA, 17 bp, Unknown
  misc_feature (1)..( 17): Result.005 file - promoters50/4283230
aggcttaatttaatcgg

SEQ ID NO: 186637 - DNA, 11 bp, Unknown
  misc_feature (1)..( 11): Result.005 file - promoters50/4283230
aaaaatcaatt

SEQ ID NO: 186638 - DNA, 11 bp, Unknown
  misc_feature (1)..( 11): Result.005 file - promoters50/4283230
aaaaatgttaa

SEQ ID NO: 186639 - DNA, 11 bp, Unknown
  misc_feature (1)..( 11): Result.005 file - promoters50/4283230
aaaaataaatt

SEQ ID NO: 186640 - DNA, 11 bp, Unknown
  misc_feature (1)..( 11): Result.005 file - promoters50/4283230
taaagtcacat

SEQ ID NO: 186641 - DNA, 11 bp, Unknown
  misc_feature (1)..( 11): Result.005 file - promoters50/4283230
cttaatttaat

SEQ ID NO: 186642 - DNA, 11 bp, Unknown
  misc_feature (1)..( 11): Result.005 file - promoters50/4283230
tttaattaatt

SEQ ID NO: 186643 - DNA, 12 bp, Unknown
  misc_feature (1)..( 12): Result.005 file - promoters50/4283240
ataaattgtagg

SEQ ID NO: 186644 - DNA, 12 bp, Unknown
  misc_feature (1)..( 12): Result.005 file - promoters50/4283240
caaaattgatat

SEQ ID NO: 186645 - DNA, 12 bp, Unknown
  misc_feature (1)..( 12): Result.005 file - promoters50/4283240
ataaattaatgc

SEQ ID NO: 186646 - DNA, 12 bp, Unknown
  misc_feature (1)..( 12): Result.005 file - promoters50/4283240
ttgaattgatat

SEQ ID NO: 186647 - DNA, 12 bp, Unknown
  misc_feature (1)..( 12): Result.005 file - promoters50/4283240
tgaaatattata

SEQ ID NO: 186648 - DNA, 12 bp, Unknown
  misc_feature (1)..( 12): Result.005 file - promoters50/4283240
tctatttgctat

SEQ ID NO: 186649 - DNA, 7 bp, Unknown
  misc_feature (1)..( 7): Result.005 file - promoters50/4283240
taattta

SEQ ID NO: 186650 - DNA, 7 bp, Unknown
  misc_feature (1)..( 7): Result.005 file - promoters50/4283240
taatttt

SEQ ID NO: 186651 - DNA, 7 bp, Unknown
  misc_feature (1)..( 7): Result.005 file - promoters50/4283240
aaattta

SEQ ID NO: 186652 - DNA, 7 bp, Unknown
  misc_feature (1)..( 7): Result.005 file - promoters50/4283240
taaatta

SEQ ID NO: 186653 - DNA, 7 bp, Unknown
  misc_feature (1)..( 7): Result.005 file - promoters50/4283240
gaaatta

SEQ ID NO: 186654 - DNA, 8 bp, Unknown
  misc_feature (1)..( 8): Result.005 file - promoters50/4283240
aaatcttg

SEQ ID NO: 186655 - DNA, 8 bp, Unknown
  misc_feature (1)..( 8): Result.005 file - promoters50/4283240
aaaccttt

SEQ ID NO: 186656 - DNA, 6 bp, Unknown
  misc_feature (1)..( 6): Result.005 file - promoters50/4283247
aattta

SEQ ID NO: 186657 - DNA, 6 bp, Unknown
  misc_feature (1)..( 6): Result.005 file - promoters50/4283247
aattta

SEQ ID NO: 186658 - DNA, 6 bp, Unknown
  misc_feature (1)..( 6): Result.005 file - promoters50/4283247
aattta

SEQ ID NO: 186659 - DNA, 8 bp, Unknown
  misc_feature (1)..( 8): Result.005 file - promoters50/4283247
gatttttg

SEQ ID NO: 186660 - DNA, 8 bp, Unknown
  misc_feature (1)..( 8): Result.005 file - promoters50/4283247
gatttttg

SEQ ID NO: 186661 - DNA, 8 bp, Unknown
  misc_feature (1)..( 8): Result.005 file - promoters50/4283247
tatttttg

SEQ ID NO: 186662 - DNA, 14 bp, Unknown
  misc_feature (1)..( 14): Result.005 file - promoters50/4283278
tttcaattttctcc

SEQ ID NO: 186663 - DNA, 14 bp, Unknown
  misc_feature (1)..( 14): Result.005 file - promoters50/4283278
gttaaattttgtag

SEQ ID NO: 186664 - DNA, 14 bp, Unknown
  misc_feature (1)..( 14): Result.005 file - promoters50/4283278
acatgattttgttt

SEQ ID NO: 186665 - DNA, 14 bp, Unknown
  misc_feature (1)..( 14): Result.005 file - promoters50/4283278
acatgattttattt

SEQ ID NO: 186666 - DNA, 14 bp, Unknown
  misc_feature (1)..( 14): Result.005 file - promoters50/4283278
cctatatttataaa

SEQ ID NO: 186667 - DNA, 10 bp, Unknown
  misc_feature (1)..( 10): Result.005 file - promoters50/4283278
tttcaatttt

SEQ ID NO: 186668 - DNA, 10 bp, Unknown
  misc_feature (1)..( 10): Result.005 file - promoters50/4283278
tttaaattat

SEQ ID NO: 186669 - DNA, 10 bp, Unknown
  misc_feature (1)..( 10): Result.005 file - promoters50/4283278
tttaaaagtg

SEQ ID NO: 186670 - DNA, 10 bp, Unknown
  misc_feature (1)..( 10): Result.005 file - promoters50/4283278
taaaaatatt

SEQ ID NO: 186671 - DNA, 10 bp, Unknown
  misc_feature (1)..( 10): Result.005 file - promoters50/4283278
tagaaacata

SEQ ID NO: 186672 - DNA, 10 bp, Unknown
  misc_feature (1)..( 10): Result.005 file - promoters50/4283282
acatttaaag

SEQ ID NO: 186673 - DNA, 10 bp, Unknown
  misc_feature (1)..( 10): Result.005 file - promoters50/4283282
ctttttaaag

SEQ ID NO: 186674 - DNA, 10 bp, Unknown
  misc_feature (1)..( 10): Result.005 file - promoters50/4283282
cttcttaaca

SEQ ID NO: 186675 - DNA, 7 bp, Unknown
  misc_feature (1)..( 7): Result.005 file - promoters50/4283293
tatttaa

SEQ ID NO: 186676 - DNA, 7 bp, Unknown
  misc_feature (1)..( 7): Result.005 file - promoters50/4283293
tatttaa

SEQ ID NO: 186677 - DNA, 7 bp, Unknown
  misc_feature (1)..( 7): Result.005 file - promoters50/4283293
aatttaa

SEQ ID NO: 186678 - DNA, 9 bp, Unknown
  misc_feature (1)..( 9): Result.005 file - promoters50/4283293
aaatagaat

SEQ ID NO: 186679 - DNA, 9 bp, Unknown
  misc_feature (1)..( 9): Result.005 file - promoters50/4283293
aaaaagaac

SEQ ID NO: 186680 - DNA, 9 bp, Unknown
  misc_feature (1)..( 9): Result.005 file - promoters50/4283293
ataaagaac

SEQ ID NO: 186681 - DNA, 10 bp, Unknown
  misc_feature (1)..( 10): Result.005 file - promoters50/4283297
agaaaatttt

SEQ ID NO: 186682 - DNA, 10 bp, Unknown
  misc_feature (1)..( 10): Result.005 file - promoters50/4283297
aaaaaattta

SEQ ID NO: 186683 - DNA, 10 bp, Unknown
  misc_feature (1)..( 10): Result.005 file - promoters50/4283297
catcaatttt

SEQ ID NO: 186684 - DNA, 10 bp, Unknown
  misc_feature (1)..( 10): Result.005 file - promoters50/4283297
aaacaattgg

SEQ ID NO: 186685 - DNA, 10 bp, Unknown
  misc_feature (1)..( 10): Result.005 file - promoters50/4283297
aaataataaa

SEQ ID NO: 186686 - DNA, 10 bp, Unknown
  misc_feature (1)..( 10): Result.005 file - promoters50/4283297
tatctattta

SEQ ID NO: 186687 - DNA, 12 bp, Unknown
  misc_feature (1)..( 12): Result.005 file - promoters50/4283309
aattaaaatata

SEQ ID NO: 186688 - DNA, 12 bp, Unknown
  misc_feature (1)..( 12): Result.005 file - promoters50/4283309
aataaaagtata

SEQ ID NO: 186689 - DNA, 12 bp, Unknown
  misc_feature (1)..( 12): Result.005 file - promoters50/4283309
gagaaaattatt

SEQ ID NO: 186690 - DNA, 8 bp, Unknown
  misc_feature (1)..( 8): Result.005 file - promoters50/4283309
aaagcaaa

SEQ ID NO: 186691 - DNA, 8 bp, Unknown
  misc_feature (1)..( 8): Result.005 file - promoters50/4283309
aaaccaat

SEQ ID NO: 186692 - DNA, 8 bp, Unknown
  misc_feature (1)..( 8): Result.005 file - promoters50/4283309
aaagcaaa

SEQ ID NO: 186693 - DNA, 7 bp, Unknown
  misc_feature (1)..( 7): Result.005 file - promoters50/4283309
ttcaaat

SEQ ID NO: 186694 - DNA, 7 bp, Unknown
  misc_feature (1)..( 7): Result.005 file - promoters50/4283309
atcaaat

SEQ ID NO: 186695 - DNA, 7 bp, Unknown
  misc_feature (1)..( 7): Result.005 file - promoters50/4283309
atcgaat

SEQ ID NO: 186696 - DNA, 8 bp, Unknown
  misc_feature (1)..( 8): Result.005 file - promoters50/4283315
tcacattc

SEQ ID NO: 186697 - DNA, 8 bp, Unknown
  misc_feature (1)..( 8): Result.005 file - promoters50/4283315
tcactttc

SEQ ID NO: 186698 - DNA, 8 bp, Unknown
  misc_feature (1)..( 8): Result.005 file - promoters50/4283315
agacattc

SEQ ID NO: 186699 - DNA, 11 bp, Unknown
  misc_feature (1)..( 11): Result.005 file - promoters50/4283338
tattaaatgag

SEQ ID NO: 186700 - DNA, 11 bp, Unknown
  misc_feature (1)..( 11): Result.005 file - promoters50/4283338
ttttaaatttt

SEQ ID NO: 186701 - DNA, 11 bp, Unknown
  misc_feature (1)..( 11): Result.005 file - promoters50/4283338
tatgaaaattc

SEQ ID NO: 186702 - DNA, 11 bp, Unknown
  misc_feature (1)..( 11): Result.005 file - promoters50/4283338
gggtaaatgct

SEQ ID NO: 186703 - DNA, 11 bp, Unknown
  misc_feature (1)..( 11): Result.005 file - promoters50/4283338
tagaaaaagct

SEQ ID NO: 186704 - DNA, 11 bp, Unknown
  misc_feature (1)..( 11): Result.005 file - promoters50/4283338
gtgtaaatctt

SEQ ID NO: 186705 - DNA, 8 bp, Unknown
  misc_feature (1)..( 8): Result.005 file - promoters50/4283347
ataaaaat

SEQ ID NO: 186706 - DNA, 8 bp, Unknown
  misc_feature (1)..( 8): Result.005 file - promoters50/4283347
gtaaaaat

SEQ ID NO: 186707 - DNA, 8 bp, Unknown
  misc_feature (1)..( 8): Result.005 file - promoters50/4283347
atacaaat

SEQ ID NO: 186708 - DNA, 8 bp, Unknown
  misc_feature (1)..( 8): Result.005 file - promoters50/4283347
tactgtta

SEQ ID NO: 186709 - DNA, 8 bp, Unknown
  misc_feature (1)..( 8): Result.005 file - promoters50/4283347
tactgtta

SEQ ID NO: 186710 - DNA, 8 bp, Unknown
  misc_feature (1)..( 8): Result.005 file - promoters50/4283347
ctctgtta

SEQ ID NO: 186711 - DNA, 8 bp, Unknown
  misc_feature (1)..( 8): Result.005 file - promoters50/4283347
atctgttc

SEQ ID NO: 186712 - DNA, 9 bp, Unknown
  misc_feature (1)..( 9): Result.005 file - promoters50/4283347
aattcgtac

SEQ ID NO: 186713 - DNA, 9 bp, Unknown
  misc_feature (1)..( 9): Result.005 file - promoters50/4283347
aattggtaa

SEQ ID NO: 186714 - DNA, 9 bp, Unknown
  misc_feature (1)..( 9): Result.005 file - promoters50/4283347
aattcatac

SEQ ID NO: 186715 - DNA, 8 bp, Unknown
  misc_feature (1)..( 8): Result.005 file - promoters50/4283355
caaagaaa

SEQ ID NO: 186716 - DNA, 8 bp, Unknown
  misc_feature (1)..( 8): Result.005 file - promoters50/4283355
caaacaaa

SEQ ID NO: 186717 - DNA, 8 bp, Unknown
  misc_feature (1)..( 8): Result.005 file - promoters50/4283355
agaagaaa

SEQ ID NO: 186718 - DNA, 8 bp, Unknown
  misc_feature (1)..( 8): Result.005 file - promoters50/4283355
aaaacaaa

SEQ ID NO: 186719 - DNA, 8 bp, Unknown
  misc_feature (1)..( 8): Result.005 file - promoters50/4283355
aaaaccaa

SEQ ID NO: 186720 - DNA, 8 bp, Unknown
  misc_feature (1)..( 8): Result.005 file - promoters50/4283355
gaaaaaat

SEQ ID NO: 186721 - DNA, 16 bp, Unknown
  misc_feature (1)..( 16): Result.005 file - promoters50/4283358
cataacactttgtaaa

SEQ ID NO: 186722 - DNA, 16 bp, Unknown
  misc_feature (1)..( 16): Result.005 file - promoters50/4283358
ttatattttttataaa

SEQ ID NO: 186723 - DNA, 16 bp, Unknown
  misc_feature (1)..( 16): Result.005 file - promoters50/4283358
ttatatgttttatttg

SEQ ID NO: 186724 - DNA, 13 bp, Unknown
  misc_feature (1)..( 13): Result.005 file - promoters50/4283358
cgttgttttttcc

SEQ ID NO: 186725 - DNA, 13 bp, Unknown
  misc_feature (1)..( 13): Result.005 file - promoters50/4283358
ttatattttttat

SEQ ID NO: 186726 - DNA, 13 bp, Unknown
  misc_feature (1)..( 13): Result.005 file - promoters50/4283358
ttatatgttttat

SEQ ID NO: 186727 - DNA, 9 bp, Unknown
  misc_feature (1)..( 9): Result.005 file - promoters50/4283378
gatgtataa

SEQ ID NO: 186728 - DNA, 9 bp, Unknown
  misc_feature (1)..( 9): Result.005 file - promoters50/4283378
aatgtatat

SEQ ID NO: 186729 - DNA, 9 bp, Unknown
  misc_feature (1)..( 9): Result.005 file - promoters50/4283378
aatgtaaaa

SEQ ID NO: 186730 - DNA, 9 bp, Unknown
  misc_feature (1)..( 9): Result.005 file - promoters50/4283378
gatgtataa

SEQ ID NO: 186731 - DNA, 9 bp, Unknown
  misc_feature (1)..( 9): Result.005 file - promoters50/4283378
aatgtaatt

SEQ ID NO: 186732 - DNA, 9 bp, Unknown
  misc_feature (1)..( 9): Result.005 file - promoters50/4283378
taagtataa

SEQ ID NO: 186733 - DNA, 12 bp, Unknown
  misc_feature (1)..( 12): Result.005 file - promoters50/4283378
tttaatttcgtt

SEQ ID NO: 186734 - DNA, 12 bp, Unknown
  misc_feature (1)..( 12): Result.005 file - promoters50/4283378
gttattttgcga

SEQ ID NO: 186735 - DNA, 12 bp, Unknown
  misc_feature (1)..( 12): Result.005 file - promoters50/4283378
tgtaatttagta

SEQ ID NO: 186736 - DNA, 12 bp, Unknown
  misc_feature (1)..( 12): Result.005 file - promoters50/4283378
acaaatttcaca

SEQ ID NO: 186737 - DNA, 12 bp, Unknown
  misc_feature (1)..( 12): Result.005 file - promoters50/4283378
ttttatttcata

SEQ ID NO: 186738 - DNA, 12 bp, Unknown
  misc_feature (1)..( 12): Result.005 file - promoters50/4283378
tttaatttcgtt

SEQ ID NO: 186739 - DNA, 12 bp, Unknown
  misc_feature (1)..( 12): Result.005 file - promoters50/4283378
ttacatttaaca

SEQ ID NO: 186740 - DNA, 11 bp, Unknown
  misc_feature (1)..( 11): Result.005 file - promoters50/4283378
gtatataaatg

SEQ ID NO: 186741 - DNA, 11 bp, Unknown
  misc_feature (1)..( 11): Result.005 file - promoters50/4283378
atatataataa

SEQ ID NO: 186742 - DNA, 11 bp, Unknown
  misc_feature (1)..( 11): Result.005 file - promoters50/4283378
acctataaata

SEQ ID NO: 186743 - DNA, 11 bp, Unknown
  misc_feature (1)..( 11): Result.005 file - promoters50/4283378
ctttataaata

SEQ ID NO: 186744 - DNA, 11 bp, Unknown
  misc_feature (1)..( 11): Result.005 file - promoters50/4283378
gtatataaact

SEQ ID NO: 186745 - DNA, 11 bp, Unknown
  misc_feature (1)..( 11): Result.005 file - promoters50/4283378
cgctataaaaa

SEQ ID NO: 186746 - DNA, 11 bp, Unknown
  misc_feature (1)..( 11): Result.005 file - promoters50/4283378
gtatataaatg

SEQ ID NO: 186747 - DNA, 11 bp, Unknown
  misc_feature (1)..( 11): Result.005 file - promoters50/4283378
ccccataaaag

SEQ ID NO: 186748 - DNA, 15 bp, Unknown
  misc_feature (1)..( 15): Result.005 file - promoters50/4283378
ataactttatgttat

SEQ ID NO: 186749 - DNA, 15 bp, Unknown
  misc_feature (1)..( 15): Result.005 file - promoters50/4283378
atatctttataagta

SEQ ID NO: 186750 - DNA, 15 bp, Unknown
  misc_feature (1)..( 15): Result.005 file - promoters50/4283378
gtaacttcaggctaa

SEQ ID NO: 186751 - DNA, 15 bp, Unknown
  misc_feature (1)..( 15): Result.005 file - promoters50/4283378
tacgttttaaaagta

SEQ ID NO: 186752 - DNA, 15 bp, Unknown
  misc_feature (1)..( 15): Result.005 file - promoters50/4283378
caatttttaaatttt

SEQ ID NO: 186753 - DNA, 15 bp, Unknown
  misc_feature (1)..( 15): Result.005 file - promoters50/4283378
ctcgcttcataacaa

SEQ ID NO: 186754 - DNA, 15 bp, Unknown
  misc_feature (1)..( 15): Result.005 file - promoters50/4283378
ataactttatgttat

SEQ ID NO: 186755 - DNA, 15 bp, Unknown
  misc_feature (1)..( 15): Result.005 file - promoters50/4283378
atattattatttctc

SEQ ID NO: 186756 - DNA, 12 bp, Unknown
  misc_feature (1)..( 12): Result.005 file - promoters50/4283378
atgttattagtt

SEQ ID NO: 186757 - DNA, 12 bp, Unknown
  misc_feature (1)..( 12): Result.005 file - promoters50/4283378
tctttataagta

SEQ ID NO: 186758 - DNA, 12 bp, Unknown
  misc_feature (1)..( 12): Result.005 file - promoters50/4283378
atgatattatta

SEQ ID NO: 186759 - DNA, 12 bp, Unknown
  misc_feature (1)..( 12): Result.005 file - promoters50/4283378
gttttaaaagta

SEQ ID NO: 186760 - DNA, 12 bp, Unknown
  misc_feature (1)..( 12): Result.005 file - promoters50/4283378
aatttttaaatt

SEQ ID NO: 186761 - DNA, 12 bp, Unknown
  misc_feature (1)..( 12): Result.005 file - promoters50/4283378
gcttcataacaa

SEQ ID NO: 186762 - DNA, 12 bp, Unknown
  misc_feature (1)..( 12): Result.005 file - promoters50/4283378
atgttattagtt

SEQ ID NO: 186763 - DNA, 12 bp, Unknown
  misc_feature (1)..( 12): Result.005 file - promoters50/4283378
aatttgtaactt

SEQ ID NO: 186764 - DNA, 13 bp, Unknown
  misc_feature (1)..( 13): Result.005 file - promoters50/4283378
aaataattttgtt

SEQ ID NO: 186765 - DNA, 13 bp, Unknown
  misc_feature (1)..( 13): Result.005 file - promoters50/4283378
gtataattgttaa

SEQ ID NO: 186766 - DNA, 13 bp, Unknown
  misc_feature (1)..( 13): Result.005 file - promoters50/4283378
aaacaatttttaa

SEQ ID NO: 186767 - DNA, 13 bp, Unknown
  misc_feature (1)..( 13): Result.005 file - promoters50/4283378
ggctaaatttgtt

SEQ ID NO: 186768 - DNA, 13 bp, Unknown
  misc_feature (1)..( 13): Result.005 file - promoters50/4283378
atattattatttc

SEQ ID NO: 186769 - DNA, 13 bp, Unknown
  misc_feature (1)..( 13): Result.005 file - promoters50/4283378
ttcgaaatttcct

SEQ ID NO: 186770 - DNA, 13 bp, Unknown
  misc_feature (1)..( 13): Result.005 file - promoters50/4283378
atgttattagtta

SEQ ID NO: 186771 - DNA, 9 bp, Unknown
  misc_feature (1)..( 9): Result.005 file - promoters50/4283378
gttttattt

SEQ ID NO: 186772 - DNA, 9 bp, Unknown
  misc_feature (1)..( 9): Result.005 file - promoters50/4283378
ttttgattc

SEQ ID NO: 186773 - DNA, 9 bp, Unknown
  misc_feature (1)..( 9): Result.005 file - promoters50/4283378
attttgttt

SEQ ID NO: 186774 - DNA, 9 bp, Unknown
  misc_feature (1)..( 9): Result.005 file - promoters50/4283378
attttgaaa

SEQ ID NO: 186775 - DNA, 9 bp, Unknown
  misc_feature (1)..( 9): Result.005 file - promoters50/4283378
tttttaaaa

SEQ ID NO: 186776 - DNA, 9 bp, Unknown
  misc_feature (1)..( 9): Result.005 file - promoters50/4283378
atttgaaaa

SEQ ID NO: 186777 - DNA, 15 bp, Unknown
  misc_feature (1)..( 15): Result.005 file - promoters50/4283378
ttgtgttaaatatga

SEQ ID NO: 186778 - DNA, 15 bp, Unknown
  misc_feature (1)..( 15): Result.005 file - promoters50/4283378
gattctaaaatattg

SEQ ID NO: 186779 - DNA, 16 bp, Unknown
  misc_feature (1)..( 16): Result.005 file - promoters50/4283378
aattttaaaattattc

SEQ ID NO: 186780 - DNA, 17 bp, Unknown
  misc_feature (1)..( 17): Result.005 file - promoters50/4283378
agaaactaagattataa

SEQ ID NO: 186781 - DNA, 17 bp, Unknown
  misc_feature (1)..( 17): Result.005 file - promoters50/4283378
accattgtgaaataatt

SEQ ID NO: 186782 - DNA, 17 bp, Unknown
  misc_feature (1)..( 17): Result.005 file - promoters50/4283378
taaattttgaaataatt

SEQ ID NO: 186783 - DNA, 17 bp, Unknown
  misc_feature (1)..( 17): Result.005 file - promoters50/4283378
aattttttaaaatatat

SEQ ID NO: 186784 - DNA, 17 bp, Unknown
  misc_feature (1)..( 17): Result.005 file - promoters50/4283378
aaatctgagaaatagat

SEQ ID NO: 186785 - DNA, 12 bp, Unknown
  misc_feature (1)..( 12): Result.005 file - promoters50/4283378
gatgatttaatt

SEQ ID NO: 186786 - DNA, 12 bp, Unknown
  misc_feature (1)..( 12): Result.005 file - promoters50/4283378
ttacatttaaca

SEQ ID NO: 186787 - DNA, 12 bp, Unknown
  misc_feature (1)..( 12): Result.005 file - promoters50/4283378
ttttatttcata

SEQ ID NO: 186788 - DNA, 12 bp, Unknown
  misc_feature (1)..( 12): Result.005 file - promoters50/4283378
acaaatttcaca

SEQ ID NO: 186789 - DNA, 12 bp, Unknown
  misc_feature (1)..( 12): Result.005 file - promoters50/4283378
gatgatttaatt

SEQ ID NO: 186790 - DNA, 12 bp, Unknown
  misc_feature (1)..( 12): Result.005 file - promoters50/4283378
aattattttcga

SEQ ID NO: 186791 - DNA, 10 bp, Unknown
  misc_feature (1)..( 10): Result.005 file - promoters50/4283378
ataattttgt

SEQ ID NO: 186792 - DNA, 10 bp, Unknown
  misc_feature (1)..( 10): Result.005 file - promoters50/4283378
taaatttttt

SEQ ID NO: 186793 - DNA, 10 bp, Unknown
  misc_feature (1)..( 10): Result.005 file - promoters50/4283378
taaatttgtt

SEQ ID NO: 186794 - DNA, 10 bp, Unknown
  misc_feature (1)..( 10): Result.005 file - promoters50/4283378
ttaatctttt

SEQ ID NO: 186795 - DNA, 10 bp, Unknown
  misc_feature (1)..( 10): Result.005 file - promoters50/4283378
gaaatttcct

SEQ ID NO: 186796 - DNA, 10 bp, Unknown
  misc_feature (1)..( 10): Result.005 file - promoters50/4283378
attattattt

SEQ ID NO: 186797 - DNA, 10 bp, Unknown
  misc_feature (1)..( 10): Result.005 file - promoters50/4283378
taactttatg

SEQ ID NO: 186798 - DNA, 8 bp, Unknown
  misc_feature (1)..( 8): Result.005 file - promoters50/4283378
tgaaaaga

SEQ ID NO: 186799 - DNA, 8 bp, Unknown
  misc_feature (1)..( 8): Result.005 file - promoters50/4283378
tgaaaatt

SEQ ID NO: 186800 - DNA, 8 bp, Unknown
  misc_feature (1)..( 8): Result.005 file - promoters50/4283378
tgaaaagg

SEQ ID NO: 186801 - DNA, 8 bp, Unknown
  misc_feature (1)..( 8): Result.005 file - promoters50/4283378
cgaaaatt

SEQ ID NO: 186802 - DNA, 8 bp, Unknown
  misc_feature (1)..( 8): Result.005 file - promoters50/4283378
ccaaaatt

SEQ ID NO: 186803 - DNA, 8 bp, Unknown
  misc_feature (1)..( 8): Result.005 file - promoters50/4283378
tgaaaaga

SEQ ID NO: 186804 - DNA, 18 bp, Unknown
  misc_feature (1)..( 18): Result.005 file - promoters50/4283378
ataaattttaaaattatt

SEQ ID NO: 186805 - DNA, 18 bp, Unknown
  misc_feature (1)..( 18): Result.005 file - promoters50/4283378
tttgattctaaaatattg

SEQ ID NO: 186806 - DNA, 18 bp, Unknown
  misc_feature (1)..( 18): Result.005 file - promoters50/4283378
atagatttgaaaaacaga

SEQ ID NO: 186807 - DNA, 18 bp, Unknown
  misc_feature (1)..( 18): Result.005 file - promoters50/4283378
gcagaaactaagattata

SEQ ID NO: 186808 - DNA, 18 bp, Unknown
  misc_feature (1)..( 18): Result.005 file - promoters50/4283378
aataattttgttttattt

SEQ ID NO: 186809 - DNA, 18 bp, Unknown
  misc_feature (1)..( 18): Result.005 file - promoters50/4283378
gtaaattttgaaataatt

SEQ ID NO: 186810 - DNA, 18 bp, Unknown
  misc_feature (1)..( 18): Result.005 file - promoters50/4283378
aaattttttaaaatatat

SEQ ID NO: 186811 - DNA, 13 bp, Unknown
  misc_feature (1)..( 13): Result.005 file - promoters50/4283378
atgataaacctga

SEQ ID NO: 186812 - DNA, 13 bp, Unknown
  misc_feature (1)..( 13): Result.005 file - promoters50/4283378
gaacaaaaccttg

SEQ ID NO: 186813 - DNA, 13 bp, Unknown
  misc_feature (1)..( 13): Result.005 file - promoters50/4283378
gattcaaaccctt

SEQ ID NO: 186814 - DNA, 14 bp, Unknown
  misc_feature (1)..( 14): Result.005 file - promoters50/4283378
gatttaaagcctga

SEQ ID NO: 186815 - DNA, 14 bp, Unknown
  misc_feature (1)..( 14): Result.005 file - promoters50/4283378
gtaagaaatcctcc

SEQ ID NO: 186816 - DNA, 14 bp, Unknown
  misc_feature (1)..( 14): Result.005 file - promoters50/4283378
gatgtgaagcctaa

SEQ ID NO: 186817 - DNA, 9 bp, Unknown
  misc_feature (1)..( 9): Result.005 file - promoters50/4283378
atattatac

SEQ ID NO: 186818 - DNA, 9 bp, Unknown
  misc_feature (1)..( 9): Result.005 file - promoters50/4283378
ttattattt

SEQ ID NO: 186819 - DNA, 9 bp, Unknown
  misc_feature (1)..( 9): Result.005 file - promoters50/4283378
gtataattg

SEQ ID NO: 186820 - DNA, 9 bp, Unknown
  misc_feature (1)..( 9): Result.005 file - promoters50/4283378
gtataactt

SEQ ID NO: 186821 - DNA, 9 bp, Unknown
  misc_feature (1)..( 9): Result.005 file - promoters50/4283378
aaatttttt

SEQ ID NO: 186822 - DNA, 9 bp, Unknown
  misc_feature (1)..( 9): Result.005 file - promoters50/4283378
gtaaatttt

SEQ ID NO: 186823 - DNA, 8 bp, Unknown
  misc_feature (1)..( 8): Result.005 file - promoters50/4283390
tctaaatt

SEQ ID NO: 186824 - DNA, 8 bp, Unknown
  misc_feature (1)..( 8): Result.005 file - promoters50/4283390
aataaatt

SEQ ID NO: 186825 - DNA, 8 bp, Unknown
  misc_feature (1)..( 8): Result.005 file - promoters50/4283390
aatagatt

SEQ ID NO: 186826 - DNA, 9 bp, Unknown
  misc_feature (1)..( 9): Result.005 file - promoters50/4283394
tatgtcttt

SEQ ID NO: 186827 - DNA, 9 bp, Unknown
  misc_feature (1)..( 9): Result.005 file - promoters50/4283394
tatatctgt

SEQ ID NO: 186828 - DNA, 9 bp, Unknown
  misc_feature (1)..( 9): Result.005 file - promoters50/4283394
tgtgtttga

SEQ ID NO: 186829 - DNA, 11 bp, Unknown
  misc_feature (1)..( 11): Result.005 file - promoters50/4283394
aaccattatta

SEQ ID NO: 186830 - DNA, 11 bp, Unknown
  misc_feature (1)..( 11): Result.005 file - promoters50/4283394
actgattttta

SEQ ID NO: 186831 - DNA, 11 bp, Unknown
  misc_feature (1)..( 11): Result.005 file - promoters50/4283394
actgagtttag

SEQ ID NO: 186832 - DNA, 9 bp, Unknown
  misc_feature (1)..( 9): Result.005 file - promoters50/4283397
attttaata

SEQ ID NO: 186833 - DNA, 9 bp, Unknown
  misc_feature (1)..( 9): Result.005 file - promoters50/4283397
attataaat

SEQ ID NO: 186834 - DNA, 9 bp, Unknown
  misc_feature (1)..( 9): Result.005 file - promoters50/4283397
catttaata

SEQ ID NO: 186835 - DNA, 9 bp, Unknown
  misc_feature (1)..( 9): Result.005 file - promoters50/4283397
attttaagc

SEQ ID NO: 186836 - DNA, 8 bp, Unknown
  misc_feature (1)..( 8): Result.005 file - promoters50/4283397
aatcaaaa

SEQ ID NO: 186837 - DNA, 8 bp, Unknown
  misc_feature (1)..( 8): Result.005 file - promoters50/4283397
aatcaatt

SEQ ID NO: 186838 - DNA, 8 bp, Unknown
  misc_feature (1)..( 8): Result.005 file - promoters50/4283397
aataaatt

SEQ ID NO: 186839 - DNA, 7 bp, Unknown
  misc_feature (1)..( 7): Result.005 file - promoters50/4283397
aaatttt

SEQ ID NO: 186840 - DNA, 7 bp, Unknown
  misc_feature (1)..( 7): Result.005 file - promoters50/4283397
gaatttt

SEQ ID NO: 186841 - DNA, 7 bp, Unknown
  misc_feature (1)..( 7): Result.005 file - promoters50/4283397
aaatttg

SEQ ID NO: 186842 - DNA, 11 bp, Unknown
  misc_feature (1)..( 11): Result.005 file - promoters50/4283397
aaacaaaattt

SEQ ID NO: 186843 - DNA, 11 bp, Unknown
  misc_feature (1)..( 11): Result.005 file - promoters50/4283397
aaaaaaaattt

SEQ ID NO: 186844 - DNA, 11 bp, Unknown
  misc_feature (1)..( 11): Result.005 file - promoters50/4283397
ccacaaaaaac

SEQ ID NO: 186845 - DNA, 10 bp, Unknown
  misc_feature (1)..( 10): Result.005 file - promoters50/4283397
aataataaaa

SEQ ID NO: 186846 - DNA, 10 bp, Unknown
  misc_feature (1)..( 10): Result.005 file - promoters50/4283397
aataaaaaaa

SEQ ID NO: 186847 - DNA, 10 bp, Unknown
  misc_feature (1)..( 10): Result.005 file - promoters50/4283397
cacaaaaaac

SEQ ID NO: 186848 - DNA, 10 bp, Unknown
  misc_feature (1)..( 10): Result.005 file - promoters50/4283397
cggaaaaaag

SEQ ID NO: 186849 - DNA, 7 bp, Unknown
  misc_feature (1)..( 7): Result.005 file - promoters50/4283397
aatttta

SEQ ID NO: 186850 - DNA, 7 bp, Unknown
  misc_feature (1)..( 7): Result.005 file - promoters50/4283397
aattttc

SEQ ID NO: 186851 - DNA, 7 bp, Unknown
  misc_feature (1)..( 7): Result.005 file - promoters50/4283397
cattttc

SEQ ID NO: 186852 - DNA, 10 bp, Unknown
  misc_feature (1)..( 10): Result.005 file - promoters50/4283397
ttttacaaaa

SEQ ID NO: 186853 - DNA, 10 bp, Unknown
  misc_feature (1)..( 10): Result.005 file - promoters50/4283397
attttcaaaa

SEQ ID NO: 186854 - DNA, 10 bp, Unknown
  misc_feature (1)..( 10): Result.005 file - promoters50/4283397
attttctttc

SEQ ID NO: 186855 - DNA, 9 bp, Unknown
  misc_feature (1)..( 9): Result.005 file - promoters50/4283397
aacaaaatt

SEQ ID NO: 186856 - DNA, 9 bp, Unknown
  misc_feature (1)..( 9): Result.005 file - promoters50/4283397
aacaaaaaa

SEQ ID NO: 186857 - DNA, 9 bp, Unknown
  misc_feature (1)..( 9): Result.005 file - promoters50/4283397
cacaaaaaa

SEQ ID NO: 186858 - DNA, 8 bp, Unknown
  misc_feature (1)..( 8): Result.005 file - promoters50/4283397
aaaataga

SEQ ID NO: 186859 - DNA, 8 bp, Unknown
  misc_feature (1)..( 8): Result.005 file - promoters50/4283397
aaaaaaga

SEQ ID NO: 186860 - DNA, 8 bp, Unknown
  misc_feature (1)..( 8): Result.005 file - promoters50/4283397
caaagagt

SEQ ID NO: 186861 - DNA, 10 bp, Unknown
  misc_feature (1)..( 10): Result.005 file - promoters50/4283397
aaaaaataaa

SEQ ID NO: 186862 - DNA, 10 bp, Unknown
  misc_feature (1)..( 10): Result.005 file - promoters50/4283397
aaaaaacaaa

SEQ ID NO: 186863 - DNA, 10 bp, Unknown
  misc_feature (1)..( 10): Result.005 file - promoters50/4283397
tatatagaaa

SEQ ID NO: 186864 - DNA, 8 bp, Unknown
  misc_feature (1)..( 8): Result.005 file - promoters50/4283422
aataattt

SEQ ID NO: 186865 - DNA, 8 bp, Unknown
  misc_feature (1)..( 8): Result.005 file - promoters50/4283422
catatttt

SEQ ID NO: 186866 - DNA, 8 bp, Unknown
  misc_feature (1)..( 8): Result.005 file - promoters50/4283422
aatatgtg

SEQ ID NO: 186867 - DNA, 10 bp, Unknown
  misc_feature (1)..( 10): Result.005 file - promoters50/4283422
aaactataga

SEQ ID NO: 186868 - DNA, 10 bp, Unknown
  misc_feature (1)..( 10): Result.005 file - promoters50/4283422
aaactataga

SEQ ID NO: 186869 - DNA, 10 bp, Unknown
  misc_feature (1)..( 10): Result.005 file - promoters50/4283422
taactatttg

SEQ ID NO: 186870 - DNA, 9 bp, Unknown
  misc_feature (1)..( 9): Result.005 file - promoters50/4283422
ttaaatgat

SEQ ID NO: 186871 - DNA, 9 bp, Unknown
  misc_feature (1)..( 9): Result.005 file - promoters50/4283422
ataaatgat

SEQ ID NO: 186872 - DNA, 9 bp, Unknown
  misc_feature (1)..( 9): Result.005 file - promoters50/4283422
ataaatata

SEQ ID NO: 186873 - DNA, 8 bp, Unknown
  misc_feature (1)..( 8): Result.005 file - promoters50/4283425
ccaaaaaa

SEQ ID NO: 186874 - DNA, 8 bp, Unknown
  misc_feature (1)..( 8): Result.005 file - promoters50/4283425
ggaaaaaa

SEQ ID NO: 186875 - DNA, 8 bp, Unknown
  misc_feature (1)..( 8): Result.005 file - promoters50/4283425
ccaaaaat

SEQ ID NO: 186876 - DNA, 10 bp, Unknown
  misc_feature (1)..( 10): Result.005 file - promoters50/4283425
tatatatata

SEQ ID NO: 186877 - DNA, 10 bp, Unknown
  misc_feature (1)..( 10): Result.005 file - promoters50/4283425
tataaatata

SEQ ID NO: 186878 - DNA, 11 bp, Unknown
  misc_feature (1)..( 11): Result.005 file - promoters50/4283425
tataatatctc

SEQ ID NO: 186879 - DNA, 9 bp, Unknown
  misc_feature (1)..( 9): Result.005 file - promoters50/4283425
agtcttaag

SEQ ID NO: 186880 - DNA, 9 bp, Unknown
  misc_feature (1)..( 9): Result.005 file - promoters50/4283425
ggtctaaag

SEQ ID NO: 186881 - DNA, 9 bp, Unknown
  misc_feature (1)..( 9): Result.005 file - promoters50/4283425
ggtcaaaaa

SEQ ID NO: 186882 - DNA, 8 bp, Unknown
  misc_feature (1)..( 8): Result.005 file - promoters50/4283433
cttcttaa

SEQ ID NO: 186883 - DNA, 8 bp, Unknown
  misc_feature (1)..( 8): Result.005 file - promoters50/4283433
cttgttaa

SEQ ID NO: 186884 - DNA, 8 bp, Unknown
  misc_feature (1)..( 8): Result.005 file - promoters50/4283433
tttcttat

SEQ ID NO: 186885 - DNA, 12 bp, Unknown
  misc_feature (1)..( 12): Result.005 file - promoters50/4283433
tttttggagaac

SEQ ID NO: 186886 - DNA, 12 bp, Unknown
  misc_feature (1)..( 12): Result.005 file - promoters50/4283433
attttgaagaac

SEQ ID NO: 186887 - DNA, 12 bp, Unknown
  misc_feature (1)..( 12): Result.005 file - promoters50/4283433
attttgattttg

SEQ ID NO: 186888 - DNA, 9 bp, Unknown
  misc_feature (1)..( 9): Result.005 file - promoters50/4283441
tcagtatcg

SEQ ID NO: 186889 - DNA, 9 bp, Unknown
  misc_feature (1)..( 9): Result.005 file - promoters50/4283441
tcattatgt

SEQ ID NO: 186890 - DNA, 9 bp, Unknown
  misc_feature (1)..( 9): Result.005 file - promoters50/4283441
taattttgt

SEQ ID NO: 186891 - DNA, 12 bp, Unknown
  misc_feature (1)..( 12): Result.005 file - promoters50/4283441
actatataaaat

SEQ ID NO: 186892 - DNA, 12 bp, Unknown
  misc_feature (1)..( 12): Result.005 file - promoters50/4283441
actttataaaat

SEQ ID NO: 186893 - DNA, 12 bp, Unknown
  misc_feature (1)..( 12): Result.005 file - promoters50/4283441
tgtttataaatc

SEQ ID NO: 186894 - DNA, 10 bp, Unknown
  misc_feature (1)..( 10): Result.005 file - promoters50/4283441
aattatttca

SEQ ID NO: 186895 - DNA, 10 bp, Unknown
  misc_feature (1)..( 10): Result.005 file - promoters50/4283441
aataattcat

SEQ ID NO: 186896 - DNA, 10 bp, Unknown
  misc_feature (1)..( 10): Result.005 file - promoters50/4283441
ggttatgtca

SEQ ID NO: 186897 - DNA, 8 bp, Unknown
  misc_feature (1)..( 8): Result.005 file - promoters50/4283445
ataatgtt

SEQ ID NO: 186898 - DNA, 8 bp, Unknown
  misc_feature (1)..( 8): Result.005 file - promoters50/4283445
atattgta

SEQ ID NO: 186899 - DNA, 8 bp, Unknown
  misc_feature (1)..( 8): Result.005 file - promoters50/4283445
ctaaggtt

SEQ ID NO: 186900 - DNA, 9 bp, Unknown
  misc_feature (1)..( 9): Result.005 file - promoters50/4283453
catgtacta

SEQ ID NO: 186901 - DNA, 9 bp, Unknown
  misc_feature (1)..( 9): Result.005 file - promoters50/4283453
catgttcta

SEQ ID NO: 186902 - DNA, 9 bp, Unknown
  misc_feature (1)..( 9): Result.005 file - promoters50/4283453
cattttcag

SEQ ID NO: 186903 - DNA, 9 bp, Unknown
  misc_feature (1)..( 9): Result.005 file - promoters50/4283453
cgtcaaatt

SEQ ID NO: 186904 - DNA, 9 bp, Unknown
  misc_feature (1)..( 9): Result.005 file - promoters50/4283453
cgtcaaaaa

SEQ ID NO: 186905 - DNA, 9 bp, Unknown
  misc_feature (1)..( 9): Result.005 file - promoters50/4283453
attcaaaaa

SEQ ID NO: 186906 - DNA, 9 bp, Unknown
  misc_feature (1)..( 9): Result.005 file - promoters50/4283453
gtttgcaaa

SEQ ID NO: 186907 - DNA, 9 bp, Unknown
  misc_feature (1)..( 9): Result.005 file - promoters50/4283453
atttccaaa

SEQ ID NO: 186908 - DNA, 9 bp, Unknown
  misc_feature (1)..( 9): Result.005 file - promoters50/4283453
attaccatt

SEQ ID NO: 186909 - DNA, 10 bp, Unknown
  misc_feature (1)..( 10): Result.005 file - promoters50/4283476
gtttgattta

SEQ ID NO: 186910 - DNA, 10 bp, Unknown
  misc_feature (1)..( 10): Result.005 file - promoters50/4283476
gtttgagatt

SEQ ID NO: 186911 - DNA, 10 bp, Unknown
  misc_feature (1)..( 10): Result.005 file - promoters50/4283476
cttttattta

SEQ ID NO: 186912 - DNA, 8 bp, Unknown
  misc_feature (1)..( 8): Result.005 file - promoters50/4283482
ttctcagt

SEQ ID NO: 186913 - DNA, 8 bp, Unknown
  misc_feature (1)..( 8): Result.005 file - promoters50/4283482
ttctcaca

SEQ ID NO: 186914 - DNA, 8 bp, Unknown
  misc_feature (1)..( 8): Result.005 file - promoters50/4283482
ttctaagt

SEQ ID NO: 186915 - DNA, 13 bp, Unknown
  misc_feature (1)..( 13): Result.005 file - promoters50/4283522
catacattttact

SEQ ID NO: 186916 - DNA, 13 bp, Unknown
  misc_feature (1)..( 13): Result.005 file - promoters50/4283522
tgagcattttact

SEQ ID NO: 186917 - DNA, 13 bp, Unknown
  misc_feature (1)..( 13): Result.005 file - promoters50/4283522
ttcaacttttacc

SEQ ID NO: 186918 - DNA, 13 bp, Unknown
  misc_feature (1)..( 13): Result.005 file - promoters50/4283522
catagatttgtta

SEQ ID NO: 186919 - DNA, 8 bp, Unknown
  misc_feature (1)..( 8): Result.005 file - promoters50/4283522
aatgaaaa

SEQ ID NO: 186920 - DNA, 8 bp, Unknown
  misc_feature (1)..( 8): Result.005 file - promoters50/4283522
tatgtaaa

SEQ ID NO: 186921 - DNA, 8 bp, Unknown
  misc_feature (1)..( 8): Result.005 file - promoters50/4283522
aattaaaa

SEQ ID NO: 186922 - DNA, 8 bp, Unknown
  misc_feature (1)..( 8): Result.005 file - promoters50/4283522
tatttaaa

SEQ ID NO: 186923 - DNA, 9 bp, Unknown
  misc_feature (1)..( 9): Result.005 file - promoters50/4283522
cttctctct

SEQ ID NO: 186924 - DNA, 9 bp, Unknown
  misc_feature (1)..( 9): Result.005 file - promoters50/4283522
cttttctat

SEQ ID NO: 186925 - DNA, 9 bp, Unknown
  misc_feature (1)..( 9): Result.005 file - promoters50/4283522
aatttctat

SEQ ID NO: 186926 - DNA, 9 bp, Unknown
  misc_feature (1)..( 9): Result.005 file - promoters50/4283522
cctttatat

SEQ ID NO: 186927 - DNA, 7 bp, Unknown
  misc_feature (1)..( 7): Result.005 file - promoters50/4283522
attctat

SEQ ID NO: 186928 - DNA, 7 bp, Unknown
  misc_feature (1)..( 7): Result.005 file - promoters50/4283522
tttctat

SEQ ID NO: 186929 - DNA, 7 bp, Unknown
  misc_feature (1)..( 7): Result.005 file - promoters50/4283522
tttctat

SEQ ID NO: 186930 - DNA, 7 bp, Unknown
  misc_feature (1)..( 7): Result.005 file - promoters50/4283522
tttatat

SEQ ID NO: 186931 - DNA, 11 bp, Unknown
  misc_feature (1)..( 11): Result.005 file - promoters50/4283550
tttttatatat

SEQ ID NO: 186932 - DNA, 11 bp, Unknown
  misc_feature (1)..( 11): Result.005 file - promoters50/4283550
aatttatttat

SEQ ID NO: 186933 - DNA, 11 bp, Unknown
  misc_feature (1)..( 11): Result.005 file - promoters50/4283550
aattgattcaa

SEQ ID NO: 186934 - DNA, 8 bp, Unknown
  misc_feature (1)..( 8): Result.005 file - promoters50/4283550
tatgtttt

SEQ ID NO: 186935 - DNA, 8 bp, Unknown
  misc_feature (1)..( 8): Result.005 file - promoters50/4283550
tatgtttt

SEQ ID NO: 186936 - DNA, 8 bp, Unknown
  misc_feature (1)..( 8): Result.005 file - promoters50/4283550
tatgcttt

SEQ ID NO: 186937 - DNA, 12 bp, Unknown
  misc_feature (1)..( 12): Result.005 file - promoters50/4283550
ttcggatatttt

SEQ ID NO: 186938 - DNA, 12 bp, Unknown
  misc_feature (1)..( 12): Result.005 file - promoters50/4283550
ttggaataattt

SEQ ID NO: 186939 - DNA, 12 bp, Unknown
  misc_feature (1)..( 12): Result.005 file - promoters50/4283550
ttctgatattat

SEQ ID NO: 186940 - DNA, 9 bp, Unknown
  misc_feature (1)..( 9): Result.005 file - promoters50/4283550
acaaatttg

SEQ ID NO: 186941 - DNA, 9 bp, Unknown
  misc_feature (1)..( 9): Result.005 file - promoters50/4283550
gataatttg

SEQ ID NO: 186942 - DNA, 9 bp, Unknown
  misc_feature (1)..( 9): Result.005 file - promoters50/4283550
gatgatttg

SEQ ID NO: 186943 - DNA, 9 bp, Unknown
  misc_feature (1)..( 9): Result.005 file - promoters50/4283554
cattttgta

SEQ ID NO: 186944 - DNA, 9 bp, Unknown
  misc_feature (1)..( 9): Result.005 file - promoters50/4283554
cattatgtc

SEQ ID NO: 186945 - DNA, 9 bp, Unknown
  misc_feature (1)..( 9): Result.005 file - promoters50/4283554
aatttagta

SEQ ID NO: 186946 - DNA, 7 bp, Unknown
  misc_feature (1)..( 7): Result.005 file - promoters50/4283554
ttgtttt

SEQ ID NO: 186947 - DNA, 7 bp, Unknown
  misc_feature (1)..( 7): Result.005 file - promoters50/4283554
ttgtttt

SEQ ID NO: 186948 - DNA, 7 bp, Unknown
  misc_feature (1)..( 7): Result.005 file - promoters50/4283554
gtgtttt

SEQ ID NO: 186949 - DNA, 8 bp, Unknown
  misc_feature (1)..( 8): Result.005 file - promoters50/4283554
attatttt

SEQ ID NO: 186950 - DNA, 8 bp, Unknown
  misc_feature (1)..( 8): Result.005 file - promoters50/4283554
attattaa

SEQ ID NO: 186951 - DNA, 8 bp, Unknown
  misc_feature (1)..( 8): Result.005 file - promoters50/4283554
tttactaa

SEQ ID NO: 186952 - DNA, 12 bp, Unknown
  misc_feature (1)..( 12): Result.005 file - promoters50/4283564
tcagaaccaaac

SEQ ID NO: 186953 - DNA, 12 bp, Unknown
  misc_feature (1)..( 12): Result.005 file - promoters50/4283564
tcataactctgt

SEQ ID NO: 186954 - DNA, 12 bp, Unknown
  misc_feature (1)..( 12): Result.005 file - promoters50/4283564
agagaacaaaac

SEQ ID NO: 186955 - DNA, 12 bp, Unknown
  misc_feature (1)..( 12): Result.005 file - promoters50/4283564
ccaaaaaaaaaa

SEQ ID NO: 186956 - DNA, 12 bp, Unknown
  misc_feature (1)..( 12): Result.005 file - promoters50/4283564
cgaaaacacaag

SEQ ID NO: 186957 - DNA, 7 bp, Unknown
  misc_feature (1)..( 7): Result.005 file - promoters50/4283573
aaaaatc

SEQ ID NO: 186958 - DNA, 7 bp, Unknown
  misc_feature (1)..( 7): Result.005 file - promoters50/4283573
aaacatc

SEQ ID NO: 186959 - DNA, 7 bp, Unknown
  misc_feature (1)..( 7): Result.005 file - promoters50/4283573
aaaaatt

SEQ ID NO: 186960 - DNA, 7 bp, Unknown
  misc_feature (1)..( 7): Result.005 file - promoters50/4283573
taagaat

SEQ ID NO: 186961 - DNA, 7 bp, Unknown
  misc_feature (1)..( 7): Result.005 file - promoters50/4283573
taaaaat

SEQ ID NO: 186962 - DNA, 7 bp, Unknown
  misc_feature (1)..( 7): Result.005 file - promoters50/4283573
taataat

SEQ ID NO: 186963 - DNA, 13 bp, Unknown
  misc_feature (1)..( 13): Result.005 file - promoters50/4283579
acaaatatatata

SEQ ID NO: 186964 - DNA, 13 bp, Unknown
  misc_feature (1)..( 13): Result.005 file - promoters50/4283579
tcaaatagagaga

SEQ ID NO: 186965 - DNA, 13 bp, Unknown
  misc_feature (1)..( 13): Result.005 file - promoters50/4283579
acaaaaaataaat

SEQ ID NO: 186966 - DNA, 13 bp, Unknown
  misc_feature (1)..( 13): Result.005 file - promoters50/4283579
aaaaacagaataa

SEQ ID NO: 186967 - DNA, 13 bp, Unknown
  misc_feature (1)..( 13): Result.005 file - promoters50/4283579
agaaacagaggat

SEQ ID NO: 186968 - DNA, 13 bp, Unknown
  misc_feature (1)..( 13): Result.005 file - promoters50/4283579
agaaaaatgtaaa

SEQ ID NO: 186969 - DNA, 9 bp, Unknown
  misc_feature (1)..( 9): Result.005 file - promoters50/4283591
taaatattt

SEQ ID NO: 186970 - DNA, 9 bp, Unknown
  misc_feature (1)..( 9): Result.005 file - promoters50/4283591
caaatatat

SEQ ID NO: 186971 - DNA, 9 bp, Unknown
  misc_feature (1)..( 9): Result.005 file - promoters50/4283591
caaatatat

SEQ ID NO: 186972 - DNA, 9 bp, Unknown
  misc_feature (1)..( 9): Result.005 file - promoters50/4283591
tttttatac

SEQ ID NO: 186973 - DNA, 9 bp, Unknown
  misc_feature (1)..( 9): Result.005 file - promoters50/4283591
tttttattt

SEQ ID NO: 186974 - DNA, 9 bp, Unknown
  misc_feature (1)..( 9): Result.005 file - promoters50/4283591
attttgttt

SEQ ID NO: 186975 - DNA, 9 bp, Unknown
  misc_feature (1)..( 9): Result.005 file - promoters50/4283591
gaaaatttt

SEQ ID NO: 186976 - DNA, 9 bp, Unknown
  misc_feature (1)..( 9): Result.005 file - promoters50/4283591
taaaacttt

SEQ ID NO: 186977 - DNA, 9 bp, Unknown
  misc_feature (1)..( 9): Result.005 file - promoters50/4283591
aaaaattta

SEQ ID NO: 186978 - DNA, 7 bp, Unknown
  misc_feature (1)..( 7): Result.005 file - promoters50/4283591
ttttaaa

SEQ ID NO: 186979 - DNA, 7 bp, Unknown
  misc_feature (1)..( 7): Result.005 file - promoters50/4283591
ttttaaa

SEQ ID NO: 186980 - DNA, 7 bp, Unknown
  misc_feature (1)..( 7): Result.005 file - promoters50/4283591
atttaaa

SEQ ID NO: 186981 - DNA, 9 bp, Unknown
  misc_feature (1)..( 9): Result.005 file - promoters50/4283591
cataaacta

SEQ ID NO: 186982 - DNA, 9 bp, Unknown
  misc_feature (1)..( 9): Result.005 file - promoters50/4283591
catacacta

SEQ ID NO: 186983 - DNA, 9 bp, Unknown
  misc_feature (1)..( 9): Result.005 file - promoters50/4283591
cataaaaat

SEQ ID NO: 186984 - DNA, 8 bp, Unknown
  misc_feature (1)..( 8): Result.005 file - promoters50/4283591
ttatttta

SEQ ID NO: 186985 - DNA, 8 bp, Unknown
  misc_feature (1)..( 8): Result.005 file - promoters50/4283591
ttaattta

SEQ ID NO: 186986 - DNA, 8 bp, Unknown
  misc_feature (1)..( 8): Result.005 file - promoters50/4283591
ttaatttc

SEQ ID NO: 186987 - DNA, 11 bp, Unknown
  misc_feature (1)..( 11): Result.005 file - promoters50/4283591
tgaatttatat

SEQ ID NO: 186988 - DNA, 11 bp, Unknown
  misc_feature (1)..( 11): Result.005 file - promoters50/4283591
caaatatatat

SEQ ID NO: 186989 - DNA, 11 bp, Unknown
  misc_feature (1)..( 11): Result.005 file - promoters50/4283591
caaatatatgt

SEQ ID NO: 186990 - DNA, 12 bp, Unknown
  misc_feature (1)..( 12): Result.005 file - promoters50/4283591
tttgaaatgtgt

SEQ ID NO: 186991 - DNA, 12 bp, Unknown
  misc_feature (1)..( 12): Result.005 file - promoters50/4283591
tttcaaatatat

SEQ ID NO: 186992 - DNA, 12 bp, Unknown
  misc_feature (1)..( 12): Result.005 file - promoters50/4283591
atccaaatatat

SEQ ID NO: 186993 - DNA, 10 bp, Unknown
  misc_feature (1)..( 10): Result.005 file - promoters50/4283591
aaactactct

SEQ ID NO: 186994 - DNA, 10 bp, Unknown
  misc_feature (1)..( 10): Result.005 file - promoters50/4283591
aaactatata

SEQ ID NO: 186995 - DNA, 10 bp, Unknown
  misc_feature (1)..( 10): Result.005 file - promoters50/4283591
aaaatatata

SEQ ID NO: 186996 - DNA, 10 bp, Unknown
  misc_feature (1)..( 10): Result.005 file - promoters50/4283591
ctactctatt

SEQ ID NO: 186997 - DNA, 10 bp, Unknown
  misc_feature (1)..( 10): Result.005 file - promoters50/4283591
aaactatata

SEQ ID NO: 186998 - DNA, 10 bp, Unknown
  misc_feature (1)..( 10): Result.005 file - promoters50/4283591
aaaatatata

SEQ ID NO: 186999 - DNA, 11 bp, Unknown
  misc_feature (1)..( 11): Result.005 file - promoters50/4283591
agatataaata

SEQ ID NO: 187000 - DNA, 11 bp, Unknown
  misc_feature (1)..( 11): Result.005 file - promoters50/4283591
ccatatatata

SEQ ID NO: 187001 - DNA, 11 bp, Unknown
  misc_feature (1)..( 11): Result.005 file - promoters50/4283591
ccatctataaa

SEQ ID NO: 187002 - DNA, 8 bp, Unknown
  misc_feature (1)..( 8): Result.005 file - promoters50/4283591
tacaaatt

SEQ ID NO: 187003 - DNA, 8 bp, Unknown
  misc_feature (1)..( 8): Result.005 file - promoters50/4283591
tacaaaac

SEQ ID NO: 187004 - DNA, 9 bp, Unknown
  misc_feature (1)..( 9): Result.005 file - promoters50/4283591
cacataacc

SEQ ID NO: 187005 - DNA, 7 bp, Unknown
  misc_feature (1)..( 7): Result.005 file - promoters50/4283591
gtttaat

SEQ ID NO: 187006 - DNA, 7 bp, Unknown
  misc_feature (1)..( 7): Result.005 file - promoters50/4283591
gtttaaa

SEQ ID NO: 187007 - DNA, 7 bp, Unknown
  misc_feature (1)..( 7): Result.005 file - promoters50/4283591
ttttaaa

SEQ ID NO: 187008 - DNA, 8 bp, Unknown
  misc_feature (1)..( 8): Result.005 file - promoters50/4283591
tctttttc

SEQ ID NO: 187009 - DNA, 8 bp, Unknown
  misc_feature (1)..( 8): Result.005 file - promoters50/4283591
tgtttttc

SEQ ID NO: 187010 - DNA, 8 bp, Unknown
  misc_feature (1)..( 8): Result.005 file - promoters50/4283591
tgttttta

SEQ ID NO: 187011 - DNA, 8 bp, Unknown
  misc_feature (1)..( 8): Result.005 file - promoters50/4283591
aaacatta

SEQ ID NO: 187012 - DNA, 8 bp, Unknown
  misc_feature (1)..( 8): Result.005 file - promoters50/4283591
aaaaatta

SEQ ID NO: 187013 - DNA, 8 bp, Unknown
  misc_feature (1)..( 8): Result.005 file - promoters50/4283591
aaaaatta

SEQ ID NO: 187014 - DNA, 8 bp, Unknown
  misc_feature (1)..( 8): Result.005 file - promoters50/4283607
ttcttgcc

SEQ ID NO: 187015 - DNA, 8 bp, Unknown
  misc_feature (1)..( 8): Result.005 file - promoters50/4283607
ttctggcc

SEQ ID NO: 187016 - DNA, 8 bp, Unknown
  misc_feature (1)..( 8): Result.005 file - promoters50/4283607
gtcttgcg

SEQ ID NO: 187017 - DNA, 9 bp, Unknown
  misc_feature (1)..( 9): Result.005 file - promoters50/4283614
gaccataaa

SEQ ID NO: 187018 - DNA, 9 bp, Unknown
  misc_feature (1)..( 9): Result.005 file - promoters50/4283614
aaccctaaa

SEQ ID NO: 187019 - DNA, 9 bp, Unknown
  misc_feature (1)..( 9): Result.005 file - promoters50/4283614
aaccctcac

SEQ ID NO: 187020 - DNA, 11 bp, Unknown
  misc_feature (1)..( 11): Result.005 file - promoters50/4283616
agactacagag

SEQ ID NO: 187021 - DNA, 11 bp, Unknown
  misc_feature (1)..( 11): Result.005 file - promoters50/4283616
ggactaaagat

SEQ ID NO: 187022 - DNA, 11 bp, Unknown
  misc_feature (1)..( 11): Result.005 file - promoters50/4283616
agaatacaatc

SEQ ID NO: 187023 - DNA, 11 bp, Unknown
  misc_feature (1)..( 11): Result.005 file - promoters50/4283616
acattaccgag

SEQ ID NO: 187024 - DNA, 11 bp, Unknown
  misc_feature (1)..( 11): Result.005 file - promoters50/4283616
caaatatgatt

SEQ ID NO: 187025 - DNA, 11 bp, Unknown
  misc_feature (1)..( 11): Result.005 file - promoters50/4283616
agacaaaacaa

SEQ ID NO: 187026 - DNA, 11 bp, Unknown
  misc_feature (1)..( 11): Result.005 file - promoters50/4283616
agaccaaagaa

SEQ ID NO: 187027 - DNA, 9 bp, Unknown
  misc_feature (1)..( 9): Result.005 file - promoters50/4283616
agtgaagag

SEQ ID NO: 187028 - DNA, 9 bp, Unknown
  misc_feature (1)..( 9): Result.005 file - promoters50/4283616
gatgaagaa

SEQ ID NO: 187029 - DNA, 9 bp, Unknown
  misc_feature (1)..( 9): Result.005 file - promoters50/4283616
gattaagtt

SEQ ID NO: 187030 - DNA, 9 bp, Unknown
  misc_feature (1)..( 9): Result.005 file - promoters50/4283616
ttggaagaa

SEQ ID NO: 187031 - DNA, 9 bp, Unknown
  misc_feature (1)..( 9): Result.005 file - promoters50/4283616
gattaaaat

SEQ ID NO: 187032 - DNA, 9 bp, Unknown
  misc_feature (1)..( 9): Result.005 file - promoters50/4283616
aattaaata

SEQ ID NO: 187033 - DNA, 9 bp, Unknown
  misc_feature (1)..( 9): Result.005 file - promoters50/4283616
gaggaagaa

SEQ ID NO: 187034 - DNA, 15 bp, Unknown
  misc_feature (1)..( 15): Result.005 file - promoters50/4283616
ctccgtttaagcttt

SEQ ID NO: 187035 - DNA, 15 bp, Unknown
  misc_feature (1)..( 15): Result.005 file - promoters50/4283616
tataccttaaacttt

SEQ ID NO: 187036 - DNA, 15 bp, Unknown
  misc_feature (1)..( 15): Result.005 file - promoters50/4283616
tttttagtaaacttt

SEQ ID NO: 187037 - DNA, 15 bp, Unknown
  misc_feature (1)..( 15): Result.005 file - promoters50/4283616
tccctcctaaaaacg

SEQ ID NO: 187038 - DNA, 15 bp, Unknown
  misc_feature (1)..( 15): Result.005 file - promoters50/4283616
aaacaagtaaaattt

SEQ ID NO: 187039 - DNA, 15 bp, Unknown
  misc_feature (1)..( 15): Result.005 file - promoters50/4283616
gaacgcataagctta

SEQ ID NO: 187040 - DNA, 15 bp, Unknown
  misc_feature (1)..( 15): Result.005 file - promoters50/4283616
aaacaagtaatcaaa

SEQ ID NO: 187041 - DNA, 10 bp, Unknown
  misc_feature (1)..( 10): Result.005 file - promoters50/4283620
atgttattca

SEQ ID NO: 187042 - DNA, 10 bp, Unknown
  misc_feature (1)..( 10): Result.005 file - promoters50/4283620
tggttattca

SEQ ID NO: 187043 - DNA, 10 bp, Unknown
  misc_feature (1)..( 10): Result.005 file - promoters50/4283620
tggtcattat

SEQ ID NO: 187044 - DNA, 9 bp, Unknown
  misc_feature (1)..( 9): Result.005 file - promoters50/4283620
gttaacatc

SEQ ID NO: 187045 - DNA, 9 bp, Unknown
  misc_feature (1)..( 9): Result.005 file - promoters50/4283620
ttcaacatc

SEQ ID NO: 187046 - DNA, 9 bp, Unknown
  misc_feature (1)..( 9): Result.005 file - promoters50/4283620
ttctacatg

SEQ ID NO: 187047 - DNA, 10 bp, Unknown
  misc_feature (1)..( 10): Result.005 file - promoters50/4283620
aaattatttt

SEQ ID NO: 187048 - DNA, 10 bp, Unknown
  misc_feature (1)..( 10): Result.005 file - promoters50/4283620
aaataattga

SEQ ID NO: 187049 - DNA, 10 bp, Unknown
  misc_feature (1)..( 10): Result.005 file - promoters50/4283620
tggtaattga

SEQ ID NO: 187050 - DNA, 9 bp, Unknown
  misc_feature (1)..( 9): Result.005 file - promoters50/4283620
aatattggt

SEQ ID NO: 187051 - DNA, 9 bp, Unknown
  misc_feature (1)..( 9): Result.005 file - promoters50/4283620
aattttggt

SEQ ID NO: 187052 - DNA, 9 bp, Unknown
  misc_feature (1)..( 9): Result.005 file - promoters50/4283620
aattttacg

SEQ ID NO: 187053 - DNA, 8 bp, Unknown
  misc_feature (1)..( 8): Result.005 file - promoters50/4283626
tataattt

SEQ ID NO: 187054 - DNA, 8 bp, Unknown
  misc_feature (1)..( 8): Result.005 file - promoters50/4283626
attaattt

SEQ ID NO: 187055 - DNA, 8 bp, Unknown
  misc_feature (1)..( 8): Result.005 file - promoters50/4283626
tattatta

SEQ ID NO: 187056 - DNA, 10 bp, Unknown
  misc_feature (1)..( 10): Result.005 file - promoters50/4283626
tttaatttcc

SEQ ID NO: 187057 - DNA, 10 bp, Unknown
  misc_feature (1)..( 10): Result.005 file - promoters50/4283626
tttaatttat

SEQ ID NO: 187058 - DNA, 10 bp, Unknown
  misc_feature (1)..( 10): Result.005 file - promoters50/4283626
ctcaatctcc

SEQ ID NO: 187059 - DNA, 8 bp, Unknown
  misc_feature (1)..( 8): Result.005 file - promoters50/4283632
tttattat

SEQ ID NO: 187060 - DNA, 8 bp, Unknown
  misc_feature (1)..( 8): Result.005 file - promoters50/4283632
attactat

SEQ ID NO: 187061 - DNA, 8 bp, Unknown
  misc_feature (1)..( 8): Result.005 file - promoters50/4283632
tttcttat

SEQ ID NO: 187062 - DNA, 8 bp, Unknown
  misc_feature (1)..( 8): Result.005 file - promoters50/4304982
aaataaat

SEQ ID NO: 187063 - DNA, 8 bp, Unknown
  misc_feature (1)..( 8): Result.005 file - promoters50/4304982
aaataaac

SEQ ID NO: 187064 - DNA, 9 bp, Unknown
  misc_feature (1)..( 9): Result.005 file - promoters50/4304982
ttgataaat

SEQ ID NO: 187065 - DNA, 9 bp, Unknown
  misc_feature (1)..( 9): Result.005 file - promoters50/4304982
aaagtaatt

SEQ ID NO: 187066 - DNA, 9 bp, Unknown
  misc_feature (1)..( 9): Result.005 file - promoters50/4304982
aaattaaat

SEQ ID NO: 187067 - DNA, 9 bp, Unknown
  misc_feature (1)..( 9): Result.005 file - promoters50/4304982
gaagcaata

SEQ ID NO: 187068 - DNA, 12 bp, Unknown
  misc_feature (1)..( 12): Result.005 file - promoters50/4304982
gaaataaatgac

SEQ ID NO: 187069 - DNA, 12 bp, Unknown
  misc_feature (1)..( 12): Result.005 file - promoters50/4304982
taaattaattaa

SEQ ID NO: 187070 - DNA, 12 bp, Unknown
  misc_feature (1)..( 12): Result.005 file - promoters50/4304982
cttatagatgta

SEQ ID NO: 187071 - DNA, 12 bp, Unknown
  misc_feature (1)..( 12): Result.005 file - promoters50/4304982
aaaataaactaa

SEQ ID NO: 187072 - DNA, 12 bp, Unknown
  misc_feature (1)..( 12): Result.005 file - promoters50/4304982
caaattaaatca

SEQ ID NO: 187073 - DNA, 12 bp, Unknown
  misc_feature (1)..( 12): Result.005 file - promoters50/4304982
cacattatcgat

SEQ ID NO: 187074 - DNA, 10 bp, Unknown
  misc_feature (1)..( 10): Result.005 file - promoters50/4304982
tatgttaaca

SEQ ID NO: 187075 - DNA, 10 bp, Unknown
  misc_feature (1)..( 10): Result.005 file - promoters50/4304982
aatgataaat

SEQ ID NO: 187076 - DNA, 10 bp, Unknown
  misc_feature (1)..( 10): Result.005 file - promoters50/4304982
aatgatggct

SEQ ID NO: 187077 - DNA, 10 bp, Unknown
  misc_feature (1)..( 10): Result.005 file - promoters50/4304982
aatgattaca

SEQ ID NO: 187078 - DNA, 10 bp, Unknown
  misc_feature (1)..( 10): Result.005 file - promoters50/4304982
tttgacaaat

SEQ ID NO: 187079 - DNA, 10 bp, Unknown
  misc_feature (1)..( 10): Result.005 file - promoters50/4304982
tattacaaat

SEQ ID NO: 187080 - DNA, 8 bp, Unknown
  misc_feature (1)..( 8): Result.005 file - promoters50/4305800
gtattact

SEQ ID NO: 187081 - DNA, 8 bp, Unknown
  misc_feature (1)..( 8): Result.005 file - promoters50/4305800
atattacg

SEQ ID NO: 187082 - DNA, 8 bp, Unknown
  misc_feature (1)..( 8): Result.005 file - promoters50/4305800
agattact

SEQ ID NO: 187083 - DNA, 8 bp, Unknown
  misc_feature (1)..( 8): Result.005 file - promoters50/4305800
gtagtaca

SEQ ID NO: 187084 - DNA, 9 bp, Unknown
  misc_feature (1)..( 9): Result.005 file - promoters50/4305800
agtatttgt

SEQ ID NO: 187085 - DNA, 9 bp, Unknown
  misc_feature (1)..( 9): Result.005 file - promoters50/4305800
agaatttgt

SEQ ID NO: 187086 - DNA, 9 bp, Unknown
  misc_feature (1)..( 9): Result.005 file - promoters50/4305800
agaaattgc

SEQ ID NO: 187087 - DNA, 8 bp, Unknown
  misc_feature (1)..( 8): Result.005 file - promoters50/4305800
tcctgctg

SEQ ID NO: 187088 - DNA, 8 bp, Unknown
  misc_feature (1)..( 8): Result.005 file - promoters50/4305800
tccagcta

SEQ ID NO: 187089 - DNA, 8 bp, Unknown
  misc_feature (1)..( 8): Result.005 file - promoters50/4305800
ttctgctg

SEQ ID NO: 187090 - DNA, 9 bp, Unknown
  misc_feature (1)..( 9): Result.005 file - promoters50/4305800
ttgacttgt

SEQ ID NO: 187091 - DNA, 9 bp, Unknown
  misc_feature (1)..( 9): Result.005 file - promoters50/4305800
tccacttgt

SEQ ID NO: 187092 - DNA, 9 bp, Unknown
  misc_feature (1)..( 9): Result.005 file - promoters50/4305800
tccacgtgt

SEQ ID NO: 187093 - DNA, 10 bp, Unknown
  misc_feature (1)..( 10): Result.005 file - promoters50/4307922
atatagaaat

SEQ ID NO: 187094 - DNA, 10 bp, Unknown
  misc_feature (1)..( 10): Result.005 file - promoters50/4307922
ataaagaggt

SEQ ID NO: 187095 - DNA, 10 bp, Unknown
  misc_feature (1)..( 10): Result.005 file - promoters50/4307922
ttattgaaat

SEQ ID NO: 187096 - DNA, 11 bp, Unknown
  misc_feature (1)..( 11): Result.005 file - promoters50/4378608
agatttacaag

SEQ ID NO: 187097 - DNA, 11 bp, Unknown
  misc_feature (1)..( 11): Result.005 file - promoters50/4378608
caattttcaat

SEQ ID NO: 187098 - DNA, 11 bp, Unknown
  misc_feature (1)..( 11): Result.005 file - promoters50/4378608
cattttacatc

SEQ ID NO: 187099 - DNA, 11 bp, Unknown
  misc_feature (1)..( 11): Result.005 file - promoters50/4378608
gaatttactga

SEQ ID NO: 187100 - DNA, 11 bp, Unknown
  misc_feature (1)..( 11): Result.005 file - promoters50/4378608
aaatttttttc

SEQ ID NO: 187101 - DNA, 11 bp, Unknown
  misc_feature (1)..( 11): Result.005 file - promoters50/4378608
aaggttatatc

SEQ ID NO: 187102 - DNA, 11 bp, Unknown
  misc_feature (1)..( 11): Result.005 file - promoters50/4378608
ggttttatgtt

SEQ ID NO: 187103 - DNA, 11 bp, Unknown
  misc_feature (1)..( 11): Result.005 file - promoters50/4577400
atgtaattaag

SEQ ID NO: 187104 - DNA, 11 bp, Unknown
  misc_feature (1)..( 11): Result.005 file - promoters50/4577400
ccagaattaag

SEQ ID NO: 187105 - DNA, 11 bp, Unknown
  misc_feature (1)..( 11): Result.005 file - promoters50/4577400
aaaacattaag

SEQ ID NO: 187106 - DNA, 11 bp, Unknown
  misc_feature (1)..( 11): Result.005 file - promoters50/4577400
ccataattagt

SEQ ID NO: 187107 - DNA, 11 bp, Unknown
  misc_feature (1)..( 11): Result.005 file - promoters50/4577400
atatatttata

SEQ ID NO: 187108 - DNA, 11 bp, Unknown
  misc_feature (1)..( 11): Result.005 file - promoters50/4577400
aaatacttaag

SEQ ID NO: 187109 - DNA, 11 bp, Unknown
  misc_feature (1)..( 11): Result.005 file - promoters50/4577400
aaataattaaa

SEQ ID NO: 187110 - DNA, 12 bp, Unknown
  misc_feature (1)..( 12): Result.005 file - promoters50/4577400
taaaattaaagg

SEQ ID NO: 187111 - DNA, 12 bp, Unknown
  misc_feature (1)..( 12): Result.005 file - promoters50/4577400
gtaaataaaaat

SEQ ID NO: 187112 - DNA, 12 bp, Unknown
  misc_feature (1)..( 12): Result.005 file - promoters50/4577400
gtacataattga

SEQ ID NO: 187113 - DNA, 12 bp, Unknown
  misc_feature (1)..( 12): Result.005 file - promoters50/4577400
atgtgtaaaaat

SEQ ID NO: 187114 - DNA, 12 bp, Unknown
  misc_feature (1)..( 12): Result.005 file - promoters50/4577400
gaaaataccctt

SEQ ID NO: 187115 - DNA, 12 bp, Unknown
  misc_feature (1)..( 12): Result.005 file - promoters50/4577400
actaataattat

SEQ ID NO: 187116 - DNA, 10 bp, Unknown
  misc_feature (1)..( 10): Result.005 file - promoters50/4607469
ctctttctct

SEQ ID NO: 187117 - DNA, 10 bp, Unknown
  misc_feature (1)..( 10): Result.005 file - promoters50/4607469
gtctctctct

SEQ ID NO: 187118 - DNA, 10 bp, Unknown
  misc_feature (1)..( 10): Result.005 file - promoters50/4607469
ttctctctcg

SEQ ID NO: 187119 - DNA, 8 bp, Unknown
  misc_feature (1)..( 8): Result.005 file - promoters50/4607469
aaattaaa

SEQ ID NO: 187120 - DNA, 8 bp, Unknown
  misc_feature (1)..( 8): Result.005 file - promoters50/4607469
aaatcaaa

SEQ ID NO: 187121 - DNA, 8 bp, Unknown
  misc_feature (1)..( 8): Result.005 file - promoters50/4607469
aaatcata

SEQ ID NO: 187122 - DNA, 8 bp, Unknown
  misc_feature (1)..( 8): Result.005 file - promoters50/4607469
caataaat

SEQ ID NO: 187123 - DNA, 8 bp, Unknown
  misc_feature (1)..( 8): Result.005 file - promoters50/4607469
aaatcaat

SEQ ID NO: 187124 - DNA, 8 bp, Unknown
  misc_feature (1)..( 8): Result.005 file - promoters50/4607469
aaatcata

SEQ ID NO: 187125 - DNA, 8 bp, Unknown
  misc_feature (1)..( 8): Result.005 file - promoters50/4607671
ttatataa

SEQ ID NO: 187126 - DNA, 8 bp, Unknown
  misc_feature (1)..( 8): Result.005 file - promoters50/4607671
ttatttaa

SEQ ID NO: 187127 - DNA, 8 bp, Unknown
  misc_feature (1)..( 8): Result.005 file - promoters50/4607671
gtatctaa

SEQ ID NO: 187128 - DNA, 9 bp, Unknown
  misc_feature (1)..( 9): Result.005 file - promoters50/4607671
aagtttaat

SEQ ID NO: 187129 - DNA, 9 bp, Unknown
  misc_feature (1)..( 9): Result.005 file - promoters50/4607671
aagtttttc

SEQ ID NO: 187130 - DNA, 9 bp, Unknown
  misc_feature (1)..( 9): Result.005 file - promoters50/4607671
cagtttttc

SEQ ID NO: 187131 - DNA, 13 bp, Unknown
  misc_feature (1)..( 13): Result.005 file - promoters50/4607671
attaacaaaatta

SEQ ID NO: 187132 - DNA, 13 bp, Unknown
  misc_feature (1)..( 13): Result.005 file - promoters50/4607671
taagataaagtta

SEQ ID NO: 187133 - DNA, 13 bp, Unknown
  misc_feature (1)..( 13): Result.005 file - promoters50/4607671
ttaactaaatggt

SEQ ID NO: 187134 - DNA, 8 bp, Unknown
  misc_feature (1)..( 8): Result.005 file - promoters50/4607671
taagtttt

SEQ ID NO: 187135 - DNA, 8 bp, Unknown
  misc_feature (1)..( 8): Result.005 file - promoters50/4607671
ttagtttt

SEQ ID NO: 187136 - DNA, 8 bp, Unknown
  misc_feature (1)..( 8): Result.005 file - promoters50/4607671
taactttc

SEQ ID NO: 187137 - DNA, 7 bp, Unknown
  misc_feature (1)..( 7): Result.005 file - promoters50/4607671
acaaaaa

SEQ ID NO: 187138 - DNA, 7 bp, Unknown
  misc_feature (1)..( 7): Result.005 file - promoters50/4607671
acaaaaa

SEQ ID NO: 187139 - DNA, 7 bp, Unknown
  misc_feature (1)..( 7): Result.005 file - promoters50/4607671
aaataaa

SEQ ID NO: 187140 - DNA, 12 bp, Unknown
  misc_feature (1)..( 12): Result.005 file - promoters50/4607678
cctatttaaatt

SEQ ID NO: 187141 - DNA, 12 bp, Unknown
  misc_feature (1)..( 12): Result.005 file - promoters50/4607678
tctctttatatt

SEQ ID NO: 187142 - DNA, 12 bp, Unknown
  misc_feature (1)..( 12): Result.005 file - promoters50/4607678
ttattttaaagc

SEQ ID NO: 187143 - DNA, 12 bp, Unknown
  misc_feature (1)..( 12): Result.005 file - promoters50/4607678
cctatataaaga

SEQ ID NO: 187144 - DNA, 12 bp, Unknown
  misc_feature (1)..( 12): Result.005 file - promoters50/4607678
ttttcttatatt

SEQ ID NO: 187145 - DNA, 12 bp, Unknown
  misc_feature (1)..( 12): Result.005 file - promoters50/4607678
ataatataaagt

SEQ ID NO: 187146 - DNA, 8 bp, Unknown
  misc_feature (1)..( 8): Result.005 file - promoters50/4607692
taatatta

SEQ ID NO: 187147 - DNA, 8 bp, Unknown
  misc_feature (1)..( 8): Result.005 file - promoters50/4607692
taaaattt

SEQ ID NO: 187148 - DNA, 8 bp, Unknown
  misc_feature (1)..( 8): Result.005 file - promoters50/4607692
taaaattt

SEQ ID NO: 187149 - DNA, 8 bp, Unknown
  misc_feature (1)..( 8): Result.005 file - promoters50/4607692
aaaaatta

SEQ ID NO: 187150 - DNA, 8 bp, Unknown
  misc_feature (1)..( 8): Result.005 file - promoters50/4607692
aaaaatat

SEQ ID NO: 187151 - DNA, 8 bp, Unknown
  misc_feature (1)..( 8): Result.005 file - promoters50/4607692
aaagatta

SEQ ID NO: 187152 - DNA, 10 bp, Unknown
  misc_feature (1)..( 10): Result.005 file - promoters50/4607692
atataatatt

SEQ ID NO: 187153 - DNA, 10 bp, Unknown
  misc_feature (1)..( 10): Result.005 file - promoters50/4607692
ataaaattaa

SEQ ID NO: 187154 - DNA, 10 bp, Unknown
  misc_feature (1)..( 10): Result.005 file - promoters50/4607692
agaaaattaa

SEQ ID NO: 187155 - DNA, 10 bp, Unknown
  misc_feature (1)..( 10): Result.005 file - promoters50/4607692
cgaacattac

SEQ ID NO: 187156 - DNA, 10 bp, Unknown
  misc_feature (1)..( 10): Result.005 file - promoters50/4607692
taataattaa

SEQ ID NO: 187157 - DNA, 10 bp, Unknown
  misc_feature (1)..( 10): Result.005 file - promoters50/4607692
attaaatatg

SEQ ID NO: 187158 - DNA, 10 bp, Unknown
  misc_feature (1)..( 10): Result.005 file - promoters50/4607692
attgaatatt

SEQ ID NO: 187159 - DNA, 12 bp, Unknown
  misc_feature (1)..( 12): Result.005 file - promoters50/4607692
gaaaaacgttga

SEQ ID NO: 187160 - DNA, 12 bp, Unknown
  misc_feature (1)..( 12): Result.005 file - promoters50/4607692
aaaaaactaatg

SEQ ID NO: 187161 - DNA, 12 bp, Unknown
  misc_feature (1)..( 12): Result.005 file - promoters50/4607692
aaaacacgtggc

SEQ ID NO: 187162 - DNA, 12 bp, Unknown
  misc_feature (1)..( 12): Result.005 file - promoters50/4607692
gaaacacgtcaa

SEQ ID NO: 187163 - DNA, 12 bp, Unknown
  misc_feature (1)..( 12): Result.005 file - promoters50/4607692
taaataaattaa

SEQ ID NO: 187164 - DNA, 12 bp, Unknown
  misc_feature (1)..( 12): Result.005 file - promoters50/4607692
aaaataaagaaa

SEQ ID NO: 187165 - DNA, 17 bp, Unknown
  misc_feature (1)..( 17): Result.005 file - promoters50/4607692
taacttgtaaagaaaag

SEQ ID NO: 187166 - DNA, 17 bp, Unknown
  misc_feature (1)..( 17): Result.005 file - promoters50/4607692
ttactcgtaatatttgt

SEQ ID NO: 187167 - DNA, 17 bp, Unknown
  misc_feature (1)..( 17): Result.005 file - promoters50/4607692
taatttgtatctatatt

SEQ ID NO: 187168 - DNA, 17 bp, Unknown
  misc_feature (1)..( 17): Result.005 file - promoters50/4607692
ctctttttatttcttta

SEQ ID NO: 187169 - DNA, 17 bp, Unknown
  misc_feature (1)..( 17): Result.005 file - promoters50/4607692
cgtcgtttacttcaaaa

SEQ ID NO: 187170 - DNA, 17 bp, Unknown
  misc_feature (1)..( 17): Result.005 file - promoters50/4607692
tacgtttcatttattta

SEQ ID NO: 187171 - DNA, 13 bp, Unknown
  misc_feature (1)..( 13): Result.005 file - promoters50/4607692
aaaaaacaaataa

SEQ ID NO: 187172 - DNA, 13 bp, Unknown
  misc_feature (1)..( 13): Result.005 file - promoters50/4607692
aaaaaagaaatga

SEQ ID NO: 187173 - DNA, 13 bp, Unknown
  misc_feature (1)..( 13): Result.005 file - promoters50/4607692
ttattacagataa

SEQ ID NO: 187174 - DNA, 13 bp, Unknown
  misc_feature (1)..( 13): Result.005 file - promoters50/4607692
agaaaagagtaat

SEQ ID NO: 187175 - DNA, 13 bp, Unknown
  misc_feature (1)..( 13): Result.005 file - promoters50/4607692
ctaaaagaagaat

SEQ ID NO: 187176 - DNA, 13 bp, Unknown
  misc_feature (1)..( 13): Result.005 file - promoters50/4607692
taaaaatgactag

SEQ ID NO: 187177 - DNA, 9 bp, Unknown
  misc_feature (1)..( 9): Result.005 file - promoters50/4607692
tttatatat

SEQ ID NO: 187178 - DNA, 9 bp, Unknown
  misc_feature (1)..( 9): Result.005 file - promoters50/4607692
attaaatat

SEQ ID NO: 187179 - DNA, 9 bp, Unknown
  misc_feature (1)..( 9): Result.005 file - promoters50/4607692
agaaaatat

SEQ ID NO: 187180 - DNA, 9 bp, Unknown
  misc_feature (1)..( 9): Result.005 file - promoters50/4607692
gccaaatat

SEQ ID NO: 187181 - DNA, 9 bp, Unknown
  misc_feature (1)..( 9): Result.005 file - promoters50/4607692
ggcaaatac

SEQ ID NO: 187182 - DNA, 9 bp, Unknown
  misc_feature (1)..( 9): Result.005 file - promoters50/4607692
ggcaaatgt

SEQ ID NO: 187183 - DNA, 14 bp, Unknown
  misc_feature (1)..( 14): Result.005 file - promoters50/4607692
aaactctttttatt

SEQ ID NO: 187184 - DNA, 14 bp, Unknown
  misc_feature (1)..( 14): Result.005 file - promoters50/4607692
cattattttttact

SEQ ID NO: 187185 - DNA, 14 bp, Unknown
  misc_feature (1)..( 14): Result.005 file - promoters50/4607692
atttaatttgtatc

SEQ ID NO: 187186 - DNA, 15 bp, Unknown
  misc_feature (1)..( 15): Result.005 file - promoters50/4607692
tttcatttatttaca

SEQ ID NO: 187187 - DNA, 15 bp, Unknown
  misc_feature (1)..( 15): Result.005 file - promoters50/4607692
tccgaattctttaaa

SEQ ID NO: 187188 - DNA, 15 bp, Unknown
  misc_feature (1)..( 15): Result.005 file - promoters50/4607692
gtcgtttacttcaaa

SEQ ID NO: 187189 - DNA, 14 bp, Unknown
  misc_feature (1)..( 14): Result.005 file - promoters50/4607692
atagagttttttct

SEQ ID NO: 187190 - DNA, 14 bp, Unknown
  misc_feature (1)..( 14): Result.005 file - promoters50/4607692
aaaaagttttattt

SEQ ID NO: 187191 - DNA, 14 bp, Unknown
  misc_feature (1)..( 14): Result.005 file - promoters50/4607692
ctatagtttcattt

SEQ ID NO: 187192 - DNA, 14 bp, Unknown
  misc_feature (1)..( 14): Result.005 file - promoters50/4607692
acctatattctttt

SEQ ID NO: 187193 - DNA, 14 bp, Unknown
  misc_feature (1)..( 14): Result.005 file - promoters50/4607692
aaaaactttttacg

SEQ ID NO: 187194 - DNA, 14 bp, Unknown
  misc_feature (1)..( 14): Result.005 file - promoters50/4607692
tttgccttttggaa

SEQ ID NO: 187195 - DNA, 12 bp, Unknown
  misc_feature (1)..( 12): Result.005 file - promoters50/4607719
ttaatattttta

SEQ ID NO: 187196 - DNA, 12 bp, Unknown
  misc_feature (1)..( 12): Result.005 file - promoters50/4607719
agtataattttg

SEQ ID NO: 187197 - DNA, 12 bp, Unknown
  misc_feature (1)..( 12): Result.005 file - promoters50/4607719
ttattatgtttg

SEQ ID NO: 187198 - DNA, 12 bp, Unknown
  misc_feature (1)..( 12): Result.005 file - promoters50/4607719
ggagtaagattg

SEQ ID NO: 187199 - DNA, 12 bp, Unknown
  misc_feature (1)..( 12): Result.005 file - promoters50/4607719
cattcgagattg

SEQ ID NO: 187200 - DNA, 12 bp, Unknown
  misc_feature (1)..( 12): Result.005 file - promoters50/4607719
atggtcagattg

SEQ ID NO: 187201 - DNA, 12 bp, Unknown
  misc_feature (1)..( 12): Result.005 file - promoters50/4607719
gagggcagcttg

SEQ ID NO: 187202 - DNA, 9 bp, Unknown
  misc_feature (1)..( 9): Result.005 file - promoters50/4607719
taatttact

SEQ ID NO: 187203 - DNA, 9 bp, Unknown
  misc_feature (1)..( 9): Result.005 file - promoters50/4607719
caatttact

SEQ ID NO: 187204 - DNA, 9 bp, Unknown
  misc_feature (1)..( 9): Result.005 file - promoters50/4607719
ttatttatt

SEQ ID NO: 187205 - DNA, 9 bp, Unknown
  misc_feature (1)..( 9): Result.005 file - promoters50/4607719
tgttttact

SEQ ID NO: 187206 - DNA, 9 bp, Unknown
  misc_feature (1)..( 9): Result.005 file - promoters50/4607719
aaatttaag

SEQ ID NO: 187207 - DNA, 9 bp, Unknown
  misc_feature (1)..( 9): Result.005 file - promoters50/4607719
atatttaat

SEQ ID NO: 187208 - DNA, 12 bp, Unknown
  misc_feature (1)..( 12): Result.005 file - promoters50/4607719
ttatacaatatt

SEQ ID NO: 187209 - DNA, 12 bp, Unknown
  misc_feature (1)..( 12): Result.005 file - promoters50/4607719
agttacaatatc

SEQ ID NO: 187210 - DNA, 12 bp, Unknown
  misc_feature (1)..( 12): Result.005 file - promoters50/4607719
gacaacaataga

SEQ ID NO: 187211 - DNA, 12 bp, Unknown
  misc_feature (1)..( 12): Result.005 file - promoters50/4607719
agcagcaaaatt

SEQ ID NO: 187212 - DNA, 12 bp, Unknown
  misc_feature (1)..( 12): Result.005 file - promoters50/4607719
cgtttcaagttt

SEQ ID NO: 187213 - DNA, 12 bp, Unknown
  misc_feature (1)..( 12): Result.005 file - promoters50/4607719
cgtgtcacgtat

SEQ ID NO: 187214 - DNA, 10 bp, Unknown
  misc_feature (1)..( 10): Result.005 file - promoters50/4607719
agtgattaaa

SEQ ID NO: 187215 - DNA, 10 bp, Unknown
  misc_feature (1)..( 10): Result.005 file - promoters50/4607719
attgataaaa

SEQ ID NO: 187216 - DNA, 10 bp, Unknown
  misc_feature (1)..( 10): Result.005 file - promoters50/4607719
attgagtaaa

SEQ ID NO: 187217 - DNA, 10 bp, Unknown
  misc_feature (1)..( 10): Result.005 file - promoters50/4607719
tttgttaaaa

SEQ ID NO: 187218 - DNA, 10 bp, Unknown
  misc_feature (1)..( 10): Result.005 file - promoters50/4607719
tttgttacag

SEQ ID NO: 187219 - DNA, 10 bp, Unknown
  misc_feature (1)..( 10): Result.005 file - promoters50/4607719
ttggagtaat

SEQ ID NO: 187220 - DNA, 11 bp, Unknown
  misc_feature (1)..( 11): Result.005 file - promoters50/4607719
ctaaaataata

SEQ ID NO: 187221 - DNA, 11 bp, Unknown
  misc_feature (1)..( 11): Result.005 file - promoters50/4607719
taaaaatacac

SEQ ID NO: 187222 - DNA, 11 bp, Unknown
  misc_feature (1)..( 11): Result.005 file - promoters50/4607719
tttaaataaaa

SEQ ID NO: 187223 - DNA, 11 bp, Unknown
  misc_feature (1)..( 11): Result.005 file - promoters50/4607719
gaaaaacatag

SEQ ID NO: 187224 - DNA, 11 bp, Unknown
  misc_feature (1)..( 11): Result.005 file - promoters50/4607719
gctaaataaaa

SEQ ID NO: 187225 - DNA, 11 bp, Unknown
  misc_feature (1)..( 11): Result.005 file - promoters50/4607719
taaagatagca

SEQ ID NO: 187226 - DNA, 9 bp, Unknown
  misc_feature (1)..( 9): Result.005 file - promoters50/4607719
attagtaat

SEQ ID NO: 187227 - DNA, 9 bp, Unknown
  misc_feature (1)..( 9): Result.005 file - promoters50/4607719
tttagtaaa

SEQ ID NO: 187228 - DNA, 9 bp, Unknown
  misc_feature (1)..( 9): Result.005 file - promoters50/4607719
atgagtaat

SEQ ID NO: 187229 - DNA, 9 bp, Unknown
  misc_feature (1)..( 9): Result.005 file - promoters50/4607719
gttaggaaa

SEQ ID NO: 187230 - DNA, 10 bp, Unknown
  misc_feature (1)..( 10): Result.005 file - promoters50/4607719
gccagtcaaa

SEQ ID NO: 187231 - DNA, 10 bp, Unknown
  misc_feature (1)..( 10): Result.005 file - promoters50/4607719
tttagtggtt

SEQ ID NO: 187232 - DNA, 11 bp, Unknown
  misc_feature (1)..( 11): Result.005 file - promoters50/4608096
tttataaactc

SEQ ID NO: 187233 - DNA, 11 bp, Unknown
  misc_feature (1)..( 11): Result.005 file - promoters50/4608096
actataaaact

SEQ ID NO: 187234 - DNA, 11 bp, Unknown
  misc_feature (1)..( 11): Result.005 file - promoters50/4608096
tatataaatcc

SEQ ID NO: 187235 - DNA, 11 bp, Unknown
  misc_feature (1)..( 11): Result.005 file - promoters50/4608096
actataaatct

SEQ ID NO: 187236 - DNA, 11 bp, Unknown
  misc_feature (1)..( 11): Result.005 file - promoters50/4608096
tttatgaatcc

SEQ ID NO: 187237 - DNA, 11 bp, Unknown
  misc_feature (1)..( 11): Result.005 file - promoters50/4608096
tttataaaacc

SEQ ID NO: 187238 - DNA, 11 bp, Unknown
  misc_feature (1)..( 11): Result.005 file - promoters50/4608096
tatataagtat

SEQ ID NO: 187239 - DNA, 12 bp, Unknown
  misc_feature (1)..( 12): Result.005 file - promoters50/4608140
cgtttatgattt

SEQ ID NO: 187240 - DNA, 12 bp, Unknown
  misc_feature (1)..( 12): Result.005 file - promoters50/4608140
tagatatgataa

SEQ ID NO: 187241 - DNA, 12 bp, Unknown
  misc_feature (1)..( 12): Result.005 file - promoters50/4608140
gttgtataattt

SEQ ID NO: 187242 - DNA, 12 bp, Unknown
  misc_feature (1)..( 12): Result.005 file - promoters50/4608140
tcgtgatgtttt

SEQ ID NO: 187243 - DNA, 12 bp, Unknown
  misc_feature (1)..( 12): Result.005 file - promoters50/4608140
aacatatgacta

SEQ ID NO: 187244 - DNA, 12 bp, Unknown
  misc_feature (1)..( 12): Result.005 file - promoters50/4608140
atcatatgaaaa

SEQ ID NO: 187245 - DNA, 12 bp, Unknown
  misc_feature (1)..( 12): Result.005 file - promoters50/4608140
aacatttgaacc

SEQ ID NO: 187246 - DNA, 15 bp, Unknown
  misc_feature (1)..( 15): Result.005 file - promoters50/4608140
aaaaaaaaagttaag

SEQ ID NO: 187247 - DNA, 15 bp, Unknown
  misc_feature (1)..( 15): Result.005 file - promoters50/4608140
atcttcaaaattata

SEQ ID NO: 187248 - DNA, 15 bp, Unknown
  misc_feature (1)..( 15): Result.005 file - promoters50/4608140
aaaaaaaaagttttt

SEQ ID NO: 187249 - DNA, 15 bp, Unknown
  misc_feature (1)..( 15): Result.005 file - promoters50/4608140
tgaacttaagttact

SEQ ID NO: 187250 - DNA, 15 bp, Unknown
  misc_feature (1)..( 15): Result.005 file - promoters50/4608140
cagaaaatagtttac

SEQ ID NO: 187251 - DNA, 15 bp, Unknown
  misc_feature (1)..( 15): Result.005 file - promoters50/4608140
aggtttgaagtttga

SEQ ID NO: 187252 - DNA, 15 bp, Unknown
  misc_feature (1)..( 15): Result.005 file - promoters50/4608140
acaacaataatttac

SEQ ID NO: 187253 - DNA, 15 bp, Unknown
  misc_feature (1)..( 15): Result.005 file - promoters50/4608140
accaagatatttttg

SEQ ID NO: 187254 - DNA, 12 bp, Unknown
  misc_feature (1)..( 12): Result.005 file - promoters50/4608140
gttgtttattat

SEQ ID NO: 187255 - DNA, 12 bp, Unknown
  misc_feature (1)..( 12): Result.005 file - promoters50/4608140
tttgattagtaa

SEQ ID NO: 187256 - DNA, 12 bp, Unknown
  misc_feature (1)..( 12): Result.005 file - promoters50/4608140
tttggttaaaac

SEQ ID NO: 187257 - DNA, 12 bp, Unknown
  misc_feature (1)..( 12): Result.005 file - promoters50/4608140
atagtttactat

SEQ ID NO: 187258 - DNA, 12 bp, Unknown
  misc_feature (1)..( 12): Result.005 file - promoters50/4608140
actcttttgaag

SEQ ID NO: 187259 - DNA, 12 bp, Unknown
  misc_feature (1)..( 12): Result.005 file - promoters50/4608140
ttaagttactac

SEQ ID NO: 187260 - DNA, 8 bp, Unknown
  misc_feature (1)..( 8): Result.005 file - promoters50/4608140
attttttt

SEQ ID NO: 187261 - DNA, 8 bp, Unknown
  misc_feature (1)..( 8): Result.005 file - promoters50/4608140
gttttttt

SEQ ID NO: 187262 - DNA, 8 bp, Unknown
  misc_feature (1)..( 8): Result.005 file - promoters50/4608140
atttttta

SEQ ID NO: 187263 - DNA, 9 bp, Unknown
  misc_feature (1)..( 9): Result.005 file - promoters50/4608140
ttttgtttt

SEQ ID NO: 187264 - DNA, 9 bp, Unknown
  misc_feature (1)..( 9): Result.005 file - promoters50/4608140
atttttatt

SEQ ID NO: 187265 - DNA, 9 bp, Unknown
  misc_feature (1)..( 9): Result.005 file - promoters50/4608140
cttgtttta

SEQ ID NO: 187266 - DNA, 20 bp, Unknown
  misc_feature (1)..( 20): Result.005 file - promoters50/4608140
ttggtaaaaaatatgaaaga

SEQ ID NO: 187267 - DNA, 20 bp, Unknown
  misc_feature (1)..( 20): Result.005 file - promoters50/4608140
tatttcaaaaatacttacaa

SEQ ID NO: 187268 - DNA, 21 bp, Unknown
  misc_feature (1)..( 21): Result.005 file - promoters50/4608140
tttgggaaaaagtatgcaaga

SEQ ID NO: 187269 - DNA, 21 bp, Unknown
  misc_feature (1)..( 21): Result.005 file - promoters50/4608140
agtaacaaaaaagatgtatat

SEQ ID NO: 187270 - DNA, 21 bp, Unknown
  misc_feature (1)..( 21): Result.005 file - promoters50/4608140
agaaataacaaagaacttaat

SEQ ID NO: 187271 - DNA, 21 bp, Unknown
  misc_feature (1)..( 21): Result.005 file - promoters50/4608140
ttttgctaaaaatccttgaga

SEQ ID NO: 187272 - DNA, 21 bp, Unknown
  misc_feature (1)..( 21): Result.005 file - promoters50/4608140
ttgttgaagaagtttcgaaag

SEQ ID NO: 187273 - DNA, 12 bp, Unknown
  misc_feature (1)..( 12): Result.005 file - promoters50/4608140
taagaaaaaaaa

SEQ ID NO: 187274 - DNA, 12 bp, Unknown
  misc_feature (1)..( 12): Result.005 file - promoters50/4608140
aaaggaaaacta

SEQ ID NO: 187275 - DNA, 12 bp, Unknown
  misc_feature (1)..( 12): Result.005 file - promoters50/4608140
taaaaaaaatcc

SEQ ID NO: 187276 - DNA, 12 bp, Unknown
  misc_feature (1)..( 12): Result.005 file - promoters50/4608140
gaataaaaacag

SEQ ID NO: 187277 - DNA, 12 bp, Unknown
  misc_feature (1)..( 12): Result.005 file - promoters50/4608140
ttacaaaaattt

SEQ ID NO: 187278 - DNA, 12 bp, Unknown
  misc_feature (1)..( 12): Result.005 file - promoters50/4608140
gatgaaatattt

SEQ ID NO: 187279 - DNA, 11 bp, Unknown
  misc_feature (1)..( 11): Result.005 file - promoters50/4608140
aaagaaattta

SEQ ID NO: 187280 - DNA, 11 bp, Unknown
  misc_feature (1)..( 11): Result.005 file - promoters50/4608140
caagaaaaact

SEQ ID NO: 187281 - DNA, 11 bp, Unknown
  misc_feature (1)..( 11): Result.005 file - promoters50/4608140
cgagaaaaaac

SEQ ID NO: 187282 - DNA, 12 bp, Unknown
  misc_feature (1)..( 12): Result.005 file - promoters50/4608140
atagacaaaaca

SEQ ID NO: 187283 - DNA, 12 bp, Unknown
  misc_feature (1)..( 12): Result.005 file - promoters50/4608140
tttatcaaaacc

SEQ ID NO: 187284 - DNA, 12 bp, Unknown
  misc_feature (1)..( 12): Result.005 file - promoters50/4608140
aaagaataatca

SEQ ID NO: 187285 - DNA, 12 bp, Unknown
  misc_feature (1)..( 12): Result.005 file - promoters50/4608140
gtagtcaaacga

SEQ ID NO: 187286 - DNA, 12 bp, Unknown
  misc_feature (1)..( 12): Result.005 file - promoters50/4608140
gtttattataat

SEQ ID NO: 187287 - DNA, 12 bp, Unknown
  misc_feature (1)..( 12): Result.005 file - promoters50/4608140
tgatattatttt

SEQ ID NO: 187288 - DNA, 12 bp, Unknown
  misc_feature (1)..( 12): Result.005 file - promoters50/4608140
gtttactattta

SEQ ID NO: 187289 - DNA, 12 bp, Unknown
  misc_feature (1)..( 12): Result.005 file - promoters50/4608140
aataactctttt

SEQ ID NO: 187290 - DNA, 12 bp, Unknown
  misc_feature (1)..( 12): Result.005 file - promoters50/4608140
agttactaccaa

SEQ ID NO: 187291 - DNA, 12 bp, Unknown
  misc_feature (1)..( 12): Result.005 file - promoters50/4608140
aaatattaattt

SEQ ID NO: 187292 - DNA, 9 bp, Unknown
  misc_feature (1)..( 9): Result.005 file - promoters50/4608140
aaactatcg

SEQ ID NO: 187293 - DNA, 9 bp, Unknown
  misc_feature (1)..( 9): Result.005 file - promoters50/4608140
aaaatatta

SEQ ID NO: 187294 - DNA, 9 bp, Unknown
  misc_feature (1)..( 9): Result.005 file - promoters50/4608140
aaagaatca

SEQ ID NO: 187295 - DNA, 9 bp, Unknown
  misc_feature (1)..( 9): Result.005 file - promoters50/4608140
aaagaaaca

SEQ ID NO: 187296 - DNA, 9 bp, Unknown
  misc_feature (1)..( 9): Result.005 file - promoters50/4608140
taataataa

SEQ ID NO: 187297 - DNA, 9 bp, Unknown
  misc_feature (1)..( 9): Result.005 file - promoters50/4608140
taataatgt

SEQ ID NO: 187298 - DNA, 11 bp, Unknown
  misc_feature (1)..( 11): Result.005 file - promoters50/4608140
gagaaaaaaca

SEQ ID NO: 187299 - DNA, 11 bp, Unknown
  misc_feature (1)..( 11): Result.005 file - promoters50/4608140
caagaaaaact

SEQ ID NO: 187300 - DNA, 11 bp, Unknown
  misc_feature (1)..( 11): Result.005 file - promoters50/4608140
tagacaaaaca

SEQ ID NO: 187301 - DNA, 11 bp, Unknown
  misc_feature (1)..( 11): Result.005 file - promoters50/4608140
ttatcaaaacc

SEQ ID NO: 187302 - DNA, 11 bp, Unknown
  misc_feature (1)..( 11): Result.005 file - promoters50/4608140
cttaaagaata

SEQ ID NO: 187303 - DNA, 11 bp, Unknown
  misc_feature (1)..( 11): Result.005 file - promoters50/4608140
tagtcaaacga

SEQ ID NO: 187304 - DNA, 17 bp, Unknown
  misc_feature (1)..( 17): Result.005 file - promoters50/4608140
atagacgaaacaaagaa

SEQ ID NO: 187305 - DNA, 17 bp, Unknown
  misc_feature (1)..( 17): Result.005 file - promoters50/4608140
tattacaaaacagagaa

SEQ ID NO: 187306 - DNA, 17 bp, Unknown
  misc_feature (1)..( 17): Result.005 file - promoters50/4608140
atagacaaaacaattaa

SEQ ID NO: 187307 - DNA, 17 bp, Unknown
  misc_feature (1)..( 17): Result.005 file - promoters50/4608140
gtatagttcttaaagaa

SEQ ID NO: 187308 - DNA, 17 bp, Unknown
  misc_feature (1)..( 17): Result.005 file - promoters50/4608140
tttatcaaaaccgttac

SEQ ID NO: 187309 - DNA, 17 bp, Unknown
  misc_feature (1)..( 17): Result.005 file - promoters50/4608140
gtagtcaaacgatttct

SEQ ID NO: 187310 - DNA, 7 bp, Unknown
  misc_feature (1)..( 7): Result.005 file - promoters50/4608143
ttagttt

SEQ ID NO: 187311 - DNA, 7 bp, Unknown
  misc_feature (1)..( 7): Result.005 file - promoters50/4608143
ttaattt

SEQ ID NO: 187312 - DNA, 7 bp, Unknown
  misc_feature (1)..( 7): Result.005 file - promoters50/4608143
ttacttt

SEQ ID NO: 187313 - DNA, 11 bp, Unknown
  misc_feature (1)..( 11): Result.005 file - promoters50/4608143
aagtttaaaat

SEQ ID NO: 187314 - DNA, 11 bp, Unknown
  misc_feature (1)..( 11): Result.005 file - promoters50/4608143
aagtataactt

SEQ ID NO: 187315 - DNA, 11 bp, Unknown
  misc_feature (1)..( 11): Result.005 file - promoters50/4608143
gcatatacctt

SEQ ID NO: 187316 - DNA, 8 bp, Unknown
  misc_feature (1)..( 8): Result.005 file - promoters50/4608143
attttata

SEQ ID NO: 187317 - DNA, 8 bp, Unknown
  misc_feature (1)..( 8): Result.005 file - promoters50/4608143
attatata

SEQ ID NO: 187318 - DNA, 8 bp, Unknown
  misc_feature (1)..( 8): Result.005 file - promoters50/4608143
attttacg

SEQ ID NO: 187319 - DNA, 8 bp, Unknown
  misc_feature (1)..( 8): Result.005 file - promoters50/4608143
gttaaata

SEQ ID NO: 187320 - DNA, 8 bp, Unknown
  misc_feature (1)..( 8): Result.005 file - promoters50/4608143
aaaaatgt

SEQ ID NO: 187321 - DNA, 8 bp, Unknown
  misc_feature (1)..( 8): Result.005 file - promoters50/4608143
aaatatga

SEQ ID NO: 187322 - DNA, 8 bp, Unknown
  misc_feature (1)..( 8): Result.005 file - promoters50/4608143
aaatattt

SEQ ID NO: 187323 - DNA, 8 bp, Unknown
  misc_feature (1)..( 8): Result.005 file - promoters50/4608143
gaatgttt

SEQ ID NO: 187324 - DNA, 8 bp, Unknown
  misc_feature (1)..( 8): Result.005 file - promoters50/4608143
catatatg

SEQ ID NO: 187325 - DNA, 8 bp, Unknown
  misc_feature (1)..( 8): Result.005 file - promoters50/4608143
aatatata

SEQ ID NO: 187326 - DNA, 8 bp, Unknown
  misc_feature (1)..( 8): Result.005 file - promoters50/4608143
aatttata

SEQ ID NO: 187327 - DNA, 15 bp, Unknown
  misc_feature (1)..( 15): Result.005 file - promoters50/4608143
aaggatgctgtgcca

SEQ ID NO: 187328 - DNA, 15 bp, Unknown
  misc_feature (1)..( 15): Result.005 file - promoters50/4608143
aaggatgatggacca

SEQ ID NO: 187329 - DNA, 15 bp, Unknown
  misc_feature (1)..( 15): Result.005 file - promoters50/4608143
aaggatgatggacca

SEQ ID NO: 187330 - DNA, 21 bp, Unknown
  misc_feature (1)..( 21): Result.005 file - promoters50/4608143
cccacgtaaataacgtggtcc

SEQ ID NO: 187331 - DNA, 21 bp, Unknown
  misc_feature (1)..( 21): Result.005 file - promoters50/4608143
tacacattaataacgtggtcc

SEQ ID NO: 187332 - DNA, 21 bp, Unknown
  misc_feature (1)..( 21): Result.005 file - promoters50/4608143
tacacattaataacgtggtcg

SEQ ID NO: 187333 - DNA, 21 bp, Unknown
  misc_feature (1)..( 21): Result.005 file - promoters50/4608143
atgaggtttgttcagtgatcc

SEQ ID NO: 187334 - DNA, 10 bp, Unknown
  misc_feature (1)..( 10): Result.005 file - promoters50/4608143
taaattaata

SEQ ID NO: 187335 - DNA, 10 bp, Unknown
  misc_feature (1)..( 10): Result.005 file - promoters50/4608143
taaatcaata

SEQ ID NO: 187336 - DNA, 10 bp, Unknown
  misc_feature (1)..( 10): Result.005 file - promoters50/4608143
gtaattaact

SEQ ID NO: 187337 - DNA, 11 bp, Unknown
  misc_feature (1)..( 11): Result.005 file - promoters50/4608143
aattaataaaa

SEQ ID NO: 187338 - DNA, 11 bp, Unknown
  misc_feature (1)..( 11): Result.005 file - promoters50/4608143
cttgaataaat

SEQ ID NO: 187339 - DNA, 11 bp, Unknown
  misc_feature (1)..( 11): Result.005 file - promoters50/4608143
cttaaatcaat

SEQ ID NO: 187340 - DNA, 9 bp, Unknown
  misc_feature (1)..( 9): Result.005 file - promoters50/4608345
aaaaaataa

SEQ ID NO: 187341 - DNA, 9 bp, Unknown
  misc_feature (1)..( 9): Result.005 file - promoters50/4608345
aaaacataa

SEQ ID NO: 187342 - DNA, 9 bp, Unknown
  misc_feature (1)..( 9): Result.005 file - promoters50/4608345
taaacattc

SEQ ID NO: 187343 - DNA, 12 bp, Unknown
  misc_feature (1)..( 12): Result.005 file - promoters50/4608965
gggcaaatcatc

SEQ ID NO: 187344 - DNA, 12 bp, Unknown
  misc_feature (1)..( 12): Result.005 file - promoters50/4608965
aaacaaatcaaa

SEQ ID NO: 187345 - DNA, 12 bp, Unknown
  misc_feature (1)..( 12): Result.005 file - promoters50/4608965
ttataaatcatc

SEQ ID NO: 187346 - DNA, 12 bp, Unknown
  misc_feature (1)..( 12): Result.005 file - promoters50/4608965
ggcaaaaccaaa

SEQ ID NO: 187347 - DNA, 12 bp, Unknown
  misc_feature (1)..( 12): Result.005 file - promoters50/4608965
aatttaatcaat

SEQ ID NO: 187348 - DNA, 12 bp, Unknown
  misc_feature (1)..( 12): Result.005 file - promoters50/4608965
gattaaatgaat

SEQ ID NO: 187349 - DNA, 12 bp, Unknown
  misc_feature (1)..( 12): Result.005 file - promoters50/4608965
gattaatgtctc

SEQ ID NO: 187350 - DNA, 13 bp, Unknown
  misc_feature (1)..( 13): Result.005 file - promoters50/4608965
cattcgtttagtc

SEQ ID NO: 187351 - DNA, 13 bp, Unknown
  misc_feature (1)..( 13): Result.005 file - promoters50/4608965
cattagtttcctg

SEQ ID NO: 187352 - DNA, 11 bp, Unknown
  misc_feature (1)..( 11): Result.005 file - promoters50/4608965
ttaatttcctg

SEQ ID NO: 187353 - DNA, 13 bp, Unknown
  misc_feature (1)..( 13): Result.005 file - promoters50/4608965
cccaagtgtccta

SEQ ID NO: 187354 - DNA, 13 bp, Unknown
  misc_feature (1)..( 13): Result.005 file - promoters50/4608965
atttactttggaa

SEQ ID NO: 187355 - DNA, 13 bp, Unknown
  misc_feature (1)..( 13): Result.005 file - promoters50/4608965
ttaatgtttgctt

SEQ ID NO: 187356 - DNA, 9 bp, Unknown
  misc_feature (1)..( 9): Result.005 file - promoters50/4608965
gaacgaaat

SEQ ID NO: 187357 - DNA, 9 bp, Unknown
  misc_feature (1)..( 9): Result.005 file - promoters50/4608965
ttacgaaat

SEQ ID NO: 187358 - DNA, 9 bp, Unknown
  misc_feature (1)..( 9): Result.005 file - promoters50/4608965
caaccaaaa

SEQ ID NO: 187359 - DNA, 9 bp, Unknown
  misc_feature (1)..( 9): Result.005 file - promoters50/4608965
taacaaaac

SEQ ID NO: 187360 - DNA, 9 bp, Unknown
  misc_feature (1)..( 9): Result.005 file - promoters50/4608965
caacgaaac

SEQ ID NO: 187361 - DNA, 9 bp, Unknown
  misc_feature (1)..( 9): Result.005 file - promoters50/4608965
ttatcaaat

SEQ ID NO: 187362 - DNA, 8 bp, Unknown
  misc_feature (1)..( 8): Result.005 file - promoters50/4608983
gaattaaa

SEQ ID NO: 187363 - DNA, 8 bp, Unknown
  misc_feature (1)..( 8): Result.005 file - promoters50/4608983
gaagtaag

SEQ ID NO: 187364 - DNA, 8 bp, Unknown
  misc_feature (1)..( 8): Result.005 file - promoters50/4608983
caaggaag

SEQ ID NO: 187365 - DNA, 13 bp, Unknown
  misc_feature (1)..( 13): Result.005 file - promoters50/4608985
aatactaaaaatc

SEQ ID NO: 187366 - DNA, 13 bp, Unknown
  misc_feature (1)..( 13): Result.005 file - promoters50/4608985
tagtttaaaaatt

SEQ ID NO: 187367 - DNA, 13 bp, Unknown
  misc_feature (1)..( 13): Result.005 file - promoters50/4608985
aataccaaaattc

SEQ ID NO: 187368 - DNA, 13 bp, Unknown
  misc_feature (1)..( 13): Result.005 file - promoters50/4608985
acttggtaaaatt

SEQ ID NO: 187369 - DNA, 13 bp, Unknown
  misc_feature (1)..( 13): Result.005 file - promoters50/4608985
agtttcaaatatt

SEQ ID NO: 187370 - DNA, 13 bp, Unknown
  misc_feature (1)..( 13): Result.005 file - promoters50/4608985
catttccaaaatt

SEQ ID NO: 187371 - DNA, 13 bp, Unknown
  misc_feature (1)..( 13): Result.005 file - promoters50/4608985
caaaaataagatt

SEQ ID NO: 187372 - DNA, 11 bp, Unknown
  misc_feature (1)..( 11): Result.005 file - promoters50/4608985
agttaatatat

SEQ ID NO: 187373 - DNA, 11 bp, Unknown
  misc_feature (1)..( 11): Result.005 file - promoters50/4608985
agttaaaaaat

SEQ ID NO: 187374 - DNA, 11 bp, Unknown
  misc_feature (1)..( 11): Result.005 file - promoters50/4608985
tgttattatat

SEQ ID NO: 187375 - DNA, 11 bp, Unknown
  misc_feature (1)..( 11): Result.005 file - promoters50/4608985
cgttaaagtta

SEQ ID NO: 187376 - DNA, 11 bp, Unknown
  misc_feature (1)..( 11): Result.005 file - promoters50/4608985
agttatttaaa

SEQ ID NO: 187377 - DNA, 11 bp, Unknown
  misc_feature (1)..( 11): Result.005 file - promoters50/4608985
aattatttaca

SEQ ID NO: 187378 - DNA, 14 bp, Unknown
  misc_feature (1)..( 14): Result.005 file - promoters50/4608985
tattttatttttgt

SEQ ID NO: 187379 - DNA, 14 bp, Unknown
  misc_feature (1)..( 14): Result.005 file - promoters50/4608985
agattgatttttgt

SEQ ID NO: 187380 - DNA, 14 bp, Unknown
  misc_feature (1)..( 14): Result.005 file - promoters50/4608985
tattatatatttca

SEQ ID NO: 187381 - DNA, 14 bp, Unknown
  misc_feature (1)..( 14): Result.005 file - promoters50/4608985
ttggatatatcaaa

SEQ ID NO: 187382 - DNA, 14 bp, Unknown
  misc_feature (1)..( 14): Result.005 file - promoters50/4608985
gcttctatttctat

SEQ ID NO: 187383 - DNA, 14 bp, Unknown
  misc_feature (1)..( 14): Result.005 file - promoters50/4608985
aaattcattataaa

SEQ ID NO: 187384 - DNA, 9 bp, Unknown
  misc_feature (1)..( 9): Result.005 file - promoters50/4608985
ttttatttt

SEQ ID NO: 187385 - DNA, 9 bp, Unknown
  misc_feature (1)..( 9): Result.005 file - promoters50/4608985
ctttattat

SEQ ID NO: 187386 - DNA, 10 bp, Unknown
  misc_feature (1)..( 10): Result.005 file - promoters50/4608985
cttctatttc

SEQ ID NO: 187387 - DNA, 11 bp, Unknown
  misc_feature (1)..( 11): Result.005 file - promoters50/4608985
atttatattat

SEQ ID NO: 187388 - DNA, 11 bp, Unknown
  misc_feature (1)..( 11): Result.005 file - promoters50/4608985
attaatattta

SEQ ID NO: 187389 - DNA, 11 bp, Unknown
  misc_feature (1)..( 11): Result.005 file - promoters50/4608985
attaataaagc

SEQ ID NO: 187390 - DNA, 11 bp, Unknown
  misc_feature (1)..( 11): Result.005 file - promoters50/4608985
ttcattataaa

SEQ ID NO: 187391 - DNA, 11 bp, Unknown
  misc_feature (1)..( 11): Result.005 file - promoters50/4608985
aatataactct

SEQ ID NO: 187392 - DNA, 11 bp, Unknown
  misc_feature (1)..( 11): Result.005 file - promoters50/4608985
aatttaactaa

SEQ ID NO: 187393 - DNA, 12 bp, Unknown
  misc_feature (1)..( 12): Result.005 file - promoters50/4608985
aatgatattcgt

SEQ ID NO: 187394 - DNA, 12 bp, Unknown
  misc_feature (1)..( 12): Result.005 file - promoters50/4608985
taaaatatacaa

SEQ ID NO: 187395 - DNA, 12 bp, Unknown
  misc_feature (1)..( 12): Result.005 file - promoters50/4608985
ttctataaataa

SEQ ID NO: 187396 - DNA, 12 bp, Unknown
  misc_feature (1)..( 12): Result.005 file - promoters50/4608985
acacatacacat

SEQ ID NO: 187397 - DNA, 11 bp, Unknown
  misc_feature (1)..( 11): Result.005 file - promoters50/4608985
aagagacaaaa

SEQ ID NO: 187398 - DNA, 11 bp, Unknown
  misc_feature (1)..( 11): Result.005 file - promoters50/4608985
gggttacaaaa

SEQ ID NO: 187399 - DNA, 11 bp, Unknown
  misc_feature (1)..( 11): Result.005 file - promoters50/4608985
caaagacaagt

SEQ ID NO: 187400 - DNA, 11 bp, Unknown
  misc_feature (1)..( 11): Result.005 file - promoters50/4608985
gtaagaaaaaa

SEQ ID NO: 187401 - DNA, 11 bp, Unknown
  misc_feature (1)..( 11): Result.005 file - promoters50/4608985
accccacaaaa

SEQ ID NO: 187402 - DNA, 11 bp, Unknown
  misc_feature (1)..( 11): Result.005 file - promoters50/4608985
gatagataaga

SEQ ID NO: 187403 - DNA, 11 bp, Unknown
  misc_feature (1)..( 11): Result.005 file - promoters50/4608985
tattgacaaaa

SEQ ID NO: 187404 - DNA, 14 bp, Unknown
  misc_feature (1)..( 14): Result.005 file - promoters50/4608985
ttaaaagaaagaga

SEQ ID NO: 187405 - DNA, 14 bp, Unknown
  misc_feature (1)..( 14): Result.005 file - promoters50/4608985
ttttaagaacgagg

SEQ ID NO: 187406 - DNA, 14 bp, Unknown
  misc_feature (1)..( 14): Result.005 file - promoters50/4608985
ttaaaataaaagtc

SEQ ID NO: 187407 - DNA, 14 bp, Unknown
  misc_feature (1)..( 14): Result.005 file - promoters50/4608985
tcactccaaagaga

SEQ ID NO: 187408 - DNA, 14 bp, Unknown
  misc_feature (1)..( 14): Result.005 file - promoters50/4608985
aaataataaatgat

SEQ ID NO: 187409 - DNA, 14 bp, Unknown
  misc_feature (1)..( 14): Result.005 file - promoters50/4608985
ataatataatgcaa

SEQ ID NO: 187410 - DNA, 12 bp, Unknown
  misc_feature (1)..( 12): Result.005 file - promoters50/4608985
tgtatatatact

SEQ ID NO: 187411 - DNA, 12 bp, Unknown
  misc_feature (1)..( 12): Result.005 file - promoters50/4608985
cctttataaact

SEQ ID NO: 187412 - DNA, 12 bp, Unknown
  misc_feature (1)..( 12): Result.005 file - promoters50/4608985
cgcctatatata

SEQ ID NO: 187413 - DNA, 12 bp, Unknown
  misc_feature (1)..( 12): Result.005 file - promoters50/4608985
cttttatatata

SEQ ID NO: 187414 - DNA, 12 bp, Unknown
  misc_feature (1)..( 12): Result.005 file - promoters50/4608985
tgtatatatact

SEQ ID NO: 187415 - DNA, 12 bp, Unknown
  misc_feature (1)..( 12): Result.005 file - promoters50/4608985
tccctataaatt

SEQ ID NO: 187416 - DNA, 12 bp, Unknown
  misc_feature (1)..( 12): Result.005 file - promoters50/4608985
acattatataaa

SEQ ID NO: 187417 - DNA, 10 bp, Unknown
  misc_feature (1)..( 10): Result.005 file - promoters50/4608985
ttttctgttc

SEQ ID NO: 187418 - DNA, 10 bp, Unknown
  misc_feature (1)..( 10): Result.005 file - promoters50/4608985
ttttcttttc

SEQ ID NO: 187419 - DNA, 10 bp, Unknown
  misc_feature (1)..( 10): Result.005 file - promoters50/4608985
ttttctataa

SEQ ID NO: 187420 - DNA, 10 bp, Unknown
  misc_feature (1)..( 10): Result.005 file - promoters50/4608985
atttcatttc

SEQ ID NO: 187421 - DNA, 10 bp, Unknown
  misc_feature (1)..( 10): Result.005 file - promoters50/4608985
atttatttcg

SEQ ID NO: 187422 - DNA, 10 bp, Unknown
  misc_feature (1)..( 10): Result.005 file - promoters50/4608985
ctttattaaa

SEQ ID NO: 187423 - DNA, 8 bp, Unknown
  misc_feature (1)..( 8): Result.005 file - promoters50/4608985
gttaaaaa

SEQ ID NO: 187424 - DNA, 8 bp, Unknown
  misc_feature (1)..( 8): Result.005 file - promoters50/4608985
tttaaaat

SEQ ID NO: 187425 - DNA, 9 bp, Unknown
  misc_feature (1)..( 9): Result.005 file - promoters50/4608985
tttacaaac

SEQ ID NO: 187426 - DNA, 9 bp, Unknown
  misc_feature (1)..( 9): Result.005 file - promoters50/4608985
gttaaagtt

SEQ ID NO: 187427 - DNA, 9 bp, Unknown
  misc_feature (1)..( 9): Result.005 file - promoters50/4608985
aagacaaac

SEQ ID NO: 187428 - DNA, 9 bp, Unknown
  misc_feature (1)..( 9): Result.005 file - promoters50/4608985
tttccaaaa

SEQ ID NO: 187429 - DNA, 10 bp, Unknown
  misc_feature (1)..( 10): Result.005 file - promoters50/4608985
taaactatga

SEQ ID NO: 187430 - DNA, 10 bp, Unknown
  misc_feature (1)..( 10): Result.005 file - promoters50/4608985
caaaatatca

SEQ ID NO: 187431 - DNA, 10 bp, Unknown
  misc_feature (1)..( 10): Result.005 file - promoters50/4608985
taaagtatac

SEQ ID NO: 187432 - DNA, 10 bp, Unknown
  misc_feature (1)..( 10): Result.005 file - promoters50/4608985
tcaaatatct

SEQ ID NO: 187433 - DNA, 10 bp, Unknown
  misc_feature (1)..( 10): Result.005 file - promoters50/4608985
aaaaccaaag

SEQ ID NO: 187434 - DNA, 10 bp, Unknown
  misc_feature (1)..( 10): Result.005 file - promoters50/4608985
acaaaaatca

SEQ ID NO: 187435 - DNA, 12 bp, Unknown
  misc_feature (1)..( 12): Result.005 file - promoters50/4608985
aaaaaaactaat

SEQ ID NO: 187436 - DNA, 12 bp, Unknown
  misc_feature (1)..( 12): Result.005 file - promoters50/4608985
taaataactaat

SEQ ID NO: 187437 - DNA, 12 bp, Unknown
  misc_feature (1)..( 12): Result.005 file - promoters50/4608985
aagaaaactcat

SEQ ID NO: 187438 - DNA, 12 bp, Unknown
  misc_feature (1)..( 12): Result.005 file - promoters50/4608985
taagaaatttcc

SEQ ID NO: 187439 - DNA, 12 bp, Unknown
  misc_feature (1)..( 12): Result.005 file - promoters50/4608985
tcttaaaataat

SEQ ID NO: 187440 - DNA, 13 bp, Unknown
  misc_feature (1)..( 13): Result.005 file - promoters50/4608985
cggctaacatatt

SEQ ID NO: 187441 - DNA, 12 bp, Unknown
  misc_feature (1)..( 12): Result.005 file - promoters50/4610292
tttttttactat

SEQ ID NO: 187442 - DNA, 12 bp, Unknown
  misc_feature (1)..( 12): Result.005 file - promoters50/4610292
tattttcactaa

SEQ ID NO: 187443 - DNA, 12 bp, Unknown
  misc_feature (1)..( 12): Result.005 file - promoters50/4610292
cagtttcaataa

SEQ ID NO: 187444 - DNA, 12 bp, Unknown
  misc_feature (1)..( 12): Result.005 file - promoters50/4610292
caggttcaaatc

SEQ ID NO: 187445 - DNA, 14 bp, Unknown
  misc_feature (1)..( 14): Result.005 file - promoters50/4610551
tctgttttttggtt

SEQ ID NO: 187446 - DNA, 14 bp, Unknown
  misc_feature (1)..( 14): Result.005 file - promoters50/4610551
ttactttttttttt

SEQ ID NO: 187447 - DNA, 14 bp, Unknown
  misc_feature (1)..( 14): Result.005 file - promoters50/4610551
tctctttttttgtt

SEQ ID NO: 187448 - DNA, 15 bp, Unknown
  misc_feature (1)..( 15): Result.005 file - promoters50/4610551
gttgttttgtttgtg

SEQ ID NO: 187449 - DNA, 15 bp, Unknown
  misc_feature (1)..( 15): Result.005 file - promoters50/4610551
aatggttggttgcag

SEQ ID NO: 187450 - DNA, 15 bp, Unknown
  misc_feature (1)..( 15): Result.005 file - promoters50/4610551
tgacgatttttggac

SEQ ID NO: 187451 - DNA, 16 bp, Unknown
  misc_feature (1)..( 16): Result.005 file - promoters50/4610551
tctgttttttggttag

SEQ ID NO: 187452 - DNA, 16 bp, Unknown
  misc_feature (1)..( 16): Result.005 file - promoters50/4610551
tgcaatggttggttgc

SEQ ID NO: 187453 - DNA, 16 bp, Unknown
  misc_feature (1)..( 16): Result.005 file - promoters50/4610551
tctctttttttgtttc

SEQ ID NO: 187454 - DNA, 16 bp, Unknown
  misc_feature (1)..( 16): Result.005 file - promoters50/4610551
gacgttgttttgtttg

SEQ ID NO: 187455 - DNA, 16 bp, Unknown
  misc_feature (1)..( 16): Result.005 file - promoters50/4610551
tgacgatttttggacc

SEQ ID NO: 187456 - DNA, 16 bp, Unknown
  misc_feature (1)..( 16): Result.005 file - promoters50/4610551
ttttttttttttttac

SEQ ID NO: 187457 - DNA, 9 bp, Unknown
  misc_feature (1)..( 9): Result.005 file - promoters50/4610628
ttctgtttg

SEQ ID NO: 187458 - DNA, 9 bp, Unknown
  misc_feature (1)..( 9): Result.005 file - promoters50/4610628
atctgtttg

SEQ ID NO: 187459 - DNA, 9 bp, Unknown
  misc_feature (1)..( 9): Result.005 file - promoters50/4610628
ttctgttgt

SEQ ID NO: 187460 - DNA, 7 bp, Unknown
  misc_feature (1)..( 7): Result.005 file - promoters50/4701809
aaattaa

SEQ ID NO: 187461 - DNA, 7 bp, Unknown
  misc_feature (1)..( 7): Result.005 file - promoters50/4701809
aaattaa

SEQ ID NO: 187462 - DNA, 7 bp, Unknown
  misc_feature (1)..( 7): Result.005 file - promoters50/4701809
caattaa

SEQ ID NO: 187463 - DNA, 8 bp, Unknown
  misc_feature (1)..( 8): Result.005 file - promoters50/4701809
aaagttat

SEQ ID NO: 187464 - DNA, 8 bp, Unknown
  misc_feature (1)..( 8): Result.005 file - promoters50/4701809
aaaattac

SEQ ID NO: 187465 - DNA, 8 bp, Unknown
  misc_feature (1)..( 8): Result.005 file - promoters50/4701809
ttagttat

SEQ ID NO: 187466 - DNA, 12 bp, Unknown
  misc_feature (1)..( 12): Result.005 file - promoters50/4701809
taaatttatcac

SEQ ID NO: 187467 - DNA, 12 bp, Unknown
  misc_feature (1)..( 12): Result.005 file - promoters50/4701809
agaatatatgaa

SEQ ID NO: 187468 - DNA, 12 bp, Unknown
  misc_feature (1)..( 12): Result.005 file - promoters50/4701809
ttaataaactta

SEQ ID NO: 187469 - DNA, 12 bp, Unknown
  misc_feature (1)..( 12): Result.005 file - promoters50/4701809
aaaattaaaaca

SEQ ID NO: 187470 - DNA, 12 bp, Unknown
  misc_feature (1)..( 12): Result.005 file - promoters50/4701809
caaacttgtcaa

SEQ ID NO: 187471 - DNA, 12 bp, Unknown
  misc_feature (1)..( 12): Result.005 file - promoters50/4701809
tagatagactat

SEQ ID NO: 187472 - DNA, 11 bp, Unknown
  misc_feature (1)..( 11): Result.005 file - promoters50/4701809
tatgattaatc

SEQ ID NO: 187473 - DNA, 11 bp, Unknown
  misc_feature (1)..( 11): Result.005 file - promoters50/4701809
ttaaattaata

SEQ ID NO: 187474 - DNA, 11 bp, Unknown
  misc_feature (1)..( 11): Result.005 file - promoters50/4701809
ataaagtaatg

SEQ ID NO: 187475 - DNA, 11 bp, Unknown
  misc_feature (1)..( 11): Result.005 file - promoters50/4701809
gtatgttaata

SEQ ID NO: 187476 - DNA, 11 bp, Unknown
  misc_feature (1)..( 11): Result.005 file - promoters50/4701809
caaaagtaaat

SEQ ID NO: 187477 - DNA, 11 bp, Unknown
  misc_feature (1)..( 11): Result.005 file - promoters50/4701809
atagagtaaac

SEQ ID NO: 187478 - DNA, 12 bp, Unknown
  misc_feature (1)..( 12): Result.005 file - promoters50/4701809
taataagttgtg

SEQ ID NO: 187479 - DNA, 12 bp, Unknown
  misc_feature (1)..( 12): Result.005 file - promoters50/4701809
ttctaaattgca

SEQ ID NO: 187480 - DNA, 12 bp, Unknown
  misc_feature (1)..( 12): Result.005 file - promoters50/4701809
ttcaaaatttat

SEQ ID NO: 187481 - DNA, 12 bp, Unknown
  misc_feature (1)..( 12): Result.005 file - promoters50/4701809
tacaagattata

SEQ ID NO: 187482 - DNA, 12 bp, Unknown
  misc_feature (1)..( 12): Result.005 file - promoters50/4701809
tgaaaaattcat

SEQ ID NO: 187483 - DNA, 12 bp, Unknown
  misc_feature (1)..( 12): Result.005 file - promoters50/4701809
gtatacatcaaa

SEQ ID NO: 187484 - DNA, 11 bp, Unknown
  misc_feature (1)..( 11): Result.005 file - promoters50/4701809
tgggtttttgg

SEQ ID NO: 187485 - DNA, 11 bp, Unknown
  misc_feature (1)..( 11): Result.005 file - promoters50/4701809
tttttttttgt

SEQ ID NO: 187486 - DNA, 11 bp, Unknown
  misc_feature (1)..( 11): Result.005 file - promoters50/4701809
tttgtttttac

SEQ ID NO: 187487 - DNA, 11 bp, Unknown
  misc_feature (1)..( 11): Result.005 file - promoters50/4701809
ttcgttgtgta

SEQ ID NO: 187488 - DNA, 11 bp, Unknown
  misc_feature (1)..( 11): Result.005 file - promoters50/4701809
atggtttggtt

SEQ ID NO: 187489 - DNA, 11 bp, Unknown
  misc_feature (1)..( 11): Result.005 file - promoters50/4701809
tcaattggttg

SEQ ID NO: 187490 - DNA, 9 bp, Unknown
  misc_feature (1)..( 9): Result.005 file - promoters50/4702444
gaagatttc

SEQ ID NO: 187491 - DNA, 9 bp, Unknown
  misc_feature (1)..( 9): Result.005 file - promoters50/4702444
gaaaattct

SEQ ID NO: 187492 - DNA, 9 bp, Unknown
  misc_feature (1)..( 9): Result.005 file - promoters50/4702444
gaaagtctt

SEQ ID NO: 187493 - DNA, 9 bp, Unknown
  misc_feature (1)..( 9): Result.005 file - promoters50/4702444
ttaaaatta

SEQ ID NO: 187494 - DNA, 9 bp, Unknown
  misc_feature (1)..( 9): Result.005 file - promoters50/4702444
ataaagtta

SEQ ID NO: 187495 - DNA, 9 bp, Unknown
  misc_feature (1)..( 9): Result.005 file - promoters50/4702444
ttacaattt

SEQ ID NO: 187496 - DNA, 11 bp, Unknown
  misc_feature (1)..( 11): Result.005 file - promoters50/4702444
cggaaagtata

SEQ ID NO: 187497 - DNA, 11 bp, Unknown
  misc_feature (1)..( 11): Result.005 file - promoters50/4702444
cggaaagtctt

SEQ ID NO: 187498 - DNA, 11 bp, Unknown
  misc_feature (1)..( 11): Result.005 file - promoters50/4702444
cgaaaattctt

SEQ ID NO: 187499 - DNA, 10 bp, Unknown
  misc_feature (1)..( 10): Result.005 file - promoters50/4702444
attaatcatt

SEQ ID NO: 187500 - DNA, 10 bp, Unknown
  misc_feature (1)..( 10): Result.005 file - promoters50/4702444
attgatccgt

SEQ ID NO: 187501 - DNA, 10 bp, Unknown
  misc_feature (1)..( 10): Result.005 file - promoters50/4702444
tttactcata

SEQ ID NO: 187502 - DNA, 10 bp, Unknown
  misc_feature (1)..( 10): Result.005 file - promoters50/4702444
agttctcata

SEQ ID NO: 187503 - DNA, 13 bp, Unknown
  misc_feature (1)..( 13): Result.005 file - promoters50/4702444
ttttactttactt

SEQ ID NO: 187504 - DNA, 13 bp, Unknown
  misc_feature (1)..( 13): Result.005 file - promoters50/4702444
atttccttctcaa

SEQ ID NO: 187505 - DNA, 13 bp, Unknown
  misc_feature (1)..( 13): Result.005 file - promoters50/4702444
tttttcttttctt

SEQ ID NO: 187506 - DNA, 10 bp, Unknown
  misc_feature (1)..( 10): Result.005 file - promoters50/4702444
ttttacaaat

SEQ ID NO: 187507 - DNA, 10 bp, Unknown
  misc_feature (1)..( 10): Result.005 file - promoters50/4702444
ttttgcaatt

SEQ ID NO: 187508 - DNA, 10 bp, Unknown
  misc_feature (1)..( 10): Result.005 file - promoters50/4702444
gtttgaaatt

SEQ ID NO: 187509 - DNA, 8 bp, Unknown
  misc_feature (1)..( 8): Result.005 file - promoters50/4702444
tttcgaaa

SEQ ID NO: 187510 - DNA, 8 bp, Unknown
  misc_feature (1)..( 8): Result.005 file - promoters50/4702444
tttagaaa

SEQ ID NO: 187511 - DNA, 8 bp, Unknown
  misc_feature (1)..( 8): Result.005 file - promoters50/4702444
tttctaaa

SEQ ID NO: 187512 - DNA, 11 bp, Unknown
  misc_feature (1)..( 11): Result.005 file - promoters50/4702444
gaagaaaccaa

SEQ ID NO: 187513 - DNA, 11 bp, Unknown
  misc_feature (1)..( 11): Result.005 file - promoters50/4702444
gaagaaaataa

SEQ ID NO: 187514 - DNA, 11 bp, Unknown
  misc_feature (1)..( 11): Result.005 file - promoters50/4702444
ttagaaactaa

SEQ ID NO: 187515 - DNA, 8 bp, Unknown
  misc_feature (1)..( 8): Result.005 file - promoters50/4766314
tatgttat

SEQ ID NO: 187516 - DNA, 8 bp, Unknown
  misc_feature (1)..( 8): Result.005 file - promoters50/4766314
aatggtat

SEQ ID NO: 187517 - DNA, 8 bp, Unknown
  misc_feature (1)..( 8): Result.005 file - promoters50/4766314
tatgttaa

SEQ ID NO: 187518 - DNA, 9 bp, Unknown
  misc_feature (1)..( 9): Result.005 file - promoters50/4766314
ccgacgaaa

SEQ ID NO: 187519 - DNA, 9 bp, Unknown
  misc_feature (1)..( 9): Result.005 file - promoters50/4766314
acgaagaat

SEQ ID NO: 187520 - DNA, 9 bp, Unknown
  misc_feature (1)..( 9): Result.005 file - promoters50/4766314
acgaagtaa

SEQ ID NO: 187521 - DNA, 9 bp, Unknown
  misc_feature (1)..( 9): Result.005 file - promoters50/4766314
tcgaattaa

SEQ ID NO: 187522 - DNA, 8 bp, Unknown
  misc_feature (1)..( 8): Result.005 file - promoters50/4766314
aacaatga

SEQ ID NO: 187523 - DNA, 8 bp, Unknown
  misc_feature (1)..( 8): Result.005 file - promoters50/4766314
aactatgg

SEQ ID NO: 187524 - DNA, 8 bp, Unknown
  misc_feature (1)..( 8): Result.005 file - promoters50/4766314
aaaaatat

SEQ ID NO: 187525 - DNA, 10 bp, Unknown
  misc_feature (1)..( 10): Result.005 file - promoters50/4766314
aatgacattt

SEQ ID NO: 187526 - DNA, 10 bp, Unknown
  misc_feature (1)..( 10): Result.005 file - promoters50/4766314
aatgagattt

SEQ ID NO: 187527 - DNA, 10 bp, Unknown
  misc_feature (1)..( 10): Result.005 file - promoters50/4766314
aattagattt

SEQ ID NO: 187528 - DNA, 13 bp, Unknown
  misc_feature (1)..( 13): Result.005 file - promoters50/4766320
aaaatttcaaatg

SEQ ID NO: 187529 - DNA, 13 bp, Unknown
  misc_feature (1)..( 13): Result.005 file - promoters50/4766320
ttaatttcaatct

SEQ ID NO: 187530 - DNA, 14 bp, Unknown
  misc_feature (1)..( 14): Result.005 file - promoters50/4766320
ctattttccaatga

SEQ ID NO: 187531 - DNA, 14 bp, Unknown
  misc_feature (1)..( 14): Result.005 file - promoters50/4766320
ctaatttccaaaga

SEQ ID NO: 187532 - DNA, 14 bp, Unknown
  misc_feature (1)..( 14): Result.005 file - promoters50/4766320
ttaatttggaatct

SEQ ID NO: 187533 - DNA, 14 bp, Unknown
  misc_feature (1)..( 14): Result.005 file - promoters50/4766320
ttaattagtaaaga

SEQ ID NO: 187534 - DNA, 16 bp, Unknown
  misc_feature (1)..( 16): Result.005 file - promoters50/4766320
ttcctttctttatata

SEQ ID NO: 187535 - DNA, 16 bp, Unknown
  misc_feature (1)..( 16): Result.005 file - promoters50/4766320
aagttattattatata

SEQ ID NO: 187536 - DNA, 16 bp, Unknown
  misc_feature (1)..( 16): Result.005 file - promoters50/4766320
tcccacctactatata

SEQ ID NO: 187537 - DNA, 16 bp, Unknown
  misc_feature (1)..( 16): Result.005 file - promoters50/4766320
ttcctttctttataaa

SEQ ID NO: 187538 - DNA, 16 bp, Unknown
  misc_feature (1)..( 16): Result.005 file - promoters50/4766320
cttctccgtctatata

SEQ ID NO: 187539 - DNA, 16 bp, Unknown
  misc_feature (1)..( 16): Result.005 file - promoters50/4766320
cctaaatatctacata

SEQ ID NO: 187540 - DNA, 15 bp, Unknown
  misc_feature (1)..( 15): Result.005 file - promoters50/4766324
ttttttcattgtagt

SEQ ID NO: 187541 - DNA, 15 bp, Unknown
  misc_feature (1)..( 15): Result.005 file - promoters50/4766324
gtttctcattaattg

SEQ ID NO: 187542 - DNA, 15 bp, Unknown
  misc_feature (1)..( 15): Result.005 file - promoters50/4766324
atttttttaatcaag

SEQ ID NO: 187543 - DNA, 15 bp, Unknown
  misc_feature (1)..( 15): Result.005 file - promoters50/4766324
acagttcattgaaga

SEQ ID NO: 187544 - DNA, 15 bp, Unknown
  misc_feature (1)..( 15): Result.005 file - promoters50/4766324
aagttttattgtagt

SEQ ID NO: 187545 - DNA, 15 bp, Unknown
  misc_feature (1)..( 15): Result.005 file - promoters50/4766324
gtttctttttgcagt

SEQ ID NO: 187546 - DNA, 15 bp, Unknown
  misc_feature (1)..( 15): Result.005 file - promoters50/4766324
actttttaacacttc

SEQ ID NO: 187547 - DNA, 16 bp, Unknown
  misc_feature (1)..( 16): Result.005 file - promoters50/4766324
actatataatggtagc

SEQ ID NO: 187548 - DNA, 16 bp, Unknown
  misc_feature (1)..( 16): Result.005 file - promoters50/4766324
tctatataatagtagc

SEQ ID NO: 187549 - DNA, 16 bp, Unknown
  misc_feature (1)..( 16): Result.005 file - promoters50/4766324
ctaatataaaacaaac

SEQ ID NO: 187550 - DNA, 16 bp, Unknown
  misc_feature (1)..( 16): Result.005 file - promoters50/4766324
actatatatacatatc

SEQ ID NO: 187551 - DNA, 16 bp, Unknown
  misc_feature (1)..( 16): Result.005 file - promoters50/4766324
tgtatatatacccttc

SEQ ID NO: 187552 - DNA, 16 bp, Unknown
  misc_feature (1)..( 16): Result.005 file - promoters50/4766324
ccaatataatctcttt

SEQ ID NO: 187553 - DNA, 15 bp, Unknown
  misc_feature (1)..( 15): Result.005 file - promoters50/4766324
gttagatgttttttt

SEQ ID NO: 187554 - DNA, 15 bp, Unknown
  misc_feature (1)..( 15): Result.005 file - promoters50/4766324
agaatttgttttctc

SEQ ID NO: 187555 - DNA, 15 bp, Unknown
  misc_feature (1)..( 15): Result.005 file - promoters50/4766324
attttttggtttctc

SEQ ID NO: 187556 - DNA, 15 bp, Unknown
  misc_feature (1)..( 15): Result.005 file - promoters50/4766324
atagtttctttttgc

SEQ ID NO: 187557 - DNA, 15 bp, Unknown
  misc_feature (1)..( 15): Result.005 file - promoters50/4766324
ataatttcttactag

SEQ ID NO: 187558 - DNA, 15 bp, Unknown
  misc_feature (1)..( 15): Result.005 file - promoters50/4766324
ttgaatttttttaat

SEQ ID NO: 187559 - DNA, 10 bp, Unknown
  misc_feature (1)..( 10): Result.005 file - promoters50/4766335
agaaatgatg

SEQ ID NO: 187560 - DNA, 10 bp, Unknown
  misc_feature (1)..( 10): Result.005 file - promoters50/4766335
ttaaatgaag

SEQ ID NO: 187561 - DNA, 10 bp, Unknown
  misc_feature (1)..( 10): Result.005 file - promoters50/4766335
aataatgatg

SEQ ID NO: 187562 - DNA, 10 bp, Unknown
  misc_feature (1)..( 10): Result.005 file - promoters50/4766335
ttacatgaac

SEQ ID NO: 187563 - DNA, 10 bp, Unknown
  misc_feature (1)..( 10): Result.005 file - promoters50/4766335
gacaatgaat

SEQ ID NO: 187564 - DNA, 13 bp, Unknown
  misc_feature (1)..( 13): Result.005 file - promoters50/4766335
cttctataaatac

SEQ ID NO: 187565 - DNA, 13 bp, Unknown
  misc_feature (1)..( 13): Result.005 file - promoters50/4766335
agtctataaatgt

SEQ ID NO: 187566 - DNA, 13 bp, Unknown
  misc_feature (1)..( 13): Result.005 file - promoters50/4766335
cgtttataaaagc

SEQ ID NO: 187567 - DNA, 13 bp, Unknown
  misc_feature (1)..( 13): Result.005 file - promoters50/4766335
cttttatttattt

SEQ ID NO: 187568 - DNA, 13 bp, Unknown
  misc_feature (1)..( 13): Result.005 file - promoters50/4766335
taagtatatatac

SEQ ID NO: 187569 - DNA, 12 bp, Unknown
  misc_feature (1)..( 12): Result.005 file - promoters50/4766335
aaagtttgtttc

SEQ ID NO: 187570 - DNA, 12 bp, Unknown
  misc_feature (1)..( 12): Result.005 file - promoters50/4766335
aaaatttggtcc

SEQ ID NO: 187571 - DNA, 12 bp, Unknown
  misc_feature (1)..( 12): Result.005 file - promoters50/4766335
attatttggatt

SEQ ID NO: 187572 - DNA, 12 bp, Unknown
  misc_feature (1)..( 12): Result.005 file - promoters50/4766335
atattttgattt

SEQ ID NO: 187573 - DNA, 12 bp, Unknown
  misc_feature (1)..( 12): Result.005 file - promoters50/4766335
aaaattaaaata

SEQ ID NO: 187574 - DNA, 10 bp, Unknown
  misc_feature (1)..( 10): Result.005 file - promoters50/4766335
tattctttga

SEQ ID NO: 187575 - DNA, 10 bp, Unknown
  misc_feature (1)..( 10): Result.005 file - promoters50/4766335
atttctttca

SEQ ID NO: 187576 - DNA, 10 bp, Unknown
  misc_feature (1)..( 10): Result.005 file - promoters50/4766335
gattcttcga

SEQ ID NO: 187577 - DNA, 10 bp, Unknown
  misc_feature (1)..( 10): Result.005 file - promoters50/4766335
gatacttgtc

SEQ ID NO: 187578 - DNA, 10 bp, Unknown
  misc_feature (1)..( 10): Result.005 file - promoters50/4766335
gcatctttca

SEQ ID NO: 187579 - DNA, 11 bp, Unknown
  misc_feature (1)..( 11): Result.005 file - promoters50/4766350
atagcaaaaat

SEQ ID NO: 187580 - DNA, 11 bp, Unknown
  misc_feature (1)..( 11): Result.005 file - promoters50/4766350
atagcaaatct

SEQ ID NO: 187581 - DNA, 11 bp, Unknown
  misc_feature (1)..( 11): Result.005 file - promoters50/4766350
tcctcaaaagc

SEQ ID NO: 187582 - DNA, 6 bp, Unknown
  misc_feature (1)..( 6): Result.005 file - promoters50/4766350
aaaaga

SEQ ID NO: 187583 - DNA, 6 bp, Unknown
  misc_feature (1)..( 6): Result.005 file - promoters50/4766350
aaaaga

SEQ ID NO: 187584 - DNA, 6 bp, Unknown
  misc_feature (1)..( 6): Result.005 file - promoters50/4766350
aaaaga

SEQ ID NO: 187585 - DNA, 8 bp, Unknown
  misc_feature (1)..( 8): Result.005 file - promoters50/4766350
ctgagaac

SEQ ID NO: 187586 - DNA, 8 bp, Unknown
  misc_feature (1)..( 8): Result.005 file - promoters50/4766350
ttgaaaac

SEQ ID NO: 187587 - DNA, 8 bp, Unknown
  misc_feature (1)..( 8): Result.005 file - promoters50/4766350
ctgagaag

SEQ ID NO: 187588 - DNA, 9 bp, Unknown
  misc_feature (1)..( 9): Result.005 file - promoters50/4766350
aaaaatgat

SEQ ID NO: 187589 - DNA, 9 bp, Unknown
  misc_feature (1)..( 9): Result.005 file - promoters50/4766350
caaaaagat

SEQ ID NO: 187590 - DNA, 9 bp, Unknown
  misc_feature (1)..( 9): Result.005 file - promoters50/4766350
caaaaaacc

SEQ ID NO: 187591 - DNA, 9 bp, Unknown
  misc_feature (1)..( 9): Result.005 file - promoters50/4766350
ctaattgag

SEQ ID NO: 187592 - DNA, 9 bp, Unknown
  misc_feature (1)..( 9): Result.005 file - promoters50/4766350
ctaatggag

SEQ ID NO: 187593 - DNA, 9 bp, Unknown
  misc_feature (1)..( 9): Result.005 file - promoters50/4766350
ttaatggtg

SEQ ID NO: 187594 - DNA, 8 bp, Unknown
  misc_feature (1)..( 8): Result.005 file - promoters50/4766353
tatagtaa

SEQ ID NO: 187595 - DNA, 8 bp, Unknown
  misc_feature (1)..( 8): Result.005 file - promoters50/4766353
tatggtac

SEQ ID NO: 187596 - DNA, 8 bp, Unknown
  misc_feature (1)..( 8): Result.005 file - promoters50/4766353
tatattaa

SEQ ID NO: 187597 - DNA, 10 bp, Unknown
  misc_feature (1)..( 10): Result.005 file - promoters50/4766353
ccttaaaaat

SEQ ID NO: 187598 - DNA, 10 bp, Unknown
  misc_feature (1)..( 10): Result.005 file - promoters50/4766353
ttgtaataat

SEQ ID NO: 187599 - DNA, 10 bp, Unknown
  misc_feature (1)..( 10): Result.005 file - promoters50/4766353
ttgtgatatt

SEQ ID NO: 187600 - DNA, 7 bp, Unknown
  misc_feature (1)..( 7): Result.005 file - promoters50/4766353
tttctaa

SEQ ID NO: 187601 - DNA, 7 bp, Unknown
  misc_feature (1)..( 7): Result.005 file - promoters50/4766353
tttataa

SEQ ID NO: 187602 - DNA, 7 bp, Unknown
  misc_feature (1)..( 7): Result.005 file - promoters50/4766353
tttgtaa

SEQ ID NO: 187603 - DNA, 12 bp, Unknown
  misc_feature (1)..( 12): Result.005 file - promoters50/4766365
caagtaagtagg

SEQ ID NO: 187604 - DNA, 12 bp, Unknown
  misc_feature (1)..( 12): Result.005 file - promoters50/4766365
aaagtaaatatt

SEQ ID NO: 187605 - DNA, 12 bp, Unknown
  misc_feature (1)..( 12): Result.005 file - promoters50/4766365
aaattaaacatt

SEQ ID NO: 187606 - DNA, 12 bp, Unknown
  misc_feature (1)..( 12): Result.005 file - promoters50/4766365
gaatcaaaaaat

SEQ ID NO: 187607 - DNA, 11 bp, Unknown
  misc_feature (1)..( 11): Result.005 file - promoters50/4766372
aatttacttat

SEQ ID NO: 187608 - DNA, 11 bp, Unknown
  misc_feature (1)..( 11): Result.005 file - promoters50/4766372
gttttccttat

SEQ ID NO: 187609 - DNA, 11 bp, Unknown
  misc_feature (1)..( 11): Result.005 file - promoters50/4766372
gttttccgtta

SEQ ID NO: 187610 - DNA, 10 bp, Unknown
  misc_feature (1)..( 10): Result.005 file - promoters50/4766372
aaaaaattta

SEQ ID NO: 187611 - DNA, 10 bp, Unknown
  misc_feature (1)..( 10): Result.005 file - promoters50/4766372
aaaaaagact

SEQ ID NO: 187612 - DNA, 10 bp, Unknown
  misc_feature (1)..( 10): Result.005 file - promoters50/4766372
aaagatttaa

SEQ ID NO: 187613 - DNA, 8 bp, Unknown
  misc_feature (1)..( 8): Result.005 file - promoters50/4766372
gaacttta

SEQ ID NO: 187614 - DNA, 8 bp, Unknown
  misc_feature (1)..( 8): Result.005 file - promoters50/4766372
gaattttt

SEQ ID NO: 187615 - DNA, 8 bp, Unknown
  misc_feature (1)..( 8): Result.005 file - promoters50/4766372
gcattttt

SEQ ID NO: 187616 - DNA, 13 bp, Unknown
  misc_feature (1)..( 13): Result.005 file - promoters50/4766376
tctgaaaacaatg

SEQ ID NO: 187617 - DNA, 13 bp, Unknown
  misc_feature (1)..( 13): Result.005 file - promoters50/4766376
cgtgataacacgt

SEQ ID NO: 187618 - DNA, 13 bp, Unknown
  misc_feature (1)..( 13): Result.005 file - promoters50/4766376
agaaaaaacactt

SEQ ID NO: 187619 - DNA, 13 bp, Unknown
  misc_feature (1)..( 13): Result.005 file - promoters50/4766376
cgtggtaatgtgt

SEQ ID NO: 187620 - DNA, 13 bp, Unknown
  misc_feature (1)..( 13): Result.005 file - promoters50/4766376
aaataaaaatact

SEQ ID NO: 187621 - DNA, 13 bp, Unknown
  misc_feature (1)..( 13): Result.005 file - promoters50/4766376
tgtgctaagtaac

SEQ ID NO: 187622 - DNA, 9 bp, Unknown
  misc_feature (1)..( 9): Result.005 file - promoters50/4766376
ttatatatc

SEQ ID NO: 187623 - DNA, 9 bp, Unknown
  misc_feature (1)..( 9): Result.005 file - promoters50/4766376
gtatatata

SEQ ID NO: 187624 - DNA, 9 bp, Unknown
  misc_feature (1)..( 9): Result.005 file - promoters50/4766376
ctataaata

SEQ ID NO: 187625 - DNA, 9 bp, Unknown
  misc_feature (1)..( 9): Result.005 file - promoters50/4766376
atataaata

SEQ ID NO: 187626 - DNA, 9 bp, Unknown
  misc_feature (1)..( 9): Result.005 file - promoters50/4766376
ctataaata

SEQ ID NO: 187627 - DNA, 9 bp, Unknown
  misc_feature (1)..( 9): Result.005 file - promoters50/4766376
ctataaaaa

SEQ ID NO: 187628 - DNA, 9 bp, Unknown
  misc_feature (1)..( 9): Result.005 file - promoters50/4766376
ctttaaata

SEQ ID NO: 187629 - DNA, 9 bp, Unknown
  misc_feature (1)..( 9): Result.005 file - promoters50/4766376
ctataaata

SEQ ID NO: 187630 - DNA, 9 bp, Unknown
  misc_feature (1)..( 9): Result.005 file - promoters50/4766376
atataaata

SEQ ID NO: 187631 - DNA, 9 bp, Unknown
  misc_feature (1)..( 9): Result.005 file - promoters50/4766376
gtatatata

SEQ ID NO: 187632 - DNA, 9 bp, Unknown
  misc_feature (1)..( 9): Result.005 file - promoters50/4766376
ctataaata

SEQ ID NO: 187633 - DNA, 9 bp, Unknown
  misc_feature (1)..( 9): Result.005 file - promoters50/4766376
ctataaaaa

SEQ ID NO: 187634 - DNA, 9 bp, Unknown
  misc_feature (1)..( 9): Result.005 file - promoters50/4766376
ctttaaata

SEQ ID NO: 187635 - DNA, 13 bp, Unknown
  misc_feature (1)..( 13): Result.005 file - promoters50/4766391
gaaatatagaacc

SEQ ID NO: 187636 - DNA, 13 bp, Unknown
  misc_feature (1)..( 13): Result.005 file - promoters50/4766391
aaaaaataacaaa

SEQ ID NO: 187637 - DNA, 13 bp, Unknown
  misc_feature (1)..( 13): Result.005 file - promoters50/4766391
aaaaaacaaaaaa

SEQ ID NO: 187638 - DNA, 17 bp, Unknown
  misc_feature (1)..( 17): Result.005 file - promoters50/4766395
ttcaaagaaaaattctt

SEQ ID NO: 187639 - DNA, 17 bp, Unknown
  misc_feature (1)..( 17): Result.005 file - promoters50/4766395
catatacaaaaattagc

SEQ ID NO: 187640 - DNA, 17 bp, Unknown
  misc_feature (1)..( 17): Result.005 file - promoters50/4766395
atttaacataaattaac

SEQ ID NO: 187641 - DNA, 17 bp, Unknown
  misc_feature (1)..( 17): Result.005 file - promoters50/4766395
attttacagaaatattc

SEQ ID NO: 187642 - DNA, 17 bp, Unknown
  misc_feature (1)..( 17): Result.005 file - promoters50/4766395
tagttatataatttaaa

SEQ ID NO: 187643 - DNA, 17 bp, Unknown
  misc_feature (1)..( 17): Result.005 file - promoters50/4766395
gaaacaaggatattatt

SEQ ID NO: 187644 - DNA, 15 bp, Unknown
  misc_feature (1)..( 15): Result.005 file - promoters50/4766395
gaattatttaattta

SEQ ID NO: 187645 - DNA, 15 bp, Unknown
  misc_feature (1)..( 15): Result.005 file - promoters50/4766395
atttaacataaatta

SEQ ID NO: 187646 - DNA, 15 bp, Unknown
  misc_feature (1)..( 15): Result.005 file - promoters50/4766395
tagttatataattta

SEQ ID NO: 187647 - DNA, 15 bp, Unknown
  misc_feature (1)..( 15): Result.005 file - promoters50/4766395
catatacaaaaatta

SEQ ID NO: 187648 - DNA, 15 bp, Unknown
  misc_feature (1)..( 15): Result.005 file - promoters50/4766395
attttacagaaatat

SEQ ID NO: 187649 - DNA, 15 bp, Unknown
  misc_feature (1)..( 15): Result.005 file - promoters50/4766395
caaggatattattac

SEQ ID NO: 187650 - DNA, 9 bp, Unknown
  misc_feature (1)..( 9): Result.005 file - promoters50/4766421
taatgattc

SEQ ID NO: 187651 - DNA, 9 bp, Unknown
  misc_feature (1)..( 9): Result.005 file - promoters50/4766421
aattgattc

SEQ ID NO: 187652 - DNA, 9 bp, Unknown
  misc_feature (1)..( 9): Result.005 file - promoters50/4766421
aatttattt

SEQ ID NO: 187653 - DNA, 7 bp, Unknown
  misc_feature (1)..( 7): Result.005 file - promoters50/4766421
caatatt

SEQ ID NO: 187654 - DNA, 7 bp, Unknown
  misc_feature (1)..( 7): Result.005 file - promoters50/4766421
caaaatt

SEQ ID NO: 187655 - DNA, 7 bp, Unknown
  misc_feature (1)..( 7): Result.005 file - promoters50/4766421
taaaatt

SEQ ID NO: 187656 - DNA, 7 bp, Unknown
  misc_feature (1)..( 7): Result.005 file - promoters50/4766421
atgtttt

SEQ ID NO: 187657 - DNA, 7 bp, Unknown
  misc_feature (1)..( 7): Result.005 file - promoters50/4766421
atgcttt

SEQ ID NO: 187658 - DNA, 7 bp, Unknown
  misc_feature (1)..( 7): Result.005 file - promoters50/4766421
atgtttt

SEQ ID NO: 187659 - DNA, 8 bp, Unknown
  misc_feature (1)..( 8): Result.005 file - promoters50/4766421
ttacaata

SEQ ID NO: 187660 - DNA, 8 bp, Unknown
  misc_feature (1)..( 8): Result.005 file - promoters50/4766421
ttaaaatt

SEQ ID NO: 187661 - DNA, 8 bp, Unknown
  misc_feature (1)..( 8): Result.005 file - promoters50/4766421
tcaaaatt

SEQ ID NO: 187662 - DNA, 8 bp, Unknown
  misc_feature (1)..( 8): Result.005 file - promoters50/4766425
ccgggctg

SEQ ID NO: 187663 - DNA, 8 bp, Unknown
  misc_feature (1)..( 8): Result.005 file - promoters50/4766425
gcggtctg

SEQ ID NO: 187664 - DNA, 8 bp, Unknown
  misc_feature (1)..( 8): Result.005 file - promoters50/4766425
gcggtcac

SEQ ID NO: 187665 - DNA, 8 bp, Unknown
  misc_feature (1)..( 8): Result.005 file - promoters50/4766429
taagaaac

SEQ ID NO: 187666 - DNA, 8 bp, Unknown
  misc_feature (1)..( 8): Result.005 file - promoters50/4766429
aaagaaac

SEQ ID NO: 187667 - DNA, 8 bp, Unknown
  misc_feature (1)..( 8): Result.005 file - promoters50/4766429
taagaatt

SEQ ID NO: 187668 - DNA, 9 bp, Unknown
  misc_feature (1)..( 9): Result.005 file - promoters50/4766458
aaatttgac

SEQ ID NO: 187669 - DNA, 9 bp, Unknown
  misc_feature (1)..( 9): Result.005 file - promoters50/4766458
aaatttgac

SEQ ID NO: 187670 - DNA, 9 bp, Unknown
  misc_feature (1)..( 9): Result.005 file - promoters50/4766458
caatttttt

SEQ ID NO: 187671 - DNA, 8 bp, Unknown
  misc_feature (1)..( 8): Result.005 file - promoters50/4766458
attataat

SEQ ID NO: 187672 - DNA, 8 bp, Unknown
  misc_feature (1)..( 8): Result.005 file - promoters50/4766458
attatata

SEQ ID NO: 187673 - DNA, 8 bp, Unknown
  misc_feature (1)..( 8): Result.005 file - promoters50/4766458
attctaat

SEQ ID NO: 187674 - DNA, 7 bp, Unknown
  misc_feature (1)..( 7): Result.005 file - promoters50/4766458
aaaaagt

SEQ ID NO: 187675 - DNA, 7 bp, Unknown
  misc_feature (1)..( 7): Result.005 file - promoters50/4766458
aaacagt

SEQ ID NO: 187676 - DNA, 7 bp, Unknown
  misc_feature (1)..( 7): Result.005 file - promoters50/4766458
aaattaa

SEQ ID NO: 187677 - DNA, 12 bp, Unknown
  misc_feature (1)..( 12): Result.005 file - promoters50/4766458
ataaaaataaaa

SEQ ID NO: 187678 - DNA, 12 bp, Unknown
  misc_feature (1)..( 12): Result.005 file - promoters50/4766458
accaaattaaaa

SEQ ID NO: 187679 - DNA, 12 bp, Unknown
  misc_feature (1)..( 12): Result.005 file - promoters50/4766458
accagattctaa

SEQ ID NO: 187680 - DNA, 11 bp, Unknown
  misc_feature (1)..( 11): Result.005 file - promoters50/4766477
actttatgggc

SEQ ID NO: 187681 - DNA, 11 bp, Unknown
  misc_feature (1)..( 11): Result.005 file - promoters50/4766477
aatttttggtc

SEQ ID NO: 187682 - DNA, 11 bp, Unknown
  misc_feature (1)..( 11): Result.005 file - promoters50/4766477
aatatttgggc

SEQ ID NO: 187683 - DNA, 11 bp, Unknown
  misc_feature (1)..( 11): Result.005 file - promoters50/4766477
aatagttgaca

SEQ ID NO: 187684 - DNA, 11 bp, Unknown
  misc_feature (1)..( 11): Result.005 file - promoters50/4766477
aacctttgggc

SEQ ID NO: 187685 - DNA, 11 bp, Unknown
  misc_feature (1)..( 11): Result.005 file - promoters50/4766477
catttttcagt

SEQ ID NO: 187686 - DNA, 10 bp, Unknown
  misc_feature (1)..( 10): Result.005 file - promoters50/4766477
cagttttttc

SEQ ID NO: 187687 - DNA, 10 bp, Unknown
  misc_feature (1)..( 10): Result.005 file - promoters50/4766477
atgtttttag

SEQ ID NO: 187688 - DNA, 10 bp, Unknown
  misc_feature (1)..( 10): Result.005 file - promoters50/4766477
tagtctttgc

SEQ ID NO: 187689 - DNA, 10 bp, Unknown
  misc_feature (1)..( 10): Result.005 file - promoters50/4766477
gtgtcttttg

SEQ ID NO: 187690 - DNA, 10 bp, Unknown
  misc_feature (1)..( 10): Result.005 file - promoters50/4766477
atgattttcc

SEQ ID NO: 187691 - DNA, 10 bp, Unknown
  misc_feature (1)..( 10): Result.005 file - promoters50/4766477
tactttttag

SEQ ID NO: 187692 - DNA, 11 bp, Unknown
  misc_feature (1)..( 11): Result.005 file - promoters50/4766477
aacaaaattaa

SEQ ID NO: 187693 - DNA, 11 bp, Unknown
  misc_feature (1)..( 11): Result.005 file - promoters50/4766477
gaaaaaaataa

SEQ ID NO: 187694 - DNA, 11 bp, Unknown
  misc_feature (1)..( 11): Result.005 file - promoters50/4766477
cacacaatttt

SEQ ID NO: 187695 - DNA, 11 bp, Unknown
  misc_feature (1)..( 11): Result.005 file - promoters50/4766477
aacaaaatgca

SEQ ID NO: 187696 - DNA, 11 bp, Unknown
  misc_feature (1)..( 11): Result.005 file - promoters50/4766477
aataaacttat

SEQ ID NO: 187697 - DNA, 11 bp, Unknown
  misc_feature (1)..( 11): Result.005 file - promoters50/4766477
tacaaacttta

SEQ ID NO: 187698 - DNA, 12 bp, Unknown
  misc_feature (1)..( 12): Result.005 file - promoters50/4766477
attaaaagtttt

SEQ ID NO: 187699 - DNA, 12 bp, Unknown
  misc_feature (1)..( 12): Result.005 file - promoters50/4766477
catataagtttg

SEQ ID NO: 187700 - DNA, 13 bp, Unknown
  misc_feature (1)..( 13): Result.005 file - promoters50/4766477
gtacaaacgttta

SEQ ID NO: 187701 - DNA, 13 bp, Unknown
  misc_feature (1)..( 13): Result.005 file - promoters50/4766477
attgaaaatttat

SEQ ID NO: 187702 - DNA, 13 bp, Unknown
  misc_feature (1)..( 13): Result.005 file - promoters50/4766477
tccaataatttac

SEQ ID NO: 187703 - DNA, 13 bp, Unknown
  misc_feature (1)..( 13): Result.005 file - promoters50/4766477
ggtaagacgatta

SEQ ID NO: 187704 - DNA, 13 bp, Unknown
  misc_feature (1)..( 13): Result.005 file - promoters50/4766477
taacaatatatat

SEQ ID NO: 187705 - DNA, 13 bp, Unknown
  misc_feature (1)..( 13): Result.005 file - promoters50/4766477
caacaatgtacaa

SEQ ID NO: 187706 - DNA, 13 bp, Unknown
  misc_feature (1)..( 13): Result.005 file - promoters50/4766477
taataatggttct

SEQ ID NO: 187707 - DNA, 13 bp, Unknown
  misc_feature (1)..( 13): Result.005 file - promoters50/4766477
caataatttacat

SEQ ID NO: 187708 - DNA, 13 bp, Unknown
  misc_feature (1)..( 13): Result.005 file - promoters50/4766477
tgaaaatttatac

SEQ ID NO: 187709 - DNA, 13 bp, Unknown
  misc_feature (1)..( 13): Result.005 file - promoters50/4766477
ttacaatttacaa

SEQ ID NO: 187710 - DNA, 8 bp, Unknown
  misc_feature (1)..( 8): Result.005 file - promoters50/4766481
attctgtg

SEQ ID NO: 187711 - DNA, 8 bp, Unknown
  misc_feature (1)..( 8): Result.005 file - promoters50/4766481
attttgtg

SEQ ID NO: 187712 - DNA, 8 bp, Unknown
  misc_feature (1)..( 8): Result.005 file - promoters50/4766481
attttgtt

SEQ ID NO: 187713 - DNA, 8 bp, Unknown
  misc_feature (1)..( 8): Result.005 file - promoters50/4766481
ctcaataa

SEQ ID NO: 187714 - DNA, 8 bp, Unknown
  misc_feature (1)..( 8): Result.005 file - promoters50/4766481
ctcaattt

SEQ ID NO: 187715 - DNA, 8 bp, Unknown
  misc_feature (1)..( 8): Result.005 file - promoters50/4766481
atcatttt

SEQ ID NO: 187716 - DNA, 10 bp, Unknown
  misc_feature (1)..( 10): Result.005 file - promoters50/4766490
aaaaaaaaga

SEQ ID NO: 187717 - DNA, 10 bp, Unknown
  misc_feature (1)..( 10): Result.005 file - promoters50/4766490
tttgaaaaga

SEQ ID NO: 187718 - DNA, 11 bp, Unknown
  misc_feature (1)..( 11): Result.005 file - promoters50/4766490
gaagaaacaga

SEQ ID NO: 187719 - DNA, 6 bp, Unknown
  misc_feature (1)..( 6): Result.005 file - promoters50/4766497
aagctt

SEQ ID NO: 187720 - DNA, 6 bp, Unknown
  misc_feature (1)..( 6): Result.005 file - promoters50/4766497
aagctt

SEQ ID NO: 187721 - DNA, 6 bp, Unknown
  misc_feature (1)..( 6): Result.005 file - promoters50/4766497
aagctt

SEQ ID NO: 187722 - DNA, 7 bp, Unknown
  misc_feature (1)..( 7): Result.005 file - promoters50/4766497
ttttttt

SEQ ID NO: 187723 - DNA, 7 bp, Unknown
  misc_feature (1)..( 7): Result.005 file - promoters50/4766497
tttattt

SEQ ID NO: 187724 - DNA, 7 bp, Unknown
  misc_feature (1)..( 7): Result.005 file - promoters50/4766497
attattt

SEQ ID NO: 187725 - DNA, 7 bp, Unknown
  misc_feature (1)..( 7): Result.005 file - promoters50/4766497
attattt

SEQ ID NO: 187726 - DNA, 10 bp, Unknown
  misc_feature (1)..( 10): Result.005 file - promoters50/4766497
ttaatattat

SEQ ID NO: 187727 - DNA, 10 bp, Unknown
  misc_feature (1)..( 10): Result.005 file - promoters50/4766497
ttaaaatttc

SEQ ID NO: 187728 - DNA, 10 bp, Unknown
  misc_feature (1)..( 10): Result.005 file - promoters50/4766497
tctatattat

SEQ ID NO: 187729 - DNA, 8 bp, Unknown
  misc_feature (1)..( 8): Result.005 file - promoters50/4766497
aaaggaac

SEQ ID NO: 187730 - DNA, 8 bp, Unknown
  misc_feature (1)..( 8): Result.005 file - promoters50/4766497
aaacgaat

SEQ ID NO: 187731 - DNA, 8 bp, Unknown
  misc_feature (1)..( 8): Result.005 file - promoters50/4766497
taacaaat

SEQ ID NO: 187732 - DNA, 11 bp, Unknown
  misc_feature (1)..( 11): Result.005 file - promoters50/4766497
taataacaaat

SEQ ID NO: 187733 - DNA, 11 bp, Unknown
  misc_feature (1)..( 11): Result.005 file - promoters50/4766497
taatatcaaag

SEQ ID NO: 187734 - DNA, 11 bp, Unknown
  misc_feature (1)..( 11): Result.005 file - promoters50/4766497
tcaaaacgaat

SEQ ID NO: 187735 - DNA, 7 bp, Unknown
  misc_feature (1)..( 7): Result.005 file - promoters50/4766497
aaagaag

SEQ ID NO: 187736 - DNA, 7 bp, Unknown
  misc_feature (1)..( 7): Result.005 file - promoters50/4766497
aaagaaa

SEQ ID NO: 187737 - DNA, 7 bp, Unknown
  misc_feature (1)..( 7): Result.005 file - promoters50/4766497
aaataag

SEQ ID NO: 187738 - DNA, 10 bp, Unknown
  misc_feature (1)..( 10): Result.005 file - promoters50/4766497
aaaaccaaaa

SEQ ID NO: 187739 - DNA, 10 bp, Unknown
  misc_feature (1)..( 10): Result.005 file - promoters50/4766497
aaaatcaaaa

SEQ ID NO: 187740 - DNA, 10 bp, Unknown
  misc_feature (1)..( 10): Result.005 file - promoters50/4766497
aatatcaaag

SEQ ID NO: 187741 - DNA, 8 bp, Unknown
  misc_feature (1)..( 8): Result.005 file - promoters50/4766500
atcacatt

SEQ ID NO: 187742 - DNA, 8 bp, Unknown
  misc_feature (1)..( 8): Result.005 file - promoters50/4766500
atcagatt

SEQ ID NO: 187743 - DNA, 8 bp, Unknown
  misc_feature (1)..( 8): Result.005 file - promoters50/4766500
accacatt

SEQ ID NO: 187744 - DNA, 12 bp, Unknown
  misc_feature (1)..( 12): Result.005 file - promoters50/4766524
tttgtagatttt

SEQ ID NO: 187745 - DNA, 12 bp, Unknown
  misc_feature (1)..( 12): Result.005 file - promoters50/4766524
agaagagatttt

SEQ ID NO: 187746 - DNA, 12 bp, Unknown
  misc_feature (1)..( 12): Result.005 file - promoters50/4766524
tttgaagatttg

SEQ ID NO: 187747 - DNA, 9 bp, Unknown
  misc_feature (1)..( 9): Result.005 file - promoters50/4766524
tttttcaaa

SEQ ID NO: 187748 - DNA, 9 bp, Unknown
  misc_feature (1)..( 9): Result.005 file - promoters50/4766524
ttttttaaa

SEQ ID NO: 187749 - DNA, 9 bp, Unknown
  misc_feature (1)..( 9): Result.005 file - promoters50/4766524
gatttgaat

SEQ ID NO: 187750 - DNA, 13 bp, Unknown
  misc_feature (1)..( 13): Result.005 file - promoters50/4766524
tttttataccatt

SEQ ID NO: 187751 - DNA, 13 bp, Unknown
  misc_feature (1)..( 13): Result.005 file - promoters50/4766524
tttttataacatt

SEQ ID NO: 187752 - DNA, 13 bp, Unknown
  misc_feature (1)..( 13): Result.005 file - promoters50/4766524
tatgtatgccaca

SEQ ID NO: 187753 - DNA, 9 bp, Unknown
  misc_feature (1)..( 9): Result.005 file - promoters50/4766524
aaacaaaaa

SEQ ID NO: 187754 - DNA, 9 bp, Unknown
  misc_feature (1)..( 9): Result.005 file - promoters50/4766524
aaacaaaag

SEQ ID NO: 187755 - DNA, 9 bp, Unknown
  misc_feature (1)..( 9): Result.005 file - promoters50/4766524
gaccaaaag

SEQ ID NO: 187756 - DNA, 9 bp, Unknown
  misc_feature (1)..( 9): Result.005 file - promoters50/4766524
tttgttttt

SEQ ID NO: 187757 - DNA, 9 bp, Unknown
  misc_feature (1)..( 9): Result.005 file - promoters50/4766524
tttatttat

SEQ ID NO: 187758 - DNA, 9 bp, Unknown
  misc_feature (1)..( 9): Result.005 file - promoters50/4766524
tttatatat

SEQ ID NO: 187759 - DNA, 8 bp, Unknown
  misc_feature (1)..( 8): Result.005 file - promoters50/4766524
atttttac

SEQ ID NO: 187760 - DNA, 8 bp, Unknown
  misc_feature (1)..( 8): Result.005 file - promoters50/4766524
attcttac

SEQ ID NO: 187761 - DNA, 8 bp, Unknown
  misc_feature (1)..( 8): Result.005 file - promoters50/4766524
attattat

SEQ ID NO: 187762 - DNA, 11 bp, Unknown
  misc_feature (1)..( 11): Result.005 file - promoters50/4766553
tctgataaata

SEQ ID NO: 187763 - DNA, 11 bp, Unknown
  misc_feature (1)..( 11): Result.005 file - promoters50/4766553
tctgataacaa

SEQ ID NO: 187764 - DNA, 11 bp, Unknown
  misc_feature (1)..( 11): Result.005 file - promoters50/4766553
aatgaaaacaa

SEQ ID NO: 187765 - DNA, 8 bp, Unknown
  misc_feature (1)..( 8): Result.005 file - promoters50/4766553
aacaacaa

SEQ ID NO: 187766 - DNA, 8 bp, Unknown
  misc_feature (1)..( 8): Result.005 file - promoters50/4766553
aacaacac

SEQ ID NO: 187767 - DNA, 8 bp, Unknown
  misc_feature (1)..( 8): Result.005 file - promoters50/4766553
ctcaacac

SEQ ID NO: 187768 - DNA, 8 bp, Unknown
  misc_feature (1)..( 8): Result.005 file - promoters50/4766553
gtagagaa

SEQ ID NO: 187769 - DNA, 8 bp, Unknown
  misc_feature (1)..( 8): Result.005 file - promoters50/4766553
gtagagaa

SEQ ID NO: 187770 - DNA, 8 bp, Unknown
  misc_feature (1)..( 8): Result.005 file - promoters50/4766553
atagagaa

SEQ ID NO: 187771 - DNA, 8 bp, Unknown
  misc_feature (1)..( 8): Result.005 file - promoters50/4766553
gagaagag

SEQ ID NO: 187772 - DNA, 8 bp, Unknown
  misc_feature (1)..( 8): Result.005 file - promoters50/4766553
aagaagaa

SEQ ID NO: 187773 - DNA, 8 bp, Unknown
  misc_feature (1)..( 8): Result.005 file - promoters50/4766553
aaggagaa

SEQ ID NO: 187774 - DNA, 12 bp, Unknown
  misc_feature (1)..( 12): Result.005 file - promoters50/4766578
taaatatttaag

SEQ ID NO: 187775 - DNA, 12 bp, Unknown
  misc_feature (1)..( 12): Result.005 file - promoters50/4766578
tccataattagt

SEQ ID NO: 187776 - DNA, 12 bp, Unknown
  misc_feature (1)..( 12): Result.005 file - promoters50/4766578
taaatacttaag

SEQ ID NO: 187777 - DNA, 12 bp, Unknown
  misc_feature (1)..( 12): Result.005 file - promoters50/4766578
atagtaattact

SEQ ID NO: 187778 - DNA, 12 bp, Unknown
  misc_feature (1)..( 12): Result.005 file - promoters50/4766578
gatgtaattaag

SEQ ID NO: 187779 - DNA, 7 bp, Unknown
  misc_feature (1)..( 7): Result.005 file - promoters50/4766578
taattaa

SEQ ID NO: 187780 - DNA, 7 bp, Unknown
  misc_feature (1)..( 7): Result.005 file - promoters50/4766578
taattaa

SEQ ID NO: 187781 - DNA, 7 bp, Unknown
  misc_feature (1)..( 7): Result.005 file - promoters50/4766578
taattac

SEQ ID NO: 187782 - DNA, 7 bp, Unknown
  misc_feature (1)..( 7): Result.005 file - promoters50/4766578
taattag

SEQ ID NO: 187783 - DNA, 10 bp, Unknown
  misc_feature (1)..( 10): Result.005 file - promoters50/4766578
aaacattaac

SEQ ID NO: 187784 - DNA, 10 bp, Unknown
  misc_feature (1)..( 10): Result.005 file - promoters50/4766578
aaaaattatt

SEQ ID NO: 187785 - DNA, 10 bp, Unknown
  misc_feature (1)..( 10): Result.005 file - promoters50/4766578
aaacaataaa

SEQ ID NO: 187786 - DNA, 10 bp, Unknown
  misc_feature (1)..( 10): Result.005 file - promoters50/4766578
gtaaaataaa

SEQ ID NO: 187787 - DNA, 7 bp, Unknown
  misc_feature (1)..( 7): Result.005 file - promoters50/4766578
aaaaaaa

SEQ ID NO: 187788 - DNA, 7 bp, Unknown
  misc_feature (1)..( 7): Result.005 file - promoters50/4766578
aaaaaaa

SEQ ID NO: 187789 - DNA, 7 bp, Unknown
  misc_feature (1)..( 7): Result.005 file - promoters50/4766578
aaaaaac

SEQ ID NO: 187790 - DNA, 7 bp, Unknown
  misc_feature (1)..( 7): Result.005 file - promoters50/4766578
ataaaaa

SEQ ID NO: 187791 - DNA, 16 bp, Unknown
  misc_feature (1)..( 16): Result.005 file - promoters50/4766578
ggttttttgattaatg

SEQ ID NO: 187792 - DNA, 16 bp, Unknown
  misc_feature (1)..( 16): Result.005 file - promoters50/4766578
attattttaattttgg

SEQ ID NO: 187793 - DNA, 17 bp, Unknown
  misc_feature (1)..( 17): Result.005 file - promoters50/4766578
atatttcttgaattatc

SEQ ID NO: 187794 - DNA, 17 bp, Unknown
  misc_feature (1)..( 17): Result.005 file - promoters50/4766578
acttgtttcaatattgg

SEQ ID NO: 187795 - DNA, 17 bp, Unknown
  misc_feature (1)..( 17): Result.005 file - promoters50/4766578
atattgcttgtgctaag

SEQ ID NO: 187796 - DNA, 8 bp, Unknown
  misc_feature (1)..( 8): Result.005 file - promoters50/4766585
ttttcatt

SEQ ID NO: 187797 - DNA, 8 bp, Unknown
  misc_feature (1)..( 8): Result.005 file - promoters50/4766585
gtttgatt

SEQ ID NO: 187798 - DNA, 8 bp, Unknown
  misc_feature (1)..( 8): Result.005 file - promoters50/4766585
ttttaatt

SEQ ID NO: 187799 - DNA, 11 bp, Unknown
  misc_feature (1)..( 11): Result.005 file - promoters50/4766585
gttcacgagtt

SEQ ID NO: 187800 - DNA, 11 bp, Unknown
  misc_feature (1)..( 11): Result.005 file - promoters50/4766585
gttgacgtttg

SEQ ID NO: 187801 - DNA, 11 bp, Unknown
  misc_feature (1)..( 11): Result.005 file - promoters50/4766585
attgatgtttg

SEQ ID NO: 187802 - DNA, 8 bp, Unknown
  misc_feature (1)..( 8): Result.005 file - promoters50/4766585
ttttttat

SEQ ID NO: 187803 - DNA, 8 bp, Unknown
  misc_feature (1)..( 8): Result.005 file - promoters50/4766585
ccttttat

SEQ ID NO: 187804 - DNA, 8 bp, Unknown
  misc_feature (1)..( 8): Result.005 file - promoters50/4766585
cctgttaa

SEQ ID NO: 187805 - DNA, 10 bp, Unknown
  misc_feature (1)..( 10): Result.005 file - promoters50/4766602
ctaatataaa

SEQ ID NO: 187806 - DNA, 10 bp, Unknown
  misc_feature (1)..( 10): Result.005 file - promoters50/4766602
actatataat

SEQ ID NO: 187807 - DNA, 10 bp, Unknown
  misc_feature (1)..( 10): Result.005 file - promoters50/4766602
actatataag

SEQ ID NO: 187808 - DNA, 10 bp, Unknown
  misc_feature (1)..( 10): Result.005 file - promoters50/4766602
actatataaa

SEQ ID NO: 187809 - DNA, 10 bp, Unknown
  misc_feature (1)..( 10): Result.005 file - promoters50/4766602
tctatataaa

SEQ ID NO: 187810 - DNA, 10 bp, Unknown
  misc_feature (1)..( 10): Result.005 file - promoters50/4766602
actatatata

SEQ ID NO: 187811 - DNA, 10 bp, Unknown
  misc_feature (1)..( 10): Result.005 file - promoters50/4766602
ccaatataat

SEQ ID NO: 187812 - DNA, 9 bp, Unknown
  misc_feature (1)..( 9): Result.005 file - promoters50/4766602
ctttttaac

SEQ ID NO: 187813 - DNA, 9 bp, Unknown
  misc_feature (1)..( 9): Result.005 file - promoters50/4766602
ttttttaat

SEQ ID NO: 187814 - DNA, 9 bp, Unknown
  misc_feature (1)..( 9): Result.005 file - promoters50/4766602
attttcaca

SEQ ID NO: 187815 - DNA, 9 bp, Unknown
  misc_feature (1)..( 9): Result.005 file - promoters50/4766602
gtttttttc

SEQ ID NO: 187816 - DNA, 9 bp, Unknown
  misc_feature (1)..( 9): Result.005 file - promoters50/4766602
gttttgatc

SEQ ID NO: 187817 - DNA, 9 bp, Unknown
  misc_feature (1)..( 9): Result.005 file - promoters50/4766602
gttttgatt

SEQ ID NO: 187818 - DNA, 11 bp, Unknown
  misc_feature (1)..( 11): Result.005 file - promoters50/4766602
attttcatttc

SEQ ID NO: 187819 - DNA, 11 bp, Unknown
  misc_feature (1)..( 11): Result.005 file - promoters50/4766602
gttttgatttt

SEQ ID NO: 187820 - DNA, 11 bp, Unknown
  misc_feature (1)..( 11): Result.005 file - promoters50/4766602
tttttcattgt

SEQ ID NO: 187821 - DNA, 11 bp, Unknown
  misc_feature (1)..( 11): Result.005 file - promoters50/4766602
attttcacaaa

SEQ ID NO: 187822 - DNA, 11 bp, Unknown
  misc_feature (1)..( 11): Result.005 file - promoters50/4766602
attttgatttt

SEQ ID NO: 187823 - DNA, 11 bp, Unknown
  misc_feature (1)..( 11): Result.005 file - promoters50/4766602
gttttgatcga

SEQ ID NO: 187824 - DNA, 7 bp, Unknown
  misc_feature (1)..( 7): Result.005 file - promoters50/4766654
tttatat

SEQ ID NO: 187825 - DNA, 7 bp, Unknown
  misc_feature (1)..( 7): Result.005 file - promoters50/4766654
tttgtat

SEQ ID NO: 187826 - DNA, 7 bp, Unknown
  misc_feature (1)..( 7): Result.005 file - promoters50/4766654
tttatat

SEQ ID NO: 187827 - DNA, 8 bp, Unknown
  misc_feature (1)..( 8): Result.005 file - promoters50/4766654
gtttataa

SEQ ID NO: 187828 - DNA, 8 bp, Unknown
  misc_feature (1)..( 8): Result.005 file - promoters50/4766654
ctttctaa

SEQ ID NO: 187829 - DNA, 8 bp, Unknown
  misc_feature (1)..( 8): Result.005 file - promoters50/4766654
gttgataa

SEQ ID NO: 187830 - DNA, 7 bp, Unknown
  misc_feature (1)..( 7): Result.005 file - promoters50/4766654
gataaac

SEQ ID NO: 187831 - DNA, 7 bp, Unknown
  misc_feature (1)..( 7): Result.005 file - promoters50/4766654
gataaaa

SEQ ID NO: 187832 - DNA, 8 bp, Unknown
  misc_feature (1)..( 8): Result.005 file - promoters50/4766654
aatagaaa

SEQ ID NO: 187833 - DNA, 8 bp, Unknown
  misc_feature (1)..( 8): Result.005 file - promoters50/4766654
aacactat

SEQ ID NO: 187834 - DNA, 8 bp, Unknown
  misc_feature (1)..( 8): Result.005 file - promoters50/4766654
aacacttt

SEQ ID NO: 187835 - DNA, 8 bp, Unknown
  misc_feature (1)..( 8): Result.005 file - promoters50/4766654
tacaattt

SEQ ID NO: 187836 - DNA, 8 bp, Unknown
  misc_feature (1)..( 8): Result.005 file - promoters50/4766678
gaaaaaaa

SEQ ID NO: 187837 - DNA, 8 bp, Unknown
  misc_feature (1)..( 8): Result.005 file - promoters50/4766678
aaaagaaa

SEQ ID NO: 187838 - DNA, 8 bp, Unknown
  misc_feature (1)..( 8): Result.005 file - promoters50/4766678
gaaaaagc

SEQ ID NO: 187839 - DNA, 8 bp, Unknown
  misc_feature (1)..( 8): Result.005 file - promoters50/4766678
gttaaaaa

SEQ ID NO: 187840 - DNA, 8 bp, Unknown
  misc_feature (1)..( 8): Result.005 file - promoters50/4766678
attacaaa

SEQ ID NO: 187841 - DNA, 8 bp, Unknown
  misc_feature (1)..( 8): Result.005 file - promoters50/4766678
gttaaagc

SEQ ID NO: 187842 - DNA, 8 bp, Unknown
  misc_feature (1)..( 8): Result.005 file - promoters50/4766678
attcattt

SEQ ID NO: 187843 - DNA, 8 bp, Unknown
  misc_feature (1)..( 8): Result.005 file - promoters50/4766678
tttcattt

SEQ ID NO: 187844 - DNA, 9 bp, Unknown
  misc_feature (1)..( 9): Result.005 file - promoters50/4766678
tttccatat

SEQ ID NO: 187845 - DNA, 8 bp, Unknown
  misc_feature (1)..( 8): Result.005 file - promoters50/4766678
aaaattca

SEQ ID NO: 187846 - DNA, 8 bp, Unknown
  misc_feature (1)..( 8): Result.005 file - promoters50/4766678
aaatttcc

SEQ ID NO: 187847 - DNA, 8 bp, Unknown
  misc_feature (1)..( 8): Result.005 file - promoters50/4766678
tcatttcc

SEQ ID NO: 187848 - DNA, 10 bp, Unknown
  misc_feature (1)..( 10): Result.005 file - promoters50/4766727
atatgaatca

SEQ ID NO: 187849 - DNA, 10 bp, Unknown
  misc_feature (1)..( 10): Result.005 file - promoters50/4766727
atataaatta

SEQ ID NO: 187850 - DNA, 10 bp, Unknown
  misc_feature (1)..( 10): Result.005 file - promoters50/4766727
acatacatta

SEQ ID NO: 187851 - DNA, 9 bp, Unknown
  misc_feature (1)..( 9): Result.005 file - promoters50/4766727
taatgatta

SEQ ID NO: 187852 - DNA, 9 bp, Unknown
  misc_feature (1)..( 9): Result.005 file - promoters50/4766727
aaataatta

SEQ ID NO: 187853 - DNA, 9 bp, Unknown
  misc_feature (1)..( 9): Result.005 file - promoters50/4766727
taatgataa

SEQ ID NO: 187854 - DNA, 10 bp, Unknown
  misc_feature (1)..( 10): Result.005 file - promoters50/4766738
aatactaaaa

SEQ ID NO: 187855 - DNA, 10 bp, Unknown
  misc_feature (1)..( 10): Result.005 file - promoters50/4766738
gatagtaaaa

SEQ ID NO: 187856 - DNA, 10 bp, Unknown
  misc_feature (1)..( 10): Result.005 file - promoters50/4766738
aatattaaga

SEQ ID NO: 187857 - DNA, 9 bp, Unknown
  misc_feature (1)..( 9): Result.005 file - promoters50/4766746
aaatataaa

SEQ ID NO: 187858 - DNA, 9 bp, Unknown
  misc_feature (1)..( 9): Result.005 file - promoters50/4766746
gtatataaa

SEQ ID NO: 187859 - DNA, 9 bp, Unknown
  misc_feature (1)..( 9): Result.005 file - promoters50/4766746
gtatatatt

SEQ ID NO: 187860 - DNA, 8 bp, Unknown
  misc_feature (1)..( 8): Result.005 file - promoters50/4766746
aaattgac

SEQ ID NO: 187861 - DNA, 8 bp, Unknown
  misc_feature (1)..( 8): Result.005 file - promoters50/4766746
aaattggg

SEQ ID NO: 187862 - DNA, 8 bp, Unknown
  misc_feature (1)..( 8): Result.005 file - promoters50/4766746
taatcggg

SEQ ID NO: 187863 - DNA, 8 bp, Unknown
  misc_feature (1)..( 8): Result.005 file - promoters50/4766750
atttctaa

SEQ ID NO: 187864 - DNA, 8 bp, Unknown
  misc_feature (1)..( 8): Result.005 file - promoters50/4766750
tcttctaa

SEQ ID NO: 187865 - DNA, 8 bp, Unknown
  misc_feature (1)..( 8): Result.005 file - promoters50/4766750
atttttaa

SEQ ID NO: 187866 - DNA, 8 bp, Unknown
  misc_feature (1)..( 8): Result.005 file - promoters50/4766754
agtataaa

SEQ ID NO: 187867 - DNA, 8 bp, Unknown
  misc_feature (1)..( 8): Result.005 file - promoters50/4766754
agtatata

SEQ ID NO: 187868 - DNA, 8 bp, Unknown
  misc_feature (1)..( 8): Result.005 file - promoters50/4766754
tgtatata

SEQ ID NO: 187869 - DNA, 8 bp, Unknown
  misc_feature (1)..( 8): Result.005 file - promoters50/4766776
tatgtatc

SEQ ID NO: 187870 - DNA, 8 bp, Unknown
  misc_feature (1)..( 8): Result.005 file - promoters50/4766776
tatttatt

SEQ ID NO: 187871 - DNA, 8 bp, Unknown
  misc_feature (1)..( 8): Result.005 file - promoters50/4766776
tatatatc

SEQ ID NO: 187872 - DNA, 8 bp, Unknown
  misc_feature (1)..( 8): Result.005 file - promoters50/4766776
aaaaatat

SEQ ID NO: 187873 - DNA, 8 bp, Unknown
  misc_feature (1)..( 8): Result.005 file - promoters50/4766776
aaaaatat

SEQ ID NO: 187874 - DNA, 8 bp, Unknown
  misc_feature (1)..( 8): Result.005 file - promoters50/4766776
ataaatat

SEQ ID NO: 187875 - DNA, 12 bp, Unknown
  misc_feature (1)..( 12): Result.005 file - promoters50/4766776
atcttaaaatat

SEQ ID NO: 187876 - DNA, 12 bp, Unknown
  misc_feature (1)..( 12): Result.005 file - promoters50/4766776
gtactaaaatat

SEQ ID NO: 187877 - DNA, 12 bp, Unknown
  misc_feature (1)..( 12): Result.005 file - promoters50/4766776
atcttaagatat

SEQ ID NO: 187878 - DNA, 8 bp, Unknown
  misc_feature (1)..( 8): Result.005 file - promoters50/4766776
aaattaat

SEQ ID NO: 187879 - DNA, 8 bp, Unknown
  misc_feature (1)..( 8): Result.005 file - promoters50/4766776
aaatcaat

SEQ ID NO: 187880 - DNA, 8 bp, Unknown
  misc_feature (1)..( 8): Result.005 file - promoters50/4766776
aaaacaac

SEQ ID NO: 187881 - DNA, 11 bp, Unknown
  misc_feature (1)..( 11): Result.005 file - promoters50/4766784
acaagtttttt

SEQ ID NO: 187882 - DNA, 11 bp, Unknown
  misc_feature (1)..( 11): Result.005 file - promoters50/4766784
aattgttgttt

SEQ ID NO: 187883 - DNA, 11 bp, Unknown
  misc_feature (1)..( 11): Result.005 file - promoters50/4766784
acaagatttga

SEQ ID NO: 187884 - DNA, 11 bp, Unknown
  misc_feature (1)..( 11): Result.005 file - promoters50/4766788
attggataatt

SEQ ID NO: 187885 - DNA, 11 bp, Unknown
  misc_feature (1)..( 11): Result.005 file - promoters50/4766788
aactgatgatt

SEQ ID NO: 187886 - DNA, 11 bp, Unknown
  misc_feature (1)..( 11): Result.005 file - promoters50/4766788
attgaataatg

SEQ ID NO: 187887 - DNA, 6 bp, Unknown
  misc_feature (1)..( 6): Result.005 file - promoters50/4766788
atttca

SEQ ID NO: 187888 - DNA, 6 bp, Unknown
  misc_feature (1)..( 6): Result.005 file - promoters50/4766788
atttca

SEQ ID NO: 187889 - DNA, 6 bp, Unknown
  misc_feature (1)..( 6): Result.005 file - promoters50/4766788
atttca

SEQ ID NO: 187890 - DNA, 7 bp, Unknown
  misc_feature (1)..( 7): Result.005 file - promoters50/4766792
cttcatt

SEQ ID NO: 187891 - DNA, 7 bp, Unknown
  misc_feature (1)..( 7): Result.005 file - promoters50/4766792
ctttatt

SEQ ID NO: 187892 - DNA, 7 bp, Unknown
  misc_feature (1)..( 7): Result.005 file - promoters50/4766792
atttatt

SEQ ID NO: 187893 - DNA, 9 bp, Unknown
  misc_feature (1)..( 9): Result.005 file - promoters50/4766792
aaaaaaaca

SEQ ID NO: 187894 - DNA, 9 bp, Unknown
  misc_feature (1)..( 9): Result.005 file - promoters50/4766792
aaataaaca

SEQ ID NO: 187895 - DNA, 9 bp, Unknown
  misc_feature (1)..( 9): Result.005 file - promoters50/4766792
aaataacta

SEQ ID NO: 187896 - DNA, 7 bp, Unknown
  misc_feature (1)..( 7): Result.005 file - promoters50/4766792
attattt

SEQ ID NO: 187897 - DNA, 7 bp, Unknown
  misc_feature (1)..( 7): Result.005 file - promoters50/4766792
tttattt

SEQ ID NO: 187898 - DNA, 7 bp, Unknown
  misc_feature (1)..( 7): Result.005 file - promoters50/4766792
tttatta

SEQ ID NO: 187899 - DNA, 7 bp, Unknown
  misc_feature (1)..( 7): Result.005 file - promoters50/4766812
aattttt

SEQ ID NO: 187900 - DNA, 7 bp, Unknown
  misc_feature (1)..( 7): Result.005 file - promoters50/4766812
tattttt

SEQ ID NO: 187901 - DNA, 7 bp, Unknown
  misc_feature (1)..( 7): Result.005 file - promoters50/4766812
aattttg

SEQ ID NO: 187902 - DNA, 9 bp, Unknown
  misc_feature (1)..( 9): Result.005 file - promoters50/4766812
aatataaat

SEQ ID NO: 187903 - DNA, 9 bp, Unknown
  misc_feature (1)..( 9): Result.005 file - promoters50/4766812
gataaaaaa

SEQ ID NO: 187904 - DNA, 9 bp, Unknown
  misc_feature (1)..( 9): Result.005 file - promoters50/4766812
aatagaaat

SEQ ID NO: 187905 - DNA, 9 bp, Unknown
  misc_feature (1)..( 9): Result.005 file - promoters50/4766812
agtaattat

SEQ ID NO: 187906 - DNA, 9 bp, Unknown
  misc_feature (1)..( 9): Result.005 file - promoters50/4766812
ggtatttat

SEQ ID NO: 187907 - DNA, 9 bp, Unknown
  misc_feature (1)..( 9): Result.005 file - promoters50/4766812
agttattaa

SEQ ID NO: 187908 - DNA, 7 bp, Unknown
  misc_feature (1)..( 7): Result.005 file - promoters50/4766812
aatcaag

SEQ ID NO: 187909 - DNA, 7 bp, Unknown
  misc_feature (1)..( 7): Result.005 file - promoters50/4766812
aatcaat

SEQ ID NO: 187910 - DNA, 7 bp, Unknown
  misc_feature (1)..( 7): Result.005 file - promoters50/4766812
aataaag

SEQ ID NO: 187911 - DNA, 8 bp, Unknown
  misc_feature (1)..( 8): Result.005 file - promoters50/4766812
agaaaacc

SEQ ID NO: 187912 - DNA, 8 bp, Unknown
  misc_feature (1)..( 8): Result.005 file - promoters50/4766812
tgaagacc

SEQ ID NO: 187913 - DNA, 8 bp, Unknown
  misc_feature (1)..( 8): Result.005 file - promoters50/4766812
agaaaatt

SEQ ID NO: 187914 - DNA, 9 bp, Unknown
  misc_feature (1)..( 9): Result.005 file - promoters50/4766816
taaatttgg

SEQ ID NO: 187915 - DNA, 9 bp, Unknown
  misc_feature (1)..( 9): Result.005 file - promoters50/4766816
caaatatgg

SEQ ID NO: 187916 - DNA, 9 bp, Unknown
  misc_feature (1)..( 9): Result.005 file - promoters50/4766816
caaatatgc

SEQ ID NO: 187917 - DNA, 8 bp, Unknown
  misc_feature (1)..( 8): Result.005 file - promoters50/4766823
atgttcct

SEQ ID NO: 187918 - DNA, 8 bp, Unknown
  misc_feature (1)..( 8): Result.005 file - promoters50/4766823
ttgttcca

SEQ ID NO: 187919 - DNA, 8 bp, Unknown
  misc_feature (1)..( 8): Result.005 file - promoters50/4766823
ttgtgcca

SEQ ID NO: 187920 - DNA, 9 bp, Unknown
  misc_feature (1)..( 9): Result.005 file - promoters50/4766835
agataaaat

SEQ ID NO: 187921 - DNA, 9 bp, Unknown
  misc_feature (1)..( 9): Result.005 file - promoters50/4766835
agaaaaaac

SEQ ID NO: 187922 - DNA, 9 bp, Unknown
  misc_feature (1)..( 9): Result.005 file - promoters50/4766835
ccttaaaat

SEQ ID NO: 187923 - DNA, 8 bp, Unknown
  misc_feature (1)..( 8): Result.005 file - promoters50/4766835
ctaaattt

SEQ ID NO: 187924 - DNA, 8 bp, Unknown
  misc_feature (1)..( 8): Result.005 file - promoters50/4766835
ttaatttt

SEQ ID NO: 187925 - DNA, 8 bp, Unknown
  misc_feature (1)..( 8): Result.005 file - promoters50/4766835
ttaattca

SEQ ID NO: 187926 - DNA, 9 bp, Unknown
  misc_feature (1)..( 9): Result.005 file - promoters50/4766835
tgctaaaaa

SEQ ID NO: 187927 - DNA, 9 bp, Unknown
  misc_feature (1)..( 9): Result.005 file - promoters50/4766835
tcataaaaa

SEQ ID NO: 187928 - DNA, 9 bp, Unknown
  misc_feature (1)..( 9): Result.005 file - promoters50/4766835
cattaaatg

SEQ ID NO: 187929 - DNA, 8 bp, Unknown
  misc_feature (1)..( 8): Result.005 file - promoters50/4766835
aagttcaa

SEQ ID NO: 187930 - DNA, 8 bp, Unknown
  misc_feature (1)..( 8): Result.005 file - promoters50/4766835
aaggtcag

SEQ ID NO: 187931 - DNA, 8 bp, Unknown
  misc_feature (1)..( 8): Result.005 file - promoters50/4766835
cggttcaa

SEQ ID NO: 187932 - DNA, 7 bp, Unknown
  misc_feature (1)..( 7): Result.005 file - promoters50/4766835
atcaaaa

SEQ ID NO: 187933 - DNA, 7 bp, Unknown
  misc_feature (1)..( 7): Result.005 file - promoters50/4766835
atccaaa

SEQ ID NO: 187934 - DNA, 7 bp, Unknown
  misc_feature (1)..( 7): Result.005 file - promoters50/4766835
atctaaa

SEQ ID NO: 187935 - DNA, 8 bp, Unknown
  misc_feature (1)..( 8): Result.005 file - promoters50/4766835
aaacaact

SEQ ID NO: 187936 - DNA, 8 bp, Unknown
  misc_feature (1)..( 8): Result.005 file - promoters50/4766835
aaacaaaa

SEQ ID NO: 187937 - DNA, 8 bp, Unknown
  misc_feature (1)..( 8): Result.005 file - promoters50/4766835
aaagaaaa

SEQ ID NO: 187938 - DNA, 10 bp, Unknown
  misc_feature (1)..( 10): Result.005 file - promoters50/4766835
aaaaaatgtt

SEQ ID NO: 187939 - DNA, 10 bp, Unknown
  misc_feature (1)..( 10): Result.005 file - promoters50/4766835
aaataattga

SEQ ID NO: 187940 - DNA, 10 bp, Unknown
  misc_feature (1)..( 10): Result.005 file - promoters50/4766835
aaataaatga

SEQ ID NO: 187941 - DNA, 8 bp, Unknown
  misc_feature (1)..( 8): Result.005 file - promoters50/4766835
acacattt

SEQ ID NO: 187942 - DNA, 8 bp, Unknown
  misc_feature (1)..( 8): Result.005 file - promoters50/4766835
acacataa

SEQ ID NO: 187943 - DNA, 8 bp, Unknown
  misc_feature (1)..( 8): Result.005 file - promoters50/4766835
acaaataa

SEQ ID NO: 187944 - DNA, 7 bp, Unknown
  misc_feature (1)..( 7): Result.005 file - promoters50/4766835
ttttcat

SEQ ID NO: 187945 - DNA, 7 bp, Unknown
  misc_feature (1)..( 7): Result.005 file - promoters50/4766835
ttttcag

SEQ ID NO: 187946 - DNA, 7 bp, Unknown
  misc_feature (1)..( 7): Result.005 file - promoters50/4766835
ttttcag

SEQ ID NO: 187947 - DNA, 8 bp, Unknown
  misc_feature (1)..( 8): Result.005 file - promoters50/4766858
aagaactt

SEQ ID NO: 187948 - DNA, 8 bp, Unknown
  misc_feature (1)..( 8): Result.005 file - promoters50/4766858
cagatctt

SEQ ID NO: 187949 - DNA, 8 bp, Unknown
  misc_feature (1)..( 8): Result.005 file - promoters50/4766858
atcatctt

SEQ ID NO: 187950 - DNA, 10 bp, Unknown
  misc_feature (1)..( 10): Result.005 file - promoters50/4766862
gtgagaaatt

SEQ ID NO: 187951 - DNA, 10 bp, Unknown
  misc_feature (1)..( 10): Result.005 file - promoters50/4766862
gattgaaatt

SEQ ID NO: 187952 - DNA, 10 bp, Unknown
  misc_feature (1)..( 10): Result.005 file - promoters50/4766862
gagtgaaatt

SEQ ID NO: 187953 - DNA, 10 bp, Unknown
  misc_feature (1)..( 10): Result.005 file - promoters50/4766862
tttcgaaatt

SEQ ID NO: 187954 - DNA, 10 bp, Unknown
  misc_feature (1)..( 10): Result.005 file - promoters50/4766862
ctgaaaaatt

SEQ ID NO: 187955 - DNA, 10 bp, Unknown
  misc_feature (1)..( 10): Result.005 file - promoters50/4766862
acgtggaata

SEQ ID NO: 187956 - DNA, 10 bp, Unknown
  misc_feature (1)..( 10): Result.005 file - promoters50/4766862
atctcaaaat

SEQ ID NO: 187957 - DNA, 13 bp, Unknown
  misc_feature (1)..( 13): Result.005 file - promoters50/4766862
ttgttaaagagct

SEQ ID NO: 187958 - DNA, 13 bp, Unknown
  misc_feature (1)..( 13): Result.005 file - promoters50/4766862
agcttagagacaa

SEQ ID NO: 187959 - DNA, 13 bp, Unknown
  misc_feature (1)..( 13): Result.005 file - promoters50/4766862
ttgttgaagaagt

SEQ ID NO: 187960 - DNA, 13 bp, Unknown
  misc_feature (1)..( 13): Result.005 file - promoters50/4766862
ggattgatgacgt

SEQ ID NO: 187961 - DNA, 13 bp, Unknown
  misc_feature (1)..( 13): Result.005 file - promoters50/4766862
atgcagaagaaga

SEQ ID NO: 187962 - DNA, 13 bp, Unknown
  misc_feature (1)..( 13): Result.005 file - promoters50/4766862
tttgggaaaaagt

SEQ ID NO: 187963 - DNA, 13 bp, Unknown
  misc_feature (1)..( 13): Result.005 file - promoters50/4766866
aaaagaaattaac

SEQ ID NO: 187964 - DNA, 13 bp, Unknown
  misc_feature (1)..( 13): Result.005 file - promoters50/4766866
aaaagaaaataaa

SEQ ID NO: 187965 - DNA, 13 bp, Unknown
  misc_feature (1)..( 13): Result.005 file - promoters50/4766866
aaatgaaatatct

SEQ ID NO: 187966 - DNA, 13 bp, Unknown
  misc_feature (1)..( 13): Result.005 file - promoters50/4766866
gttggaatttaga

SEQ ID NO: 187967 - DNA, 13 bp, Unknown
  misc_feature (1)..( 13): Result.005 file - promoters50/4766866
caagacatttaga

SEQ ID NO: 187968 - DNA, 12 bp, Unknown
  misc_feature (1)..( 12): Result.005 file - promoters50/4766866
ttgagacaaaaa

SEQ ID NO: 187969 - DNA, 12 bp, Unknown
  misc_feature (1)..( 12): Result.005 file - promoters50/4766866
ttgaaacaaaaa

SEQ ID NO: 187970 - DNA, 12 bp, Unknown
  misc_feature (1)..( 12): Result.005 file - promoters50/4766866
ataagacaacac

SEQ ID NO: 187971 - DNA, 12 bp, Unknown
  misc_feature (1)..( 12): Result.005 file - promoters50/4766866
gagaaagaaagc

SEQ ID NO: 187972 - DNA, 12 bp, Unknown
  misc_feature (1)..( 12): Result.005 file - promoters50/4766866
taaagacacacc

SEQ ID NO: 187973 - DNA, 9 bp, Unknown
  misc_feature (1)..( 9): Result.005 file - promoters50/4766866
aaaaataat

SEQ ID NO: 187974 - DNA, 9 bp, Unknown
  misc_feature (1)..( 9): Result.005 file - promoters50/4766866
taaattaaa

SEQ ID NO: 187975 - DNA, 9 bp, Unknown
  misc_feature (1)..( 9): Result.005 file - promoters50/4766866
gaaaatagt

SEQ ID NO: 187976 - DNA, 9 bp, Unknown
  misc_feature (1)..( 9): Result.005 file - promoters50/4766866
gaaaatgct

SEQ ID NO: 187977 - DNA, 9 bp, Unknown
  misc_feature (1)..( 9): Result.005 file - promoters50/4766866
taaattggg

SEQ ID NO: 187978 - DNA, 9 bp, Unknown
  misc_feature (1)..( 9): Result.005 file - promoters50/4766866
attattaaa

SEQ ID NO: 187979 - DNA, 7 bp, Unknown
  misc_feature (1)..( 7): Result.005 file - promoters50/4766870
gattttt

SEQ ID NO: 187980 - DNA, 7 bp, Unknown
  misc_feature (1)..( 7): Result.005 file - promoters50/4766870
gattttg

SEQ ID NO: 187981 - DNA, 7 bp, Unknown
  misc_feature (1)..( 7): Result.005 file - promoters50/4766870
gatgttg

SEQ ID NO: 187982 - DNA, 7 bp, Unknown
  misc_feature (1)..( 7): Result.005 file - promoters50/4766870
tctaaaa

SEQ ID NO: 187983 - DNA, 7 bp, Unknown
  misc_feature (1)..( 7): Result.005 file - promoters50/4766870
tcttaaa

SEQ ID NO: 187984 - DNA, 7 bp, Unknown
  misc_feature (1)..( 7): Result.005 file - promoters50/4766870
gcttaaa

SEQ ID NO: 187985 - DNA, 9 bp, Unknown
  misc_feature (1)..( 9): Result.005 file - promoters50/4766908
ttgctttaa

SEQ ID NO: 187986 - DNA, 9 bp, Unknown
  misc_feature (1)..( 9): Result.005 file - promoters50/4766908
atgctttgt

SEQ ID NO: 187987 - DNA, 9 bp, Unknown
  misc_feature (1)..( 9): Result.005 file - promoters50/4766908
ttgttttaa

SEQ ID NO: 187988 - DNA, 9 bp, Unknown
  misc_feature (1)..( 9): Result.005 file - promoters50/4766908
aaataaaaa

SEQ ID NO: 187989 - DNA, 9 bp, Unknown
  misc_feature (1)..( 9): Result.005 file - promoters50/4766908
aaagaaagc

SEQ ID NO: 187990 - DNA, 9 bp, Unknown
  misc_feature (1)..( 9): Result.005 file - promoters50/4766908
aaacaaaaa

SEQ ID NO: 187991 - DNA, 10 bp, Unknown
  misc_feature (1)..( 10): Result.005 file - promoters50/4766908
acccattaaa

SEQ ID NO: 187992 - DNA, 10 bp, Unknown
  misc_feature (1)..( 10): Result.005 file - promoters50/4766908
acccactaaa

SEQ ID NO: 187993 - DNA, 10 bp, Unknown
  misc_feature (1)..( 10): Result.005 file - promoters50/4766908
tcccactaga

SEQ ID NO: 187994 - DNA, 9 bp, Unknown
  misc_feature (1)..( 9): Result.005 file - promoters50/4766912
ggttaataa

SEQ ID NO: 187995 - DNA, 9 bp, Unknown
  misc_feature (1)..( 9): Result.005 file - promoters50/4766912
gcttattaa

SEQ ID NO: 187996 - DNA, 9 bp, Unknown
  misc_feature (1)..( 9): Result.005 file - promoters50/4766912
gctgattcc

SEQ ID NO: 187997 - DNA, 7 bp, Unknown
  misc_feature (1)..( 7): Result.005 file - promoters50/4766912
agtattc

SEQ ID NO: 187998 - DNA, 7 bp, Unknown
  misc_feature (1)..( 7): Result.005 file - promoters50/4766912
tgtattc

SEQ ID NO: 187999 - DNA, 7 bp, Unknown
  misc_feature (1)..( 7): Result.005 file - promoters50/4766912
agtattc

SEQ ID NO: 188000 - DNA, 9 bp, Unknown
  misc_feature (1)..( 9): Result.005 file - promoters50/4766912
gtttgtgtt

SEQ ID NO: 188001 - DNA, 9 bp, Unknown
  misc_feature (1)..( 9): Result.005 file - promoters50/4766912
gtttttgtt

SEQ ID NO: 188002 - DNA, 9 bp, Unknown
  misc_feature (1)..( 9): Result.005 file - promoters50/4766912
gtttgttaa

SEQ ID NO: 188003 - DNA, 7 bp, Unknown
  misc_feature (1)..( 7): Result.005 file - promoters50/4766912
tttgtga

SEQ ID NO: 188004 - DNA, 7 bp, Unknown
  misc_feature (1)..( 7): Result.005 file - promoters50/4766912
gttgtga

SEQ ID NO: 188005 - DNA, 7 bp, Unknown
  misc_feature (1)..( 7): Result.005 file - promoters50/4766912
gttctga

SEQ ID NO: 188006 - DNA, 7 bp, Unknown
  misc_feature (1)..( 7): Result.005 file - promoters50/4766912
tcttgtt

SEQ ID NO: 188007 - DNA, 7 bp, Unknown
  misc_feature (1)..( 7): Result.005 file - promoters50/4766912
tcttgtc

SEQ ID NO: 188008 - DNA, 7 bp, Unknown
  misc_feature (1)..( 7): Result.005 file - promoters50/4766912
acttgtc

SEQ ID NO: 188009 - DNA, 9 bp, Unknown
  misc_feature (1)..( 9): Result.005 file - promoters50/4766912
aagagatct

SEQ ID NO: 188010 - DNA, 9 bp, Unknown
  misc_feature (1)..( 9): Result.005 file - promoters50/4766912
cagagatcc

SEQ ID NO: 188011 - DNA, 9 bp, Unknown
  misc_feature (1)..( 9): Result.005 file - promoters50/4766912
cagaggtcc

SEQ ID NO: 188012 - DNA, 11 bp, Unknown
  misc_feature (1)..( 11): Result.005 file - promoters50/4766916
ttaccaaatat

SEQ ID NO: 188013 - DNA, 11 bp, Unknown
  misc_feature (1)..( 11): Result.005 file - promoters50/4766916
ttacaaaatta

SEQ ID NO: 188014 - DNA, 11 bp, Unknown
  misc_feature (1)..( 11): Result.005 file - promoters50/4766916
tttaaaaatta

SEQ ID NO: 188015 - DNA, 7 bp, Unknown
  misc_feature (1)..( 7): Result.005 file - promoters50/4766916
aatttta

SEQ ID NO: 188016 - DNA, 7 bp, Unknown
  misc_feature (1)..( 7): Result.005 file - promoters50/4766916
tatttta

SEQ ID NO: 188017 - DNA, 7 bp, Unknown
  misc_feature (1)..( 7): Result.005 file - promoters50/4766916
aattttt

SEQ ID NO: 188018 - DNA, 6 bp, Unknown
  misc_feature (1)..( 6): Result.005 file - promoters50/4766916
taaaaa

SEQ ID NO: 188019 - DNA, 6 bp, Unknown
  misc_feature (1)..( 6): Result.005 file - promoters50/4766916
taaaaa

SEQ ID NO: 188020 - DNA, 6 bp, Unknown
  misc_feature (1)..( 6): Result.005 file - promoters50/4766916
taaaaa

SEQ ID NO: 188021 - DNA, 9 bp, Unknown
  misc_feature (1)..( 9): Result.005 file - promoters50/4766916
aaaacatgt

SEQ ID NO: 188022 - DNA, 9 bp, Unknown
  misc_feature (1)..( 9): Result.005 file - promoters50/4766916
gaaaaatgt

SEQ ID NO: 188023 - DNA, 9 bp, Unknown
  misc_feature (1)..( 9): Result.005 file - promoters50/4766916
aaaacaaaa

SEQ ID NO: 188024 - DNA, 12 bp, Unknown
  misc_feature (1)..( 12): Result.005 file - promoters50/4766936
ttctttataagc

SEQ ID NO: 188025 - DNA, 12 bp, Unknown
  misc_feature (1)..( 12): Result.005 file - promoters50/4766936
atctttgtaaag

SEQ ID NO: 188026 - DNA, 12 bp, Unknown
  misc_feature (1)..( 12): Result.005 file - promoters50/4766936
atctatataaat

SEQ ID NO: 188027 - DNA, 12 bp, Unknown
  misc_feature (1)..( 12): Result.005 file - promoters50/4766936
tcaattaaaagt

SEQ ID NO: 188028 - DNA, 12 bp, Unknown
  misc_feature (1)..( 12): Result.005 file - promoters50/4766936
atcttttaaaaa

SEQ ID NO: 188029 - DNA, 12 bp, Unknown
  misc_feature (1)..( 12): Result.005 file - promoters50/4766936
ataagtataaat

SEQ ID NO: 188030 - DNA, 14 bp, Unknown
  misc_feature (1)..( 14): Result.005 file - promoters50/4766957
ctgtttttcattct

SEQ ID NO: 188031 - DNA, 14 bp, Unknown
  misc_feature (1)..( 14): Result.005 file - promoters50/4766957
acgtttgtcaatct

SEQ ID NO: 188032 - DNA, 14 bp, Unknown
  misc_feature (1)..( 14): Result.005 file - promoters50/4766957
tacttttttttttt

SEQ ID NO: 188033 - DNA, 12 bp, Unknown
  misc_feature (1)..( 12): Result.005 file - promoters50/4766957
agcgacaaaaaa

SEQ ID NO: 188034 - DNA, 12 bp, Unknown
  misc_feature (1)..( 12): Result.005 file - promoters50/4766957
ttaaataaaaaa

SEQ ID NO: 188035 - DNA, 12 bp, Unknown
  misc_feature (1)..( 12): Result.005 file - promoters50/4766957
ttaagtaaaaac

SEQ ID NO: 188036 - DNA, 13 bp, Unknown
  misc_feature (1)..( 13): Result.005 file - promoters50/4766957
gacaaaaaaaact

SEQ ID NO: 188037 - DNA, 13 bp, Unknown
  misc_feature (1)..( 13): Result.005 file - promoters50/4766957
ttaagtaaaaact

SEQ ID NO: 188038 - DNA, 13 bp, Unknown
  misc_feature (1)..( 13): Result.005 file - promoters50/4766957
ttaaataaaaaac

SEQ ID NO: 188039 - DNA, 12 bp, Unknown
  misc_feature (1)..( 12): Result.005 file - promoters50/4766977
aaaaataattga

SEQ ID NO: 188040 - DNA, 12 bp, Unknown
  misc_feature (1)..( 12): Result.005 file - promoters50/4766977
acaaagaatttc

SEQ ID NO: 188041 - DNA, 13 bp, Unknown
  misc_feature (1)..( 13): Result.005 file - promoters50/4766977
taaaattaagaat

SEQ ID NO: 188042 - DNA, 13 bp, Unknown
  misc_feature (1)..( 13): Result.005 file - promoters50/4766977
taaagttataaac

SEQ ID NO: 188043 - DNA, 13 bp, Unknown
  misc_feature (1)..( 13): Result.005 file - promoters50/4766977
tctcattaatgtt

SEQ ID NO: 188044 - DNA, 13 bp, Unknown
  misc_feature (1)..( 13): Result.005 file - promoters50/4766977
aatctttaaaatg

SEQ ID NO: 188045 - DNA, 13 bp, Unknown
  misc_feature (1)..( 13): Result.005 file - promoters50/4766977
atatataaatagt

SEQ ID NO: 188046 - DNA, 13 bp, Unknown
  misc_feature (1)..( 13): Result.005 file - promoters50/4766977
ctataaaaaaaaa

SEQ ID NO: 188047 - DNA, 13 bp, Unknown
  misc_feature (1)..( 13): Result.005 file - promoters50/4766977
ctataaatagaaa

SEQ ID NO: 188048 - DNA, 13 bp, Unknown
  misc_feature (1)..( 13): Result.005 file - promoters50/4766977
atataaataacac

SEQ ID NO: 188049 - DNA, 13 bp, Unknown
  misc_feature (1)..( 13): Result.005 file - promoters50/4766977
atataaatactct

SEQ ID NO: 188050 - DNA, 13 bp, Unknown
  misc_feature (1)..( 13): Result.005 file - promoters50/4766977
aaatatatgtggc

SEQ ID NO: 188051 - DNA, 13 bp, Unknown
  misc_feature (1)..( 13): Result.005 file - promoters50/4766977
atataaataaata

SEQ ID NO: 188052 - DNA, 16 bp, Unknown
  misc_feature (1)..( 16): Result.005 file - promoters50/4766977
taccagtatacggatc

SEQ ID NO: 188053 - DNA, 16 bp, Unknown
  misc_feature (1)..( 16): Result.005 file - promoters50/4766977
taatagtataaaatac

SEQ ID NO: 188054 - DNA, 16 bp, Unknown
  misc_feature (1)..( 16): Result.005 file - promoters50/4766977
aaagagtttaattctc

SEQ ID NO: 188055 - DNA, 16 bp, Unknown
  misc_feature (1)..( 16): Result.005 file - promoters50/4766977
cataagtagaaaactt

SEQ ID NO: 188056 - DNA, 16 bp, Unknown
  misc_feature (1)..( 16): Result.005 file - promoters50/4766977
aagacgcagaaaaaat

SEQ ID NO: 188057 - DNA, 16 bp, Unknown
  misc_feature (1)..( 16): Result.005 file - promoters50/4766977
tttcattttcaatttt

SEQ ID NO: 188058 - DNA, 16 bp, Unknown
  misc_feature (1)..( 16): Result.005 file - promoters50/4766977
ctgaaatttcaaattt

SEQ ID NO: 188059 - DNA, 13 bp, Unknown
  misc_feature (1)..( 13): Result.005 file - promoters50/4766977
tacattttgtaac

SEQ ID NO: 188060 - DNA, 13 bp, Unknown
  misc_feature (1)..( 13): Result.005 file - promoters50/4766977
aaaatttcgtaat

SEQ ID NO: 188061 - DNA, 13 bp, Unknown
  misc_feature (1)..( 13): Result.005 file - promoters50/4766977
acaatttacgtat

SEQ ID NO: 188062 - DNA, 13 bp, Unknown
  misc_feature (1)..( 13): Result.005 file - promoters50/4766977
tttctttttaatg

SEQ ID NO: 188063 - DNA, 13 bp, Unknown
  misc_feature (1)..( 13): Result.005 file - promoters50/4766977
aaatatttgtaat

SEQ ID NO: 188064 - DNA, 13 bp, Unknown
  misc_feature (1)..( 13): Result.005 file - promoters50/4766977
taaacttttaaat

SEQ ID NO: 188065 - DNA, 10 bp, Unknown
  misc_feature (1)..( 10): Result.005 file - promoters50/4766977
ttgctatact

SEQ ID NO: 188066 - DNA, 10 bp, Unknown
  misc_feature (1)..( 10): Result.005 file - promoters50/4766977
gacctaaact

SEQ ID NO: 188067 - DNA, 10 bp, Unknown
  misc_feature (1)..( 10): Result.005 file - promoters50/4766977
aaactaaaaa

SEQ ID NO: 188068 - DNA, 10 bp, Unknown
  misc_feature (1)..( 10): Result.005 file - promoters50/4766977
gaaccaaaat

SEQ ID NO: 188069 - DNA, 10 bp, Unknown
  misc_feature (1)..( 10): Result.005 file - promoters50/4766977
aaaataaaaa

SEQ ID NO: 188070 - DNA, 10 bp, Unknown
  misc_feature (1)..( 10): Result.005 file - promoters50/4766977
acattaaact

SEQ ID NO: 188071 - DNA, 14 bp, Unknown
  misc_feature (1)..( 14): Result.005 file - promoters50/4766977
ggacaataatagta

SEQ ID NO: 188072 - DNA, 14 bp, Unknown
  misc_feature (1)..( 14): Result.005 file - promoters50/4766977
gaacattaatatga

SEQ ID NO: 188073 - DNA, 14 bp, Unknown
  misc_feature (1)..( 14): Result.005 file - promoters50/4766977
actttttaatattt

SEQ ID NO: 188074 - DNA, 14 bp, Unknown
  misc_feature (1)..( 14): Result.005 file - promoters50/4766977
acttgttattattt

SEQ ID NO: 188075 - DNA, 14 bp, Unknown
  misc_feature (1)..( 14): Result.005 file - promoters50/4766977
ttaggttattttgg

SEQ ID NO: 188076 - DNA, 14 bp, Unknown
  misc_feature (1)..( 14): Result.005 file - promoters50/4766977
gtaagatatttttt

SEQ ID NO: 188077 - DNA, 11 bp, Unknown
  misc_feature (1)..( 11): Result.005 file - promoters50/4766977
taaaatacttt

SEQ ID NO: 188078 - DNA, 11 bp, Unknown
  misc_feature (1)..( 11): Result.005 file - promoters50/4766977
aaaaatatatt

SEQ ID NO: 188079 - DNA, 11 bp, Unknown
  misc_feature (1)..( 11): Result.005 file - promoters50/4766977
ttaaatacttt

SEQ ID NO: 188080 - DNA, 11 bp, Unknown
  misc_feature (1)..( 11): Result.005 file - promoters50/4766977
taagatatttt

SEQ ID NO: 188081 - DNA, 11 bp, Unknown
  misc_feature (1)..( 11): Result.005 file - promoters50/4766977
agaaatatatg

SEQ ID NO: 188082 - DNA, 11 bp, Unknown
  misc_feature (1)..( 11): Result.005 file - promoters50/4766977
aatcatatatg

SEQ ID NO: 188083 - DNA, 11 bp, Unknown
  misc_feature (1)..( 11): Result.005 file - promoters50/4766977
cacaataattt

SEQ ID NO: 188084 - DNA, 12 bp, Unknown
  misc_feature (1)..( 12): Result.005 file - promoters50/4766977
ttctttttcgag

SEQ ID NO: 188085 - DNA, 12 bp, Unknown
  misc_feature (1)..( 12): Result.005 file - promoters50/4766977
tactttatcgtc

SEQ ID NO: 188086 - DNA, 12 bp, Unknown
  misc_feature (1)..( 12): Result.005 file - promoters50/4766977
gtattttttttt

SEQ ID NO: 188087 - DNA, 12 bp, Unknown
  misc_feature (1)..( 12): Result.005 file - promoters50/4766977
acgtttataaga

SEQ ID NO: 188088 - DNA, 12 bp, Unknown
  misc_feature (1)..( 12): Result.005 file - promoters50/4766977
ttcattttcaat

SEQ ID NO: 188089 - DNA, 12 bp, Unknown
  misc_feature (1)..( 12): Result.005 file - promoters50/4766977
aaactttgcaat

SEQ ID NO: 188090 - DNA, 14 bp, Unknown
  misc_feature (1)..( 14): Result.005 file - promoters50/4766977
tccaatcaatcttt

SEQ ID NO: 188091 - DNA, 14 bp, Unknown
  misc_feature (1)..( 14): Result.005 file - promoters50/4766977
actttttaatattt

SEQ ID NO: 188092 - DNA, 14 bp, Unknown
  misc_feature (1)..( 14): Result.005 file - promoters50/4766977
gaacattaatatga

SEQ ID NO: 188093 - DNA, 14 bp, Unknown
  misc_feature (1)..( 14): Result.005 file - promoters50/4766977
acttgttattattt

SEQ ID NO: 188094 - DNA, 14 bp, Unknown
  misc_feature (1)..( 14): Result.005 file - promoters50/4766977
caagtaagatattt

SEQ ID NO: 188095 - DNA, 14 bp, Unknown
  misc_feature (1)..( 14): Result.005 file - promoters50/4766977
aatttaggttattt

SEQ ID NO: 188096 - DNA, 13 bp, Unknown
  misc_feature (1)..( 13): Result.005 file - promoters50/4766977
taaaatactttat

SEQ ID NO: 188097 - DNA, 13 bp, Unknown
  misc_feature (1)..( 13): Result.005 file - promoters50/4766977
cacaataatttag

SEQ ID NO: 188098 - DNA, 13 bp, Unknown
  misc_feature (1)..( 13): Result.005 file - promoters50/4766977
acgaatactatat

SEQ ID NO: 188099 - DNA, 13 bp, Unknown
  misc_feature (1)..( 13): Result.005 file - promoters50/4766977
taagatatttttt

SEQ ID NO: 188100 - DNA, 13 bp, Unknown
  misc_feature (1)..( 13): Result.005 file - promoters50/4766977
aaatatatttatt

SEQ ID NO: 188101 - DNA, 13 bp, Unknown
  misc_feature (1)..( 13): Result.005 file - promoters50/4766977
ttggatgttttcc

SEQ ID NO: 188102 - DNA, 13 bp, Unknown
  misc_feature (1)..( 13): Result.005 file - promoters50/4766977
ttaaatacttttt

SEQ ID NO: 188103 - DNA, 16 bp, Unknown
  misc_feature (1)..( 16): Result.005 file - promoters50/4766977
ctaaaaatatatttat

SEQ ID NO: 188104 - DNA, 16 bp, Unknown
  misc_feature (1)..( 16): Result.005 file - promoters50/4766977
acttgttattatttac

SEQ ID NO: 188105 - DNA, 16 bp, Unknown
  misc_feature (1)..( 16): Result.005 file - promoters50/4766977
caagtaagatattttt

SEQ ID NO: 188106 - DNA, 16 bp, Unknown
  misc_feature (1)..( 16): Result.005 file - promoters50/4766977
gaatttggatgttttc

SEQ ID NO: 188107 - DNA, 16 bp, Unknown
  misc_feature (1)..( 16): Result.005 file - promoters50/4766977
actttttaatatttca

SEQ ID NO: 188108 - DNA, 16 bp, Unknown
  misc_feature (1)..( 16): Result.005 file - promoters50/4766977
aatttaggttattttg

SEQ ID NO: 188109 - DNA, 10 bp, Unknown
  misc_feature (1)..( 10): Result.005 file - promoters50/4766980
catatactgt

SEQ ID NO: 188110 - DNA, 10 bp, Unknown
  misc_feature (1)..( 10): Result.005 file - promoters50/4766980
aatagactgt

SEQ ID NO: 188111 - DNA, 10 bp, Unknown
  misc_feature (1)..( 10): Result.005 file - promoters50/4766980
aatagatctt

SEQ ID NO: 188112 - DNA, 8 bp, Unknown
  misc_feature (1)..( 8): Result.005 file - promoters50/4766980
ggaagaaa

SEQ ID NO: 188113 - DNA, 8 bp, Unknown
  misc_feature (1)..( 8): Result.005 file - promoters50/4766980
aaaagaaa

SEQ ID NO: 188114 - DNA, 8 bp, Unknown
  misc_feature (1)..( 8): Result.005 file - promoters50/4766980
ggaagaaa

SEQ ID NO: 188115 - DNA, 8 bp, Unknown
  misc_feature (1)..( 8): Result.005 file - promoters50/4766983
tcttttat

SEQ ID NO: 188116 - DNA, 8 bp, Unknown
  misc_feature (1)..( 8): Result.005 file - promoters50/4766983
gcttctat

SEQ ID NO: 188117 - DNA, 8 bp, Unknown
  misc_feature (1)..( 8): Result.005 file - promoters50/4766983
aattctat

SEQ ID NO: 188118 - DNA, 8 bp, Unknown
  misc_feature (1)..( 8): Result.005 file - promoters50/4766983
aatactag

SEQ ID NO: 188119 - DNA, 11 bp, Unknown
  misc_feature (1)..( 11): Result.005 file - promoters50/4766983
attagactctt

SEQ ID NO: 188120 - DNA, 11 bp, Unknown
  misc_feature (1)..( 11): Result.005 file - promoters50/4766983
attaaactcat

SEQ ID NO: 188121 - DNA, 11 bp, Unknown
  misc_feature (1)..( 11): Result.005 file - promoters50/4766983
gtgatactaat

SEQ ID NO: 188122 - DNA, 11 bp, Unknown
  misc_feature (1)..( 11): Result.005 file - promoters50/4766983
tagttacaaat

SEQ ID NO: 188123 - DNA, 12 bp, Unknown
  misc_feature (1)..( 12): Result.005 file - promoters50/4766983
aaattgattaaa

SEQ ID NO: 188124 - DNA, 12 bp, Unknown
  misc_feature (1)..( 12): Result.005 file - promoters50/4766983
aaattgaataaa

SEQ ID NO: 188125 - DNA, 12 bp, Unknown
  misc_feature (1)..( 12): Result.005 file - promoters50/4766983
catttggttaca

SEQ ID NO: 188126 - DNA, 7 bp, Unknown
  misc_feature (1)..( 7): Result.005 file - promoters50/4766983
aaaaata

SEQ ID NO: 188127 - DNA, 7 bp, Unknown
  misc_feature (1)..( 7): Result.005 file - promoters50/4766983
aaaaatc

SEQ ID NO: 188128 - DNA, 7 bp, Unknown
  misc_feature (1)..( 7): Result.005 file - promoters50/4766983
aaatata

SEQ ID NO: 188129 - DNA, 16 bp, Unknown
  misc_feature (1)..( 16): Result.005 file - promoters50/4766983
taaacattagggttct

SEQ ID NO: 188130 - DNA, 16 bp, Unknown
  misc_feature (1)..( 16): Result.005 file - promoters50/4766983
gatcaatttgggatct

SEQ ID NO: 188131 - DNA, 16 bp, Unknown
  misc_feature (1)..( 16): Result.005 file - promoters50/4766983
atcaaattgacatatt

SEQ ID NO: 188132 - DNA, 16 bp, Unknown
  misc_feature (1)..( 16): Result.005 file - promoters50/4766983
agaaaattgacttcaa

SEQ ID NO: 188133 - DNA, 7 bp, Unknown
  misc_feature (1)..( 7): Result.005 file - promoters50/4766983
aaaaata

SEQ ID NO: 188134 - DNA, 7 bp, Unknown
  misc_feature (1)..( 7): Result.005 file - promoters50/4766983
aaatata

SEQ ID NO: 188135 - DNA, 7 bp, Unknown
  misc_feature (1)..( 7): Result.005 file - promoters50/4766983
gaatata

SEQ ID NO: 188136 - DNA, 7 bp, Unknown
  misc_feature (1)..( 7): Result.005 file - promoters50/4766983
taaaaaa

SEQ ID NO: 188137 - DNA, 7 bp, Unknown
  misc_feature (1)..( 7): Result.005 file - promoters50/4766983
taaaaat

SEQ ID NO: 188138 - DNA, 7 bp, Unknown
  misc_feature (1)..( 7): Result.005 file - promoters50/4766983
caaaaaa

SEQ ID NO: 188139 - DNA, 8 bp, Unknown
  misc_feature (1)..( 8): Result.005 file - promoters50/4766983
ttgttttt

SEQ ID NO: 188140 - DNA, 8 bp, Unknown
  misc_feature (1)..( 8): Result.005 file - promoters50/4766983
ttgttttt

SEQ ID NO: 188141 - DNA, 8 bp, Unknown
  misc_feature (1)..( 8): Result.005 file - promoters50/4766983
atgtttta

SEQ ID NO: 188142 - DNA, 8 bp, Unknown
  misc_feature (1)..( 8): Result.005 file - promoters50/4766983
aatctaag

SEQ ID NO: 188143 - DNA, 8 bp, Unknown
  misc_feature (1)..( 8): Result.005 file - promoters50/4766983
aatcaaag

SEQ ID NO: 188144 - DNA, 8 bp, Unknown
  misc_feature (1)..( 8): Result.005 file - promoters50/4766983
aatcaaaa

SEQ ID NO: 188145 - DNA, 13 bp, Unknown
  misc_feature (1)..( 13): Result.005 file - promoters50/4766983
aacttgaattcaa

SEQ ID NO: 188146 - DNA, 13 bp, Unknown
  misc_feature (1)..( 13): Result.005 file - promoters50/4766983
aaattgacttcaa

SEQ ID NO: 188147 - DNA, 13 bp, Unknown
  misc_feature (1)..( 13): Result.005 file - promoters50/4766983
aaattgacatatt

SEQ ID NO: 188148 - DNA, 11 bp, Unknown
  misc_feature (1)..( 11): Result.005 file - promoters50/4766991
ataaaagaaaa

SEQ ID NO: 188149 - DNA, 11 bp, Unknown
  misc_feature (1)..( 11): Result.005 file - promoters50/4766991
gtaaaagaaaa

SEQ ID NO: 188150 - DNA, 11 bp, Unknown
  misc_feature (1)..( 11): Result.005 file - promoters50/4766991
ataaaaaaact

SEQ ID NO: 188151 - DNA, 10 bp, Unknown
  misc_feature (1)..( 10): Result.005 file - promoters50/4766991
caatacataa

SEQ ID NO: 188152 - DNA, 10 bp, Unknown
  misc_feature (1)..( 10): Result.005 file - promoters50/4766991
aaatatataa

SEQ ID NO: 188153 - DNA, 11 bp, Unknown
  misc_feature (1)..( 11): Result.005 file - promoters50/4766991
aaaaagtatga

SEQ ID NO: 188154 - DNA, 7 bp, Unknown
  misc_feature (1)..( 7): Result.005 file - promoters50/4767003
cattctc

SEQ ID NO: 188155 - DNA, 7 bp, Unknown
  misc_feature (1)..( 7): Result.005 file - promoters50/4767003
cattcta

SEQ ID NO: 188156 - DNA, 7 bp, Unknown
  misc_feature (1)..( 7): Result.005 file - promoters50/4767003
catacta

SEQ ID NO: 188157 - DNA, 8 bp, Unknown
  misc_feature (1)..( 8): Result.005 file - promoters50/4767024
gaataaac

SEQ ID NO: 188158 - DNA, 8 bp, Unknown
  misc_feature (1)..( 8): Result.005 file - promoters50/4767024
aaataaaa

SEQ ID NO: 188159 - DNA, 9 bp, Unknown
  misc_feature (1)..( 9): Result.005 file - promoters50/4767024
gatataaaa

SEQ ID NO: 188160 - DNA, 9 bp, Unknown
  misc_feature (1)..( 9): Result.005 file - promoters50/4767024
caactaaga

SEQ ID NO: 188161 - DNA, 16 bp, Unknown
  misc_feature (1)..( 16): Result.005 file - promoters50/4767038
cattaacaaataaaaa

SEQ ID NO: 188162 - DNA, 16 bp, Unknown
  misc_feature (1)..( 16): Result.005 file - promoters50/4767038
agttaataaatacgaa

SEQ ID NO: 188163 - DNA, 16 bp, Unknown
  misc_feature (1)..( 16): Result.005 file - promoters50/4767038
gactttaaaatgaaaa

SEQ ID NO: 188164 - DNA, 16 bp, Unknown
  misc_feature (1)..( 16): Result.005 file - promoters50/4767038
tggcgggagatggaaa

SEQ ID NO: 188165 - DNA, 16 bp, Unknown
  misc_feature (1)..( 16): Result.005 file - promoters50/4767038
ttttattaaatcaact

SEQ ID NO: 188166 - DNA, 16 bp, Unknown
  misc_feature (1)..( 16): Result.005 file - promoters50/4767038
agttaatatttcattt

SEQ ID NO: 188167 - DNA, 8 bp, Unknown
  misc_feature (1)..( 8): Result.005 file - promoters50/4767050
atagaaaa

SEQ ID NO: 188168 - DNA, 8 bp, Unknown
  misc_feature (1)..( 8): Result.005 file - promoters50/4767050
atataaat

SEQ ID NO: 188169 - DNA, 8 bp, Unknown
  misc_feature (1)..( 8): Result.005 file - promoters50/4767050
aaataaat

SEQ ID NO: 188170 - DNA, 10 bp, Unknown
  misc_feature (1)..( 10): Result.005 file - promoters50/4767054
atttctcaac

SEQ ID NO: 188171 - DNA, 10 bp, Unknown
  misc_feature (1)..( 10): Result.005 file - promoters50/4767054
ttttctctcc

SEQ ID NO: 188172 - DNA, 10 bp, Unknown
  misc_feature (1)..( 10): Result.005 file - promoters50/4767054
atttcacaac

SEQ ID NO: 188173 - DNA, 7 bp, Unknown
  misc_feature (1)..( 7): Result.005 file - promoters50/4767054
aaacata

SEQ ID NO: 188174 - DNA, 7 bp, Unknown
  misc_feature (1)..( 7): Result.005 file - promoters50/4767054
aaacata

SEQ ID NO: 188175 - DNA, 7 bp, Unknown
  misc_feature (1)..( 7): Result.005 file - promoters50/4767054
aaaaata

SEQ ID NO: 188176 - DNA, 8 bp, Unknown
  misc_feature (1)..( 8): Result.005 file - promoters50/4767059
gaacttct

SEQ ID NO: 188177 - DNA, 8 bp, Unknown
  misc_feature (1)..( 8): Result.005 file - promoters50/4767059
gaactttg

SEQ ID NO: 188178 - DNA, 8 bp, Unknown
  misc_feature (1)..( 8): Result.005 file - promoters50/4767059
gaattttg

SEQ ID NO: 188179 - DNA, 7 bp, Unknown
  misc_feature (1)..( 7): Result.005 file - promoters50/4767059
gaaattt

SEQ ID NO: 188180 - DNA, 7 bp, Unknown
  misc_feature (1)..( 7): Result.005 file - promoters50/4767059
taaattt

SEQ ID NO: 188181 - DNA, 7 bp, Unknown
  misc_feature (1)..( 7): Result.005 file - promoters50/4767059
taaatta

SEQ ID NO: 188182 - DNA, 7 bp, Unknown
  misc_feature (1)..( 7): Result.005 file - promoters50/4767063
tttcttt

SEQ ID NO: 188183 - DNA, 7 bp, Unknown
  misc_feature (1)..( 7): Result.005 file - promoters50/4767063
tttattt

SEQ ID NO: 188184 - DNA, 7 bp, Unknown
  misc_feature (1)..( 7): Result.005 file - promoters50/4767063
tttcttc

SEQ ID NO: 188185 - DNA, 7 bp, Unknown
  misc_feature (1)..( 7): Result.005 file - promoters50/4767063
aaactga

SEQ ID NO: 188186 - DNA, 7 bp, Unknown
  misc_feature (1)..( 7): Result.005 file - promoters50/4767063
aaaatga

SEQ ID NO: 188187 - DNA, 7 bp, Unknown
  misc_feature (1)..( 7): Result.005 file - promoters50/4767063
caaatga

SEQ ID NO: 188188 - DNA, 9 bp, Unknown
  misc_feature (1)..( 9): Result.005 file - promoters50/4767063
atttcatga

SEQ ID NO: 188189 - DNA, 9 bp, Unknown
  misc_feature (1)..( 9): Result.005 file - promoters50/4767063
attttatgt

SEQ ID NO: 188190 - DNA, 9 bp, Unknown
  misc_feature (1)..( 9): Result.005 file - promoters50/4767063
gacttatgt

SEQ ID NO: 188191 - DNA, 11 bp, Unknown
  misc_feature (1)..( 11): Result.005 file - promoters50/4767063
tgaaattataa

SEQ ID NO: 188192 - DNA, 11 bp, Unknown
  misc_feature (1)..( 11): Result.005 file - promoters50/4767063
attaattataa

SEQ ID NO: 188193 - DNA, 11 bp, Unknown
  misc_feature (1)..( 11): Result.005 file - promoters50/4767063
attaattaatt

SEQ ID NO: 188194 - DNA, 8 bp, Unknown
  misc_feature (1)..( 8): Result.005 file - promoters50/4767066
cttagtca

SEQ ID NO: 188195 - DNA, 8 bp, Unknown
  misc_feature (1)..( 8): Result.005 file - promoters50/4767066
tttaatca

SEQ ID NO: 188196 - DNA, 8 bp, Unknown
  misc_feature (1)..( 8): Result.005 file - promoters50/4767066
agtaatga

SEQ ID NO: 188197 - DNA, 9 bp, Unknown
  misc_feature (1)..( 9): Result.005 file - promoters50/4767066
gatttttac

SEQ ID NO: 188198 - DNA, 9 bp, Unknown
  misc_feature (1)..( 9): Result.005 file - promoters50/4767066
aatttttca

SEQ ID NO: 188199 - DNA, 9 bp, Unknown
  misc_feature (1)..( 9): Result.005 file - promoters50/4767066
tattattca

SEQ ID NO: 188200 - DNA, 9 bp, Unknown
  misc_feature (1)..( 9): Result.005 file - promoters50/4767066
tattattga

SEQ ID NO: 188201 - DNA, 8 bp, Unknown
  misc_feature (1)..( 8): Result.005 file - promoters50/4767066
cattgatg

SEQ ID NO: 188202 - DNA, 8 bp, Unknown
  misc_feature (1)..( 8): Result.005 file - promoters50/4767066
tattgatc

SEQ ID NO: 188203 - DNA, 8 bp, Unknown
  misc_feature (1)..( 8): Result.005 file - promoters50/4767066
catttatg

SEQ ID NO: 188204 - DNA, 8 bp, Unknown
  misc_feature (1)..( 8): Result.005 file - promoters50/4767066
caaaaact

SEQ ID NO: 188205 - DNA, 8 bp, Unknown
  misc_feature (1)..( 8): Result.005 file - promoters50/4767066
caaaaact

SEQ ID NO: 188206 - DNA, 8 bp, Unknown
  misc_feature (1)..( 8): Result.005 file - promoters50/4767066
gcaaaact

SEQ ID NO: 188207 - DNA, 7 bp, Unknown
  misc_feature (1)..( 7): Result.005 file - promoters50/4767066
gagaaat

SEQ ID NO: 188208 - DNA, 7 bp, Unknown
  misc_feature (1)..( 7): Result.005 file - promoters50/4767066
aagaaat

SEQ ID NO: 188209 - DNA, 7 bp, Unknown
  misc_feature (1)..( 7): Result.005 file - promoters50/4767066
taaaaaa

SEQ ID NO: 188210 - DNA, 9 bp, Unknown
  misc_feature (1)..( 9): Result.005 file - promoters50/4767066
gctttcttt

SEQ ID NO: 188211 - DNA, 9 bp, Unknown
  misc_feature (1)..( 9): Result.005 file - promoters50/4767066
aattttttt

SEQ ID NO: 188212 - DNA, 9 bp, Unknown
  misc_feature (1)..( 9): Result.005 file - promoters50/4767066
aatttttag

SEQ ID NO: 188213 - DNA, 9 bp, Unknown
  misc_feature (1)..( 9): Result.005 file - promoters50/4767066
taaaacatt

SEQ ID NO: 188214 - DNA, 9 bp, Unknown
  misc_feature (1)..( 9): Result.005 file - promoters50/4767066
aaaaacaaa

SEQ ID NO: 188215 - DNA, 9 bp, Unknown
  misc_feature (1)..( 9): Result.005 file - promoters50/4767066
aaaaagaaa

SEQ ID NO: 188216 - DNA, 13 bp, Unknown
  misc_feature (1)..( 13): Result.005 file - promoters50/4767066
gtgactaattctt

SEQ ID NO: 188217 - DNA, 13 bp, Unknown
  misc_feature (1)..( 13): Result.005 file - promoters50/4767066
tttgcaaattctc

SEQ ID NO: 188218 - DNA, 14 bp, Unknown
  misc_feature (1)..( 14): Result.005 file - promoters50/4767066
tttttcaatttctc

SEQ ID NO: 188219 - DNA, 8 bp, Unknown
  misc_feature (1)..( 8): Result.005 file - promoters50/4767085
aaaacttt

SEQ ID NO: 188220 - DNA, 8 bp, Unknown
  misc_feature (1)..( 8): Result.005 file - promoters50/4767085
aaaatttt

SEQ ID NO: 188221 - DNA, 8 bp, Unknown
  misc_feature (1)..( 8): Result.005 file - promoters50/4767085
aaaactat

SEQ ID NO: 188222 - DNA, 8 bp, Unknown
  misc_feature (1)..( 8): Result.005 file - promoters50/4767085
caaatttc

SEQ ID NO: 188223 - DNA, 14 bp, Unknown
  misc_feature (1)..( 14): Result.005 file - promoters50/4767085
cataaattagacaa

SEQ ID NO: 188224 - DNA, 14 bp, Unknown
  misc_feature (1)..( 14): Result.005 file - promoters50/4767085
tataatttagtcat

SEQ ID NO: 188225 - DNA, 14 bp, Unknown
  misc_feature (1)..( 14): Result.005 file - promoters50/4767085
tattattcgttgtt

SEQ ID NO: 188226 - DNA, 14 bp, Unknown
  misc_feature (1)..( 14): Result.005 file - promoters50/4767085
aaatatttagacat

SEQ ID NO: 188227 - DNA, 11 bp, Unknown
  misc_feature (1)..( 11): Result.005 file - promoters50/4767103
tcactggttta

SEQ ID NO: 188228 - DNA, 11 bp, Unknown
  misc_feature (1)..( 11): Result.005 file - promoters50/4767103
gttctgattta

SEQ ID NO: 188229 - DNA, 11 bp, Unknown
  misc_feature (1)..( 11): Result.005 file - promoters50/4767103
tcactggttta

SEQ ID NO: 188230 - DNA, 8 bp, Unknown
  misc_feature (1)..( 8): Result.005 file - promoters50/4767103
ggagattt

SEQ ID NO: 188231 - DNA, 8 bp, Unknown
  misc_feature (1)..( 8): Result.005 file - promoters50/4767103
ggaaattt

SEQ ID NO: 188232 - DNA, 8 bp, Unknown
  misc_feature (1)..( 8): Result.005 file - promoters50/4767103
agaatttt

SEQ ID NO: 188233 - DNA, 10 bp, Unknown
  misc_feature (1)..( 10): Result.005 file - promoters50/4767109
aatacaataa

SEQ ID NO: 188234 - DNA, 10 bp, Unknown
  misc_feature (1)..( 10): Result.005 file - promoters50/4767109
gatacaaaat

SEQ ID NO: 188235 - DNA, 10 bp, Unknown
  misc_feature (1)..( 10): Result.005 file - promoters50/4767109
gataaaaaat

SEQ ID NO: 188236 - DNA, 7 bp, Unknown
  misc_feature (1)..( 7): Result.005 file - promoters50/4767109
tttaatt

SEQ ID NO: 188237 - DNA, 7 bp, Unknown
  misc_feature (1)..( 7): Result.005 file - promoters50/4767109
tttcatt

SEQ ID NO: 188238 - DNA, 7 bp, Unknown
  misc_feature (1)..( 7): Result.005 file - promoters50/4767109
tttaata

SEQ ID NO: 188239 - DNA, 11 bp, Unknown
  misc_feature (1)..( 11): Result.005 file - promoters50/4767109
aataaacaata

SEQ ID NO: 188240 - DNA, 11 bp, Unknown
  misc_feature (1)..( 11): Result.005 file - promoters50/4767109
gataaaaaata

SEQ ID NO: 188241 - DNA, 11 bp, Unknown
  misc_feature (1)..( 11): Result.005 file - promoters50/4767109
gatacaaaatc

SEQ ID NO: 188242 - DNA, 10 bp, Unknown
  misc_feature (1)..( 10): Result.005 file - promoters50/4767109
tctctatata

SEQ ID NO: 188243 - DNA, 10 bp, Unknown
  misc_feature (1)..( 10): Result.005 file - promoters50/4767109
cctatatata

SEQ ID NO: 188244 - DNA, 10 bp, Unknown
  misc_feature (1)..( 10): Result.005 file - promoters50/4767109
tctgtatatt

SEQ ID NO: 188245 - DNA, 7 bp, Unknown
  misc_feature (1)..( 7): Result.005 file - promoters50/4767109
caatttt

SEQ ID NO: 188246 - DNA, 7 bp, Unknown
  misc_feature (1)..( 7): Result.005 file - promoters50/4767109
caaattt

SEQ ID NO: 188247 - DNA, 7 bp, Unknown
  misc_feature (1)..( 7): Result.005 file - promoters50/4767109
caaatta

SEQ ID NO: 188248 - DNA, 10 bp, Unknown
  misc_feature (1)..( 10): Result.005 file - promoters50/4767129
tttatgtatt

SEQ ID NO: 188249 - DNA, 10 bp, Unknown
  misc_feature (1)..( 10): Result.005 file - promoters50/4767129
attttgtatt

SEQ ID NO: 188250 - DNA, 10 bp, Unknown
  misc_feature (1)..( 10): Result.005 file - promoters50/4767129
tttctgtata

SEQ ID NO: 188251 - DNA, 7 bp, Unknown
  misc_feature (1)..( 7): Result.005 file - promoters50/4767129
tttctct

SEQ ID NO: 188252 - DNA, 7 bp, Unknown
  misc_feature (1)..( 7): Result.005 file - promoters50/4767129
tttttct

SEQ ID NO: 188253 - DNA, 7 bp, Unknown
  misc_feature (1)..( 7): Result.005 file - promoters50/4767129
tttctgt

SEQ ID NO: 188254 - DNA, 9 bp, Unknown
  misc_feature (1)..( 9): Result.005 file - promoters50/4767129
taataaact

SEQ ID NO: 188255 - DNA, 9 bp, Unknown
  misc_feature (1)..( 9): Result.005 file - promoters50/4767129
tcataaact

SEQ ID NO: 188256 - DNA, 9 bp, Unknown
  misc_feature (1)..( 9): Result.005 file - promoters50/4767129
tcaaaaaca

SEQ ID NO: 188257 - DNA, 9 bp, Unknown
  misc_feature (1)..( 9): Result.005 file - promoters50/4767133
aaattattt

SEQ ID NO: 188258 - DNA, 9 bp, Unknown
  misc_feature (1)..( 9): Result.005 file - promoters50/4767133
ggtttattt

SEQ ID NO: 188259 - DNA, 9 bp, Unknown
  misc_feature (1)..( 9): Result.005 file - promoters50/4767133
aaatgattt

SEQ ID NO: 188260 - DNA, 8 bp, Unknown
  misc_feature (1)..( 8): Result.005 file - promoters50/4767133
ttaatgta

SEQ ID NO: 188261 - DNA, 8 bp, Unknown
  misc_feature (1)..( 8): Result.005 file - promoters50/4767133
ttagtgta

SEQ ID NO: 188262 - DNA, 8 bp, Unknown
  misc_feature (1)..( 8): Result.005 file - promoters50/4767133
ataatgtc

SEQ ID NO: 188263 - DNA, 9 bp, Unknown
  misc_feature (1)..( 9): Result.005 file - promoters50/4767148
attcatatg

SEQ ID NO: 188264 - DNA, 9 bp, Unknown
  misc_feature (1)..( 9): Result.005 file - promoters50/4767148
attgatata

SEQ ID NO: 188265 - DNA, 9 bp, Unknown
  misc_feature (1)..( 9): Result.005 file - promoters50/4767148
atttatata

SEQ ID NO: 188266 - DNA, 9 bp, Unknown
  misc_feature (1)..( 9): Result.005 file - promoters50/4767148
tactatata

SEQ ID NO: 188267 - DNA, 9 bp, Unknown
  misc_feature (1)..( 9): Result.005 file - promoters50/4767148
atttcttac

SEQ ID NO: 188268 - DNA, 9 bp, Unknown
  misc_feature (1)..( 9): Result.005 file - promoters50/4767148
atttctaca

SEQ ID NO: 188269 - DNA, 9 bp, Unknown
  misc_feature (1)..( 9): Result.005 file - promoters50/4767148
attcctttg

SEQ ID NO: 188270 - DNA, 9 bp, Unknown
  misc_feature (1)..( 9): Result.005 file - promoters50/4767148
ttttcgtac

SEQ ID NO: 188271 - DNA, 12 bp, Unknown
  misc_feature (1)..( 12): Result.005 file - promoters50/4767148
aacaaatttgac

SEQ ID NO: 188272 - DNA, 12 bp, Unknown
  misc_feature (1)..( 12): Result.005 file - promoters50/4767148
agtaaatttgac

SEQ ID NO: 188273 - DNA, 12 bp, Unknown
  misc_feature (1)..( 12): Result.005 file - promoters50/4767148
agtatatttgaa

SEQ ID NO: 188274 - DNA, 12 bp, Unknown
  misc_feature (1)..( 12): Result.005 file - promoters50/4767148
agtaactttaga

SEQ ID NO: 188275 - DNA, 8 bp, Unknown
  misc_feature (1)..( 8): Result.005 file - promoters50/4767148
gcttatta

SEQ ID NO: 188276 - DNA, 8 bp, Unknown
  misc_feature (1)..( 8): Result.005 file - promoters50/4767148
gtttatta

SEQ ID NO: 188277 - DNA, 8 bp, Unknown
  misc_feature (1)..( 8): Result.005 file - promoters50/4767148
atttatta

SEQ ID NO: 188278 - DNA, 8 bp, Unknown
  misc_feature (1)..( 8): Result.005 file - promoters50/4767148
atttattc

SEQ ID NO: 188279 - DNA, 6 bp, Unknown
  misc_feature (1)..( 6): Result.005 file - promoters50/4767156
aaaatt

SEQ ID NO: 188280 - DNA, 6 bp, Unknown
  misc_feature (1)..( 6): Result.005 file - promoters50/4767156
aaaatt

SEQ ID NO: 188281 - DNA, 6 bp, Unknown
  misc_feature (1)..( 6): Result.005 file - promoters50/4767156
aaaatt

SEQ ID NO: 188282 - DNA, 15 bp, Unknown
  misc_feature (1)..( 15): Result.005 file - promoters50/4767156
aaaaagtaaaaaaca

SEQ ID NO: 188283 - DNA, 15 bp, Unknown
  misc_feature (1)..( 15): Result.005 file - promoters50/4767156
taaaattaaagaaca

SEQ ID NO: 188284 - DNA, 15 bp, Unknown
  misc_feature (1)..( 15): Result.005 file - promoters50/4767156
taaaatgttgtcatt

SEQ ID NO: 188285 - DNA, 8 bp, Unknown
  misc_feature (1)..( 8): Result.005 file - promoters50/4767169
tttttttg

SEQ ID NO: 188286 - DNA, 8 bp, Unknown
  misc_feature (1)..( 8): Result.005 file - promoters50/4767169
gtttattg

SEQ ID NO: 188287 - DNA, 8 bp, Unknown
  misc_feature (1)..( 8): Result.005 file - promoters50/4767169
gtttatcg

SEQ ID NO: 188288 - DNA, 7 bp, Unknown
  misc_feature (1)..( 7): Result.005 file - promoters50/4767199
atttttc

SEQ ID NO: 188289 - DNA, 7 bp, Unknown
  misc_feature (1)..( 7): Result.005 file - promoters50/4767199
atttttt

SEQ ID NO: 188290 - DNA, 8 bp, Unknown
  misc_feature (1)..( 8): Result.005 file - promoters50/4767199
atttattt

SEQ ID NO: 188291 - DNA, 8 bp, Unknown
  misc_feature (1)..( 8): Result.005 file - promoters50/4767199
ctttgttc

SEQ ID NO: 188292 - DNA, 8 bp, Unknown
  misc_feature (1)..( 8): Result.005 file - promoters50/4767199
tttttttc

SEQ ID NO: 188293 - DNA, 8 bp, Unknown
  misc_feature (1)..( 8): Result.005 file - promoters50/4767199
atttattt

SEQ ID NO: 188294 - DNA, 8 bp, Unknown
  misc_feature (1)..( 8): Result.005 file - promoters50/4767199
atttaaaa

SEQ ID NO: 188295 - DNA, 8 bp, Unknown
  misc_feature (1)..( 8): Result.005 file - promoters50/4767199
attaaaaa

SEQ ID NO: 188296 - DNA, 8 bp, Unknown
  misc_feature (1)..( 8): Result.005 file - promoters50/4767199
attagaaa

SEQ ID NO: 188297 - DNA, 10 bp, Unknown
  misc_feature (1)..( 10): Result.005 file - promoters50/4767199
taatttatgc

SEQ ID NO: 188298 - DNA, 10 bp, Unknown
  misc_feature (1)..( 10): Result.005 file - promoters50/4767199
taatttattt

SEQ ID NO: 188299 - DNA, 10 bp, Unknown
  misc_feature (1)..( 10): Result.005 file - promoters50/4767199
tcattttttt

SEQ ID NO: 188300 - DNA, 10 bp, Unknown
  misc_feature (1)..( 10): Result.005 file - promoters50/4767199
caatctaaga

SEQ ID NO: 188301 - DNA, 10 bp, Unknown
  misc_feature (1)..( 10): Result.005 file - promoters50/4767199
taatcttaga

SEQ ID NO: 188302 - DNA, 10 bp, Unknown
  misc_feature (1)..( 10): Result.005 file - promoters50/4767199
taatattaag

SEQ ID NO: 188303 - DNA, 9 bp, Unknown
  misc_feature (1)..( 9): Result.005 file - promoters50/4767226
tatagtctt

SEQ ID NO: 188304 - DNA, 9 bp, Unknown
  misc_feature (1)..( 9): Result.005 file - promoters50/4767226
aatattctt

SEQ ID NO: 188305 - DNA, 9 bp, Unknown
  misc_feature (1)..( 9): Result.005 file - promoters50/4767226
aatattgtt

SEQ ID NO: 188306 - DNA, 12 bp, Unknown
  misc_feature (1)..( 12): Result.005 file - promoters50/4767230
taaattttcaaa

SEQ ID NO: 188307 - DNA, 12 bp, Unknown
  misc_feature (1)..( 12): Result.005 file - promoters50/4767230
aaaatcttcaac

SEQ ID NO: 188308 - DNA, 13 bp, Unknown
  misc_feature (1)..( 13): Result.005 file - promoters50/4767230
aaatatcttaaac

SEQ ID NO: 188309 - DNA, 15 bp, Unknown
  misc_feature (1)..( 15): Result.005 file - promoters50/4767230
aaaagagttttgcac

SEQ ID NO: 188310 - DNA, 15 bp, Unknown
  misc_feature (1)..( 15): Result.005 file - promoters50/4767230
attttactttggcaa

SEQ ID NO: 188311 - DNA, 15 bp, Unknown
  misc_feature (1)..( 15): Result.005 file - promoters50/4767230
atttgactttgacaa

SEQ ID NO: 188312 - DNA, 9 bp, Unknown
  misc_feature (1)..( 9): Result.005 file - promoters50/4767255
ccttttctt

SEQ ID NO: 188313 - DNA, 9 bp, Unknown
  misc_feature (1)..( 9): Result.005 file - promoters50/4767255
ccttctctt

SEQ ID NO: 188314 - DNA, 9 bp, Unknown
  misc_feature (1)..( 9): Result.005 file - promoters50/4767255
ctctctctt

SEQ ID NO: 188315 - DNA, 7 bp, Unknown
  misc_feature (1)..( 7): Result.005 file - promoters50/4767267
ttttaat

SEQ ID NO: 188316 - DNA, 7 bp, Unknown
  misc_feature (1)..( 7): Result.005 file - promoters50/4767267
atttaat

SEQ ID NO: 188317 - DNA, 7 bp, Unknown
  misc_feature (1)..( 7): Result.005 file - promoters50/4767267
attgaat

SEQ ID NO: 188318 - DNA, 10 bp, Unknown
  misc_feature (1)..( 10): Result.005 file - promoters50/4767267
aatttatgta

SEQ ID NO: 188319 - DNA, 10 bp, Unknown
  misc_feature (1)..( 10): Result.005 file - promoters50/4767267
aatatattga

SEQ ID NO: 188320 - DNA, 10 bp, Unknown
  misc_feature (1)..( 10): Result.005 file - promoters50/4767267
aataaattga

SEQ ID NO: 188321 - DNA, 11 bp, Unknown
  misc_feature (1)..( 11): Result.005 file - promoters50/4767267
aattgaaaaag

SEQ ID NO: 188322 - DNA, 11 bp, Unknown
  misc_feature (1)..( 11): Result.005 file - promoters50/4767267
ataagaagaag

SEQ ID NO: 188323 - DNA, 11 bp, Unknown
  misc_feature (1)..( 11): Result.005 file - promoters50/4767267
aatttaaaata

SEQ ID NO: 188324 - DNA, 9 bp, Unknown
  misc_feature (1)..( 9): Result.005 file - promoters50/4767279
ttaacattg

SEQ ID NO: 188325 - DNA, 9 bp, Unknown
  misc_feature (1)..( 9): Result.005 file - promoters50/4767279
ctaaccttg

SEQ ID NO: 188326 - DNA, 9 bp, Unknown
  misc_feature (1)..( 9): Result.005 file - promoters50/4767279
ttaacaaaa

SEQ ID NO: 188327 - DNA, 9 bp, Unknown
  misc_feature (1)..( 9): Result.005 file - promoters50/4767279
attaaaagg

SEQ ID NO: 188328 - DNA, 9 bp, Unknown
  misc_feature (1)..( 9): Result.005 file - promoters50/4767279
taaaaaagg

SEQ ID NO: 188329 - DNA, 9 bp, Unknown
  misc_feature (1)..( 9): Result.005 file - promoters50/4767279
attcaaaga

SEQ ID NO: 188330 - DNA, 9 bp, Unknown
  misc_feature (1)..( 9): Result.005 file - promoters50/4767283
atttacttt

SEQ ID NO: 188331 - DNA, 9 bp, Unknown
  misc_feature (1)..( 9): Result.005 file - promoters50/4767283
acttatttt

SEQ ID NO: 188332 - DNA, 10 bp, Unknown
  misc_feature (1)..( 10): Result.005 file - promoters50/4767283
aattaactat

SEQ ID NO: 188333 - DNA, 7 bp, Unknown
  misc_feature (1)..( 7): Result.005 file - promoters50/4767283
caaatta

SEQ ID NO: 188334 - DNA, 7 bp, Unknown
  misc_feature (1)..( 7): Result.005 file - promoters50/4767283
taaatta

SEQ ID NO: 188335 - DNA, 7 bp, Unknown
  misc_feature (1)..( 7): Result.005 file - promoters50/4767283
taaattg

SEQ ID NO: 188336 - DNA, 12 bp, Unknown
  misc_feature (1)..( 12): Result.005 file - promoters50/4767294
aaagatttttga

SEQ ID NO: 188337 - DNA, 12 bp, Unknown
  misc_feature (1)..( 12): Result.005 file - promoters50/4767294
aaaaattcttga

SEQ ID NO: 188338 - DNA, 12 bp, Unknown
  misc_feature (1)..( 12): Result.005 file - promoters50/4767294
aaagattattat

SEQ ID NO: 188339 - DNA, 12 bp, Unknown
  misc_feature (1)..( 12): Result.005 file - promoters50/4767294
taaacttcacat

SEQ ID NO: 188340 - DNA, 13 bp, Unknown
  misc_feature (1)..( 13): Result.005 file - promoters50/4767294
aaataataaatca

SEQ ID NO: 188341 - DNA, 13 bp, Unknown
  misc_feature (1)..( 13): Result.005 file - promoters50/4767294
actaaattaaaag

SEQ ID NO: 188342 - DNA, 13 bp, Unknown
  misc_feature (1)..( 13): Result.005 file - promoters50/4767298
tcctaaaatagtt

SEQ ID NO: 188343 - DNA, 13 bp, Unknown
  misc_feature (1)..( 13): Result.005 file - promoters50/4767298
tcctaaaatcaag

SEQ ID NO: 188344 - DNA, 13 bp, Unknown
  misc_feature (1)..( 13): Result.005 file - promoters50/4767298
atgaaaaataaac

SEQ ID NO: 188345 - DNA, 13 bp, Unknown
  misc_feature (1)..( 13): Result.005 file - promoters50/4767298
cattaaaatattc

SEQ ID NO: 188346 - DNA, 13 bp, Unknown
  misc_feature (1)..( 13): Result.005 file - promoters50/4767298
ttttaaaatatag

SEQ ID NO: 188347 - DNA, 13 bp, Unknown
  misc_feature (1)..( 13): Result.005 file - promoters50/4767298
ttgacaaataaac

SEQ ID NO: 188348 - DNA, 13 bp, Unknown
  misc_feature (1)..( 13): Result.005 file - promoters50/4767298
atctaatatatat

SEQ ID NO: 188349 - DNA, 12 bp, Unknown
  misc_feature (1)..( 12): Result.005 file - promoters50/4767298
tttcaagtaagt

SEQ ID NO: 188350 - DNA, 12 bp, Unknown
  misc_feature (1)..( 12): Result.005 file - promoters50/4767298
aatcaagtgaag

SEQ ID NO: 188351 - DNA, 12 bp, Unknown
  misc_feature (1)..( 12): Result.005 file - promoters50/4767298
tgacaaataaac

SEQ ID NO: 188352 - DNA, 12 bp, Unknown
  misc_feature (1)..( 12): Result.005 file - promoters50/4767298
tgaaaaataaac

SEQ ID NO: 188353 - DNA, 12 bp, Unknown
  misc_feature (1)..( 12): Result.005 file - promoters50/4767298
gataaattaaaa

SEQ ID NO: 188354 - DNA, 12 bp, Unknown
  misc_feature (1)..( 12): Result.005 file - promoters50/4767298
gacgaattcaaa

SEQ ID NO: 188355 - DNA, 10 bp, Unknown
  misc_feature (1)..( 10): Result.005 file - promoters50/4767298
tatgtcacta

SEQ ID NO: 188356 - DNA, 10 bp, Unknown
  misc_feature (1)..( 10): Result.005 file - promoters50/4767298
tatttcattt

SEQ ID NO: 188357 - DNA, 10 bp, Unknown
  misc_feature (1)..( 10): Result.005 file - promoters50/4767298
tatttccttc

SEQ ID NO: 188358 - DNA, 10 bp, Unknown
  misc_feature (1)..( 10): Result.005 file - promoters50/4767298
tatatcacaa

SEQ ID NO: 188359 - DNA, 10 bp, Unknown
  misc_feature (1)..( 10): Result.005 file - promoters50/4767298
aatatcaata

SEQ ID NO: 188360 - DNA, 10 bp, Unknown
  misc_feature (1)..( 10): Result.005 file - promoters50/4767298
aatctcaata

SEQ ID NO: 188361 - DNA, 11 bp, Unknown
  misc_feature (1)..( 11): Result.005 file - promoters50/4767298
ttaaaaaggaa

SEQ ID NO: 188362 - DNA, 11 bp, Unknown
  misc_feature (1)..( 11): Result.005 file - promoters50/4767298
ttaaaaagtga

SEQ ID NO: 188363 - DNA, 11 bp, Unknown
  misc_feature (1)..( 11): Result.005 file - promoters50/4767298
caaaaaagaaa

SEQ ID NO: 188364 - DNA, 11 bp, Unknown
  misc_feature (1)..( 11): Result.005 file - promoters50/4767298
cagaaatgaat

SEQ ID NO: 188365 - DNA, 11 bp, Unknown
  misc_feature (1)..( 11): Result.005 file - promoters50/4767298
gaataaattgt

SEQ ID NO: 188366 - DNA, 11 bp, Unknown
  misc_feature (1)..( 11): Result.005 file - promoters50/4767298
tgagaaagaaa

SEQ ID NO: 188367 - DNA, 13 bp, Unknown
  misc_feature (1)..( 13): Result.005 file - promoters50/4767298
aaaaatatttcga

SEQ ID NO: 188368 - DNA, 13 bp, Unknown
  misc_feature (1)..( 13): Result.005 file - promoters50/4767298
taaaatatcaata

SEQ ID NO: 188369 - DNA, 13 bp, Unknown
  misc_feature (1)..( 13): Result.005 file - promoters50/4767298
tgaaatattactc

SEQ ID NO: 188370 - DNA, 13 bp, Unknown
  misc_feature (1)..( 13): Result.005 file - promoters50/4767298
gataatatttcat

SEQ ID NO: 188371 - DNA, 13 bp, Unknown
  misc_feature (1)..( 13): Result.005 file - promoters50/4767298
taaaatacagtag

SEQ ID NO: 188372 - DNA, 13 bp, Unknown
  misc_feature (1)..( 13): Result.005 file - promoters50/4767298
tgcaatctcaata

SEQ ID NO: 188373 - DNA, 13 bp, Unknown
  misc_feature (1)..( 13): Result.005 file - promoters50/4767298
ctttttataatca

SEQ ID NO: 188374 - DNA, 13 bp, Unknown
  misc_feature (1)..( 13): Result.005 file - promoters50/4767298
gacattataaaat

SEQ ID NO: 188375 - DNA, 13 bp, Unknown
  misc_feature (1)..( 13): Result.005 file - promoters50/4767298
ctttttttaacaa

SEQ ID NO: 188376 - DNA, 13 bp, Unknown
  misc_feature (1)..( 13): Result.005 file - promoters50/4767298
tggcttctatttc

SEQ ID NO: 188377 - DNA, 13 bp, Unknown
  misc_feature (1)..( 13): Result.005 file - promoters50/4767298
tgaattctaaaat

SEQ ID NO: 188378 - DNA, 13 bp, Unknown
  misc_feature (1)..( 13): Result.005 file - promoters50/4767298
tgtcttttatcaa

SEQ ID NO: 188379 - DNA, 8 bp, Unknown
  misc_feature (1)..( 8): Result.005 file - promoters50/4767314
aaaatttt

SEQ ID NO: 188380 - DNA, 8 bp, Unknown
  misc_feature (1)..( 8): Result.005 file - promoters50/4767314
aaaacttt

SEQ ID NO: 188381 - DNA, 9 bp, Unknown
  misc_feature (1)..( 9): Result.005 file - promoters50/4767314
aaacactta

SEQ ID NO: 188382 - DNA, 12 bp, Unknown
  misc_feature (1)..( 12): Result.005 file - promoters50/4767314
tttcaagaaaca

SEQ ID NO: 188383 - DNA, 12 bp, Unknown
  misc_feature (1)..( 12): Result.005 file - promoters50/4767314
ttttaagtgata

SEQ ID NO: 188384 - DNA, 12 bp, Unknown
  misc_feature (1)..( 12): Result.005 file - promoters50/4767314
gtttaaatgata

SEQ ID NO: 188385 - DNA, 9 bp, Unknown
  misc_feature (1)..( 9): Result.005 file - promoters50/4767318
tgttatttc

SEQ ID NO: 188386 - DNA, 9 bp, Unknown
  misc_feature (1)..( 9): Result.005 file - promoters50/4767318
tgtaatttt

SEQ ID NO: 188387 - DNA, 9 bp, Unknown
  misc_feature (1)..( 9): Result.005 file - promoters50/4767318
ccatatttc

SEQ ID NO: 188388 - DNA, 12 bp, Unknown
  misc_feature (1)..( 12): Result.005 file - promoters50/4767318
taacattaatat

SEQ ID NO: 188389 - DNA, 12 bp, Unknown
  misc_feature (1)..( 12): Result.005 file - promoters50/4767318
aatcattaaact

SEQ ID NO: 188390 - DNA, 12 bp, Unknown
  misc_feature (1)..( 12): Result.005 file - promoters50/4767318
taagattaagtt

SEQ ID NO: 188391 - DNA, 12 bp, Unknown
  misc_feature (1)..( 12): Result.005 file - promoters50/4767318
gaatatttatat

SEQ ID NO: 188392 - DNA, 9 bp, Unknown
  misc_feature (1)..( 9): Result.005 file - promoters50/4767318
tttaattag

SEQ ID NO: 188393 - DNA, 9 bp, Unknown
  misc_feature (1)..( 9): Result.005 file - promoters50/4767318
tttacttaa

SEQ ID NO: 188394 - DNA, 9 bp, Unknown
  misc_feature (1)..( 9): Result.005 file - promoters50/4767318
ttttcttaa

SEQ ID NO: 188395 - DNA, 9 bp, Unknown
  misc_feature (1)..( 9): Result.005 file - promoters50/4767318
tttacttca

SEQ ID NO: 188396 - DNA, 10 bp, Unknown
  misc_feature (1)..( 10): Result.005 file - promoters50/4767318
ttaaatacac

SEQ ID NO: 188397 - DNA, 10 bp, Unknown
  misc_feature (1)..( 10): Result.005 file - promoters50/4767318
gaaaacacac

SEQ ID NO: 188398 - DNA, 10 bp, Unknown
  misc_feature (1)..( 10): Result.005 file - promoters50/4767318
aaaaacacaa

SEQ ID NO: 188399 - DNA, 9 bp, Unknown
  misc_feature (1)..( 9): Result.005 file - promoters50/4767318
aaattatca

SEQ ID NO: 188400 - DNA, 9 bp, Unknown
  misc_feature (1)..( 9): Result.005 file - promoters50/4767318
aaaatatta

SEQ ID NO: 188401 - DNA, 9 bp, Unknown
  misc_feature (1)..( 9): Result.005 file - promoters50/4767318
caattttat

SEQ ID NO: 188402 - DNA, 9 bp, Unknown
  misc_feature (1)..( 9): Result.005 file - promoters50/4767318
aaagactga

SEQ ID NO: 188403 - DNA, 9 bp, Unknown
  misc_feature (1)..( 9): Result.005 file - promoters50/4767318
aaatactta

SEQ ID NO: 188404 - DNA, 9 bp, Unknown
  misc_feature (1)..( 9): Result.005 file - promoters50/4767318
gaatattta

SEQ ID NO: 188405 - DNA, 7 bp, Unknown
  misc_feature (1)..( 7): Result.005 file - promoters50/4767318
ttctttt

SEQ ID NO: 188406 - DNA, 7 bp, Unknown
  misc_feature (1)..( 7): Result.005 file - promoters50/4767318
ttcgttt

SEQ ID NO: 188407 - DNA, 7 bp, Unknown
  misc_feature (1)..( 7): Result.005 file - promoters50/4767318
ttcattt

SEQ ID NO: 188408 - DNA, 8 bp, Unknown
  misc_feature (1)..( 8): Result.005 file - promoters50/4767318
acatgatt

SEQ ID NO: 188409 - DNA, 8 bp, Unknown
  misc_feature (1)..( 8): Result.005 file - promoters50/4767318
acaagatt

SEQ ID NO: 188410 - DNA, 8 bp, Unknown
  misc_feature (1)..( 8): Result.005 file - promoters50/4767318
tcaatatt

SEQ ID NO: 188411 - DNA, 10 bp, Unknown
  misc_feature (1)..( 10): Result.005 file - promoters50/4767318
gtcttcatca

SEQ ID NO: 188412 - DNA, 10 bp, Unknown
  misc_feature (1)..( 10): Result.005 file - promoters50/4767318
gtcttcattt

SEQ ID NO: 188413 - DNA, 10 bp, Unknown
  misc_feature (1)..( 10): Result.005 file - promoters50/4767318
ttgttcgttt

SEQ ID NO: 188414 - DNA, 9 bp, Unknown
  misc_feature (1)..( 9): Result.005 file - promoters50/4767318
aaaatcatt

SEQ ID NO: 188415 - DNA, 9 bp, Unknown
  misc_feature (1)..( 9): Result.005 file - promoters50/4767318
aaaattatt

SEQ ID NO: 188416 - DNA, 9 bp, Unknown
  misc_feature (1)..( 9): Result.005 file - promoters50/4767318
taaattatt

SEQ ID NO: 188417 - DNA, 8 bp, Unknown
  misc_feature (1)..( 8): Result.005 file - promoters50/4767330
cgatattt

SEQ ID NO: 188418 - DNA, 8 bp, Unknown
  misc_feature (1)..( 8): Result.005 file - promoters50/4767330
caatattt

SEQ ID NO: 188419 - DNA, 8 bp, Unknown
  misc_feature (1)..( 8): Result.005 file - promoters50/4767330
cgagattc

SEQ ID NO: 188420 - DNA, 8 bp, Unknown
  misc_feature (1)..( 8): Result.005 file - promoters50/4767330
caattttt

SEQ ID NO: 188421 - DNA, 11 bp, Unknown
  misc_feature (1)..( 11): Result.005 file - promoters50/4767330
atttctgtttg

SEQ ID NO: 188422 - DNA, 11 bp, Unknown
  misc_feature (1)..( 11): Result.005 file - promoters50/4767330
atttttgtttg

SEQ ID NO: 188423 - DNA, 11 bp, Unknown
  misc_feature (1)..( 11): Result.005 file - promoters50/4767330
acttgtgtttg

SEQ ID NO: 188424 - DNA, 11 bp, Unknown
  misc_feature (1)..( 11): Result.005 file - promoters50/4767330
aattgtattta

SEQ ID NO: 188425 - DNA, 13 bp, Unknown
  misc_feature (1)..( 13): Result.005 file - promoters50/4767335
acacattcttcaa

SEQ ID NO: 188426 - DNA, 13 bp, Unknown
  misc_feature (1)..( 13): Result.005 file - promoters50/4767335
atgaattctttca

SEQ ID NO: 188427 - DNA, 13 bp, Unknown
  misc_feature (1)..( 13): Result.005 file - promoters50/4767335
aagaattattttg

SEQ ID NO: 188428 - DNA, 14 bp, Unknown
  misc_feature (1)..( 14): Result.005 file - promoters50/4767335
atccattagtttcc

SEQ ID NO: 188429 - DNA, 14 bp, Unknown
  misc_feature (1)..( 14): Result.005 file - promoters50/4767335
tttgcttctttgga

SEQ ID NO: 188430 - DNA, 14 bp, Unknown
  misc_feature (1)..( 14): Result.005 file - promoters50/4767335
atgaaatctctcaa

SEQ ID NO: 188431 - DNA, 9 bp, Unknown
  misc_feature (1)..( 9): Result.005 file - promoters50/4767369
aaataaaga

SEQ ID NO: 188432 - DNA, 9 bp, Unknown
  misc_feature (1)..( 9): Result.005 file - promoters50/4767369
caataaatt

SEQ ID NO: 188433 - DNA, 9 bp, Unknown
  misc_feature (1)..( 9): Result.005 file - promoters50/4767369
caatatatt

SEQ ID NO: 188434 - DNA, 7 bp, Unknown
  misc_feature (1)..( 7): Result.005 file - promoters50/4767377
ttaaaat

SEQ ID NO: 188435 - DNA, 7 bp, Unknown
  misc_feature (1)..( 7): Result.005 file - promoters50/4767377
ttaaaat

SEQ ID NO: 188436 - DNA, 7 bp, Unknown
  misc_feature (1)..( 7): Result.005 file - promoters50/4767377
ttaaaaa

SEQ ID NO: 188437 - DNA, 7 bp, Unknown
  misc_feature (1)..( 7): Result.005 file - promoters50/4767377
ttaaaaa

SEQ ID NO: 188438 - DNA, 12 bp, Unknown
  misc_feature (1)..( 12): Result.005 file - promoters50/4767377
ccgttaaaatag

SEQ ID NO: 188439 - DNA, 12 bp, Unknown
  misc_feature (1)..( 12): Result.005 file - promoters50/4767377
aaattaaaatct

SEQ ID NO: 188440 - DNA, 12 bp, Unknown
  misc_feature (1)..( 12): Result.005 file - promoters50/4767377
tctacaaaataa

SEQ ID NO: 188441 - DNA, 12 bp, Unknown
  misc_feature (1)..( 12): Result.005 file - promoters50/4767377
aaattaaacggg

SEQ ID NO: 188442 - DNA, 12 bp, Unknown
  misc_feature (1)..( 12): Result.005 file - promoters50/4767377
ttgataaactct

SEQ ID NO: 188443 - DNA, 9 bp, Unknown
  misc_feature (1)..( 9): Result.005 file - promoters50/4767377
ttaaaccat

SEQ ID NO: 188444 - DNA, 9 bp, Unknown
  misc_feature (1)..( 9): Result.005 file - promoters50/4767377
ataaaccta

SEQ ID NO: 188445 - DNA, 9 bp, Unknown
  misc_feature (1)..( 9): Result.005 file - promoters50/4767377
aaaaaccat

SEQ ID NO: 188446 - DNA, 9 bp, Unknown
  misc_feature (1)..( 9): Result.005 file - promoters50/4767377
ataaactct

SEQ ID NO: 188447 - DNA, 7 bp, Unknown
  misc_feature (1)..( 7): Result.005 file - promoters50/4767377
aaataac

SEQ ID NO: 188448 - DNA, 7 bp, Unknown
  misc_feature (1)..( 7): Result.005 file - promoters50/4767377
aaataaa

SEQ ID NO: 188449 - DNA, 7 bp, Unknown
  misc_feature (1)..( 7): Result.005 file - promoters50/4767377
aaataat

SEQ ID NO: 188450 - DNA, 8 bp, Unknown
  misc_feature (1)..( 8): Result.005 file - promoters50/4767377
aagatata

SEQ ID NO: 188451 - DNA, 7 bp, Unknown
  misc_feature (1)..( 7): Result.005 file - promoters50/4767377
caaataa

SEQ ID NO: 188452 - DNA, 7 bp, Unknown
  misc_feature (1)..( 7): Result.005 file - promoters50/4767377
gaaataa

SEQ ID NO: 188453 - DNA, 7 bp, Unknown
  misc_feature (1)..( 7): Result.005 file - promoters50/4767377
gaaataa

SEQ ID NO: 188454 - DNA, 7 bp, Unknown
  misc_feature (1)..( 7): Result.005 file - promoters50/4767377
gaaataa

SEQ ID NO: 188455 - DNA, 11 bp, Unknown
  misc_feature (1)..( 11): Result.005 file - promoters50/4767377
ttaaaatcaac

SEQ ID NO: 188456 - DNA, 11 bp, Unknown
  misc_feature (1)..( 11): Result.005 file - promoters50/4767377
ttaaaaatata

SEQ ID NO: 188457 - DNA, 12 bp, Unknown
  misc_feature (1)..( 12): Result.005 file - promoters50/4767377
ttataaataatt

SEQ ID NO: 188458 - DNA, 12 bp, Unknown
  misc_feature (1)..( 12): Result.005 file - promoters50/4767377
tgtgaaataatt

SEQ ID NO: 188459 - DNA, 14 bp, Unknown
  misc_feature (1)..( 14): Result.005 file - promoters50/4767379
ttcgtttgatatat

SEQ ID NO: 188460 - DNA, 14 bp, Unknown
  misc_feature (1)..( 14): Result.005 file - promoters50/4767379
aaccaatgatattc

SEQ ID NO: 188461 - DNA, 14 bp, Unknown
  misc_feature (1)..( 14): Result.005 file - promoters50/4767379
taacattgatataa

SEQ ID NO: 188462 - DNA, 14 bp, Unknown
  misc_feature (1)..( 14): Result.005 file - promoters50/4767379
gtttaatgaaattc

SEQ ID NO: 188463 - DNA, 14 bp, Unknown
  misc_feature (1)..( 14): Result.005 file - promoters50/4767379
taaaattaatattt

SEQ ID NO: 188464 - DNA, 14 bp, Unknown
  misc_feature (1)..( 14): Result.005 file - promoters50/4767379
caaaaataacagat

SEQ ID NO: 188465 - DNA, 14 bp, Unknown
  misc_feature (1)..( 14): Result.005 file - promoters50/4767379
ccaaaatgaaaaac

SEQ ID NO: 188466 - DNA, 9 bp, Unknown
  misc_feature (1)..( 9): Result.005 file - promoters50/4767379
atacatata

SEQ ID NO: 188467 - DNA, 9 bp, Unknown
  misc_feature (1)..( 9): Result.005 file - promoters50/4767379
gtacacata

SEQ ID NO: 188468 - DNA, 9 bp, Unknown
  misc_feature (1)..( 9): Result.005 file - promoters50/4767379
ataaataaa

SEQ ID NO: 188469 - DNA, 9 bp, Unknown
  misc_feature (1)..( 9): Result.005 file - promoters50/4767379
aaaaacaaa

SEQ ID NO: 188470 - DNA, 9 bp, Unknown
  misc_feature (1)..( 9): Result.005 file - promoters50/4767379
ttaaaaaaa

SEQ ID NO: 188471 - DNA, 9 bp, Unknown
  misc_feature (1)..( 9): Result.005 file - promoters50/4767379
tgaaaaaaa

SEQ ID NO: 188472 - DNA, 14 bp, Unknown
  misc_feature (1)..( 14): Result.005 file - promoters50/4767379
atactgtatgttta

SEQ ID NO: 188473 - DNA, 14 bp, Unknown
  misc_feature (1)..( 14): Result.005 file - promoters50/4767379
caaacaaatgtttg

SEQ ID NO: 188474 - DNA, 14 bp, Unknown
  misc_feature (1)..( 14): Result.005 file - promoters50/4767379
gaaaagaatgatta

SEQ ID NO: 188475 - DNA, 14 bp, Unknown
  misc_feature (1)..( 14): Result.005 file - promoters50/4767379
taaataaatttttg

SEQ ID NO: 188476 - DNA, 14 bp, Unknown
  misc_feature (1)..( 14): Result.005 file - promoters50/4767379
aaaacaaacgtgga

SEQ ID NO: 188477 - DNA, 14 bp, Unknown
  misc_feature (1)..( 14): Result.005 file - promoters50/4767379
taaaaaaagaagaa

SEQ ID NO: 188478 - DNA, 14 bp, Unknown
  misc_feature (1)..( 14): Result.005 file - promoters50/4767379
ttgatttctttttg

SEQ ID NO: 188479 - DNA, 10 bp, Unknown
  misc_feature (1)..( 10): Result.005 file - promoters50/4767379
ttaagaaaag

SEQ ID NO: 188480 - DNA, 10 bp, Unknown
  misc_feature (1)..( 10): Result.005 file - promoters50/4767379
agtagagaag

SEQ ID NO: 188481 - DNA, 10 bp, Unknown
  misc_feature (1)..( 10): Result.005 file - promoters50/4767379
ttaaaaaaag

SEQ ID NO: 188482 - DNA, 10 bp, Unknown
  misc_feature (1)..( 10): Result.005 file - promoters50/4767379
gtcaaacaaa

SEQ ID NO: 188483 - DNA, 10 bp, Unknown
  misc_feature (1)..( 10): Result.005 file - promoters50/4767379
tgaaaaaaaa

SEQ ID NO: 188484 - DNA, 10 bp, Unknown
  misc_feature (1)..( 10): Result.005 file - promoters50/4767379
gctaaccaat

SEQ ID NO: 188485 - DNA, 10 bp, Unknown
  misc_feature (1)..( 10): Result.005 file - promoters50/4767379
ataaataaat

SEQ ID NO: 188486 - DNA, 10 bp, Unknown
  misc_feature (1)..( 10): Result.005 file - promoters50/4767379
caaaatgaaa

SEQ ID NO: 188487 - DNA, 11 bp, Unknown
  misc_feature (1)..( 11): Result.005 file - promoters50/4767379
ataatgttaac

SEQ ID NO: 188488 - DNA, 11 bp, Unknown
  misc_feature (1)..( 11): Result.005 file - promoters50/4767379
atagtgtacgg

SEQ ID NO: 188489 - DNA, 11 bp, Unknown
  misc_feature (1)..( 11): Result.005 file - promoters50/4767379
taaattttaat

SEQ ID NO: 188490 - DNA, 11 bp, Unknown
  misc_feature (1)..( 11): Result.005 file - promoters50/4767379
agaatgtcaac

SEQ ID NO: 188491 - DNA, 11 bp, Unknown
  misc_feature (1)..( 11): Result.005 file - promoters50/4767379
ttaattttttc

SEQ ID NO: 188492 - DNA, 11 bp, Unknown
  misc_feature (1)..( 11): Result.005 file - promoters50/4767379
tcaatcaaaaa

SEQ ID NO: 188493 - DNA, 11 bp, Unknown
  misc_feature (1)..( 11): Result.005 file - promoters50/4767379
tctgtttcaca

SEQ ID NO: 188494 - DNA, 11 bp, Unknown
  misc_feature (1)..( 11): Result.005 file - promoters50/4767379
tctttttattt

SEQ ID NO: 188495 - DNA, 11 bp, Unknown
  misc_feature (1)..( 11): Result.005 file - promoters50/4767379
tttgtttaaca

SEQ ID NO: 188496 - DNA, 11 bp, Unknown
  misc_feature (1)..( 11): Result.005 file - promoters50/4767379
tttgtttctgg

SEQ ID NO: 188497 - DNA, 11 bp, Unknown
  misc_feature (1)..( 11): Result.005 file - promoters50/4767379
acggtttaagc

SEQ ID NO: 188498 - DNA, 11 bp, Unknown
  misc_feature (1)..( 11): Result.005 file - promoters50/4767379
taggtttaaga

SEQ ID NO: 188499 - DNA, 12 bp, Unknown
  misc_feature (1)..( 12): Result.005 file - promoters50/4767379
atacattgtagg

SEQ ID NO: 188500 - DNA, 12 bp, Unknown
  misc_feature (1)..( 12): Result.005 file - promoters50/4767379
taacattgatat

SEQ ID NO: 188501 - DNA, 12 bp, Unknown
  misc_feature (1)..( 12): Result.005 file - promoters50/4767379
taatatttcatt

SEQ ID NO: 188502 - DNA, 12 bp, Unknown
  misc_feature (1)..( 12): Result.005 file - promoters50/4767379
taaaattaatat

SEQ ID NO: 188503 - DNA, 12 bp, Unknown
  misc_feature (1)..( 12): Result.005 file - promoters50/4767379
caaaaataacag

SEQ ID NO: 188504 - DNA, 12 bp, Unknown
  misc_feature (1)..( 12): Result.005 file - promoters50/4767379
gaaaaataaata

SEQ ID NO: 188505 - DNA, 9 bp, Unknown
  misc_feature (1)..( 9): Result.005 file - promoters50/4767379
taaaatttc

SEQ ID NO: 188506 - DNA, 9 bp, Unknown
  misc_feature (1)..( 9): Result.005 file - promoters50/4767379
taaaatttc

SEQ ID NO: 188507 - DNA, 9 bp, Unknown
  misc_feature (1)..( 9): Result.005 file - promoters50/4767379
aaaaattaa

SEQ ID NO: 188508 - DNA, 9 bp, Unknown
  misc_feature (1)..( 9): Result.005 file - promoters50/4767379
caaaattaa

SEQ ID NO: 188509 - DNA, 10 bp, Unknown
  misc_feature (1)..( 10): Result.005 file - promoters50/4767379
aaaatattaa

SEQ ID NO: 188510 - DNA, 10 bp, Unknown
  misc_feature (1)..( 10): Result.005 file - promoters50/4767379
taacaattct

SEQ ID NO: 188511 - DNA, 10 bp, Unknown
  misc_feature (1)..( 10): Result.005 file - promoters50/4767379
ggagataata

SEQ ID NO: 188512 - DNA, 10 bp, Unknown
  misc_feature (1)..( 10): Result.005 file - promoters50/4767379
aaagaaaatt

SEQ ID NO: 188513 - DNA, 10 bp, Unknown
  misc_feature (1)..( 10): Result.005 file - promoters50/4767379
caataaaatt

SEQ ID NO: 188514 - DNA, 10 bp, Unknown
  misc_feature (1)..( 10): Result.005 file - promoters50/4767379
aaataaataa

SEQ ID NO: 188515 - DNA, 10 bp, Unknown
  misc_feature (1)..( 10): Result.005 file - promoters50/4767379
ttataaaata

SEQ ID NO: 188516 - DNA, 10 bp, Unknown
  misc_feature (1)..( 10): Result.005 file - promoters50/4767379
caaaaaaata

SEQ ID NO: 188517 - DNA, 10 bp, Unknown
  misc_feature (1)..( 10): Result.005 file - promoters50/4767379
aaaaataaca

SEQ ID NO: 188518 - DNA, 7 bp, Unknown
  misc_feature (1)..( 7): Result.005 file - promoters50/4767379
aaacaaa

SEQ ID NO: 188519 - DNA, 7 bp, Unknown
  misc_feature (1)..( 7): Result.005 file - promoters50/4767379
aaacaaa

SEQ ID NO: 188520 - DNA, 7 bp, Unknown
  misc_feature (1)..( 7): Result.005 file - promoters50/4767379
aaaaaaa

SEQ ID NO: 188521 - DNA, 7 bp, Unknown
  misc_feature (1)..( 7): Result.005 file - promoters50/4767379
aaaaaaa

SEQ ID NO: 188522 - DNA, 7 bp, Unknown
  misc_feature (1)..( 7): Result.005 file - promoters50/4767379
aaccaat

SEQ ID NO: 188523 - DNA, 7 bp, Unknown
  misc_feature (1)..( 7): Result.005 file - promoters50/4767379
aaataaa

SEQ ID NO: 188524 - DNA, 11 bp, Unknown
  misc_feature (1)..( 11): Result.005 file - promoters50/4767379
ccgttaaaaat

SEQ ID NO: 188525 - DNA, 11 bp, Unknown
  misc_feature (1)..( 11): Result.005 file - promoters50/4767379
aaattaaaatc

SEQ ID NO: 188526 - DNA, 11 bp, Unknown
  misc_feature (1)..( 11): Result.005 file - promoters50/4767379
actataaaaaa

SEQ ID NO: 188527 - DNA, 11 bp, Unknown
  misc_feature (1)..( 11): Result.005 file - promoters50/4767379
atcataaaatc

SEQ ID NO: 188528 - DNA, 11 bp, Unknown
  misc_feature (1)..( 11): Result.005 file - promoters50/4767379
tcattaaattc

SEQ ID NO: 188529 - DNA, 11 bp, Unknown
  misc_feature (1)..( 11): Result.005 file - promoters50/4767379
cccagaaaaaa

SEQ ID NO: 188530 - DNA, 12 bp, Unknown
  misc_feature (1)..( 12): Result.005 file - promoters50/4767379
tcaaacatataa

SEQ ID NO: 188531 - DNA, 12 bp, Unknown
  misc_feature (1)..( 12): Result.005 file - promoters50/4767379
tcaaacaataaa

SEQ ID NO: 188532 - DNA, 12 bp, Unknown
  misc_feature (1)..( 12): Result.005 file - promoters50/4767379
cgaaaaataaat

SEQ ID NO: 188533 - DNA, 12 bp, Unknown
  misc_feature (1)..( 12): Result.005 file - promoters50/4767379
aaaaaaatataa

SEQ ID NO: 188534 - DNA, 12 bp, Unknown
  misc_feature (1)..( 12): Result.005 file - promoters50/4767379
tcaaaaataaca

SEQ ID NO: 188535 - DNA, 12 bp, Unknown
  misc_feature (1)..( 12): Result.005 file - promoters50/4767379
tataaaatacag

SEQ ID NO: 188536 - DNA, 8 bp, Unknown
  misc_feature (1)..( 8): Result.005 file - promoters50/4767395
atcaatgt

SEQ ID NO: 188537 - DNA, 8 bp, Unknown
  misc_feature (1)..( 8): Result.005 file - promoters50/4767395
atcaataa

SEQ ID NO: 188538 - DNA, 8 bp, Unknown
  misc_feature (1)..( 8): Result.005 file - promoters50/4767395
ttcaataa

SEQ ID NO: 188539 - DNA, 7 bp, Unknown
  misc_feature (1)..( 7): Result.005 file - promoters50/4767410
tatgaaa

SEQ ID NO: 188540 - DNA, 7 bp, Unknown
  misc_feature (1)..( 7): Result.005 file - promoters50/4767410
tatgaaa

SEQ ID NO: 188541 - DNA, 7 bp, Unknown
  misc_feature (1)..( 7): Result.005 file - promoters50/4767410
tattaaa

SEQ ID NO: 188542 - DNA, 8 bp, Unknown
  misc_feature (1)..( 8): Result.005 file - promoters50/4767410
agttaaag

SEQ ID NO: 188543 - DNA, 8 bp, Unknown
  misc_feature (1)..( 8): Result.005 file - promoters50/4767410
tgttaaag

SEQ ID NO: 188544 - DNA, 8 bp, Unknown
  misc_feature (1)..( 8): Result.005 file - promoters50/4767410
agtaaaaa

SEQ ID NO: 188545 - DNA, 9 bp, Unknown
  misc_feature (1)..( 9): Result.005 file - promoters50/4767410
ggttttgtt

SEQ ID NO: 188546 - DNA, 9 bp, Unknown
  misc_feature (1)..( 9): Result.005 file - promoters50/4767410
ggatttgtt

SEQ ID NO: 188547 - DNA, 9 bp, Unknown
  misc_feature (1)..( 9): Result.005 file - promoters50/4767410
ggacttgtg

SEQ ID NO: 188548 - DNA, 12 bp, Unknown
  misc_feature (1)..( 12): Result.005 file - promoters50/4767452
caaaaacctctg

SEQ ID NO: 188549 - DNA, 12 bp, Unknown
  misc_feature (1)..( 12): Result.005 file - promoters50/4767452
caaaaagacggc

SEQ ID NO: 188550 - DNA, 12 bp, Unknown
  misc_feature (1)..( 12): Result.005 file - promoters50/4767452
aaaaaaaaaaaa

SEQ ID NO: 188551 - DNA, 12 bp, Unknown
  misc_feature (1)..( 12): Result.005 file - promoters50/4767452
gaaaaagatatg

SEQ ID NO: 188552 - DNA, 10 bp, Unknown
  misc_feature (1)..( 10): Result.005 file - promoters50/4767487
attaattttt

SEQ ID NO: 188553 - DNA, 10 bp, Unknown
  misc_feature (1)..( 10): Result.005 file - promoters50/4767487
cataaatttg

SEQ ID NO: 188554 - DNA, 10 bp, Unknown
  misc_feature (1)..( 10): Result.005 file - promoters50/4767487
gttaattgtc

SEQ ID NO: 188555 - DNA, 10 bp, Unknown
  misc_feature (1)..( 10): Result.005 file - promoters50/4767487
atttatttat

SEQ ID NO: 188556 - DNA, 10 bp, Unknown
  misc_feature (1)..( 10): Result.005 file - promoters50/4767487
atatatttaa

SEQ ID NO: 188557 - DNA, 10 bp, Unknown
  misc_feature (1)..( 10): Result.005 file - promoters50/4767487
ccaaaattga

SEQ ID NO: 188558 - DNA, 10 bp, Unknown
  misc_feature (1)..( 10): Result.005 file - promoters50/4767487
atatatgtaa

SEQ ID NO: 188559 - DNA, 10 bp, Unknown
  misc_feature (1)..( 10): Result.005 file - promoters50/4767487
ccattttaga

SEQ ID NO: 188560 - DNA, 10 bp, Unknown
  misc_feature (1)..( 10): Result.005 file - promoters50/4767487
ctattttatt

SEQ ID NO: 188561 - DNA, 10 bp, Unknown
  misc_feature (1)..( 10): Result.005 file - promoters50/4767487
gcattttctt

SEQ ID NO: 188562 - DNA, 10 bp, Unknown
  misc_feature (1)..( 10): Result.005 file - promoters50/4767487
tttttttagt

SEQ ID NO: 188563 - DNA, 10 bp, Unknown
  misc_feature (1)..( 10): Result.005 file - promoters50/4767487
ccattttccc

SEQ ID NO: 188564 - DNA, 10 bp, Unknown
  misc_feature (1)..( 10): Result.005 file - promoters50/4767487
aaatttaatt

SEQ ID NO: 188565 - DNA, 10 bp, Unknown
  misc_feature (1)..( 10): Result.005 file - promoters50/4767490
acaagattaa

SEQ ID NO: 188566 - DNA, 10 bp, Unknown
  misc_feature (1)..( 10): Result.005 file - promoters50/4767490
taaagtttaa

SEQ ID NO: 188567 - DNA, 10 bp, Unknown
  misc_feature (1)..( 10): Result.005 file - promoters50/4767490
taaacttttt

SEQ ID NO: 188568 - DNA, 10 bp, Unknown
  misc_feature (1)..( 10): Result.005 file - promoters50/4767490
taaatttttt

SEQ ID NO: 188569 - DNA, 13 bp, Unknown
  misc_feature (1)..( 13): Result.005 file - promoters50/4767490
agtcatatttatt

SEQ ID NO: 188570 - DNA, 13 bp, Unknown
  misc_feature (1)..( 13): Result.005 file - promoters50/4767490
actcatatttgaa

SEQ ID NO: 188571 - DNA, 13 bp, Unknown
  misc_feature (1)..( 13): Result.005 file - promoters50/4767490
tcaaatatatatt

SEQ ID NO: 188572 - DNA, 13 bp, Unknown
  misc_feature (1)..( 13): Result.005 file - promoters50/4767490
agtgataaaagaa

SEQ ID NO: 188573 - DNA, 11 bp, Unknown
  misc_feature (1)..( 11): Result.005 file - promoters50/4767490
ctggttttgaa

SEQ ID NO: 188574 - DNA, 11 bp, Unknown
  misc_feature (1)..( 11): Result.005 file - promoters50/4767490
ccggttttttt

SEQ ID NO: 188575 - DNA, 11 bp, Unknown
  misc_feature (1)..( 11): Result.005 file - promoters50/4767490
attgttttttt

SEQ ID NO: 188576 - DNA, 11 bp, Unknown
  misc_feature (1)..( 11): Result.005 file - promoters50/4767490
tgtgtttttaa

SEQ ID NO: 188577 - DNA, 10 bp, Unknown
  misc_feature (1)..( 10): Result.005 file - promoters50/4767490
ttttgaaaaa

SEQ ID NO: 188578 - DNA, 10 bp, Unknown
  misc_feature (1)..( 10): Result.005 file - promoters50/4767490
ttttgacact

SEQ ID NO: 188579 - DNA, 10 bp, Unknown
  misc_feature (1)..( 10): Result.005 file - promoters50/4767490
ttttgaaact

SEQ ID NO: 188580 - DNA, 10 bp, Unknown
  misc_feature (1)..( 10): Result.005 file - promoters50/4767490
atttaacact

SEQ ID NO: 188581 - DNA, 6 bp, Unknown
  misc_feature (1)..( 6): Result.005 file - promoters50/4767509
atcaac

SEQ ID NO: 188582 - DNA, 6 bp, Unknown
  misc_feature (1)..( 6): Result.005 file - promoters50/4767509
atcaac

SEQ ID NO: 188583 - DNA, 6 bp, Unknown
  misc_feature (1)..( 6): Result.005 file - promoters50/4767509
atcaac

SEQ ID NO: 188584 - DNA, 11 bp, Unknown
  misc_feature (1)..( 11): Result.005 file - promoters50/4767509
tcaaatatata

SEQ ID NO: 188585 - DNA, 11 bp, Unknown
  misc_feature (1)..( 11): Result.005 file - promoters50/4767509
tataatataat

SEQ ID NO: 188586 - DNA, 11 bp, Unknown
  misc_feature (1)..( 11): Result.005 file - promoters50/4767509
tatcatataat

SEQ ID NO: 188587 - DNA, 11 bp, Unknown
  misc_feature (1)..( 11): Result.005 file - promoters50/4767515
tttgatttttg

SEQ ID NO: 188588 - DNA, 11 bp, Unknown
  misc_feature (1)..( 11): Result.005 file - promoters50/4767515
attgattgcta

SEQ ID NO: 188589 - DNA, 12 bp, Unknown
  misc_feature (1)..( 12): Result.005 file - promoters50/4767515
tgctgatgtttg

SEQ ID NO: 188590 - DNA, 12 bp, Unknown
  misc_feature (1)..( 12): Result.005 file - promoters50/4767515
gttggatagctt

SEQ ID NO: 188591 - DNA, 12 bp, Unknown
  misc_feature (1)..( 12): Result.005 file - promoters50/4767515
tggcgcttatga

SEQ ID NO: 188592 - DNA, 12 bp, Unknown
  misc_feature (1)..( 12): Result.005 file - promoters50/4767515
tcgagatgggaa

SEQ ID NO: 188593 - DNA, 13 bp, Unknown
  misc_feature (1)..( 13): Result.005 file - promoters50/4767515
tcaactaaacaag

SEQ ID NO: 188594 - DNA, 13 bp, Unknown
  misc_feature (1)..( 13): Result.005 file - promoters50/4767515
ttaacaaaacaat

SEQ ID NO: 188595 - DNA, 13 bp, Unknown
  misc_feature (1)..( 13): Result.005 file - promoters50/4767515
tttttaaaacacc

SEQ ID NO: 188596 - DNA, 13 bp, Unknown
  misc_feature (1)..( 13): Result.005 file - promoters50/4767515
atctcaaaatacc

SEQ ID NO: 188597 - DNA, 13 bp, Unknown
  misc_feature (1)..( 13): Result.005 file - promoters50/4767515
tgaacaaatatat

SEQ ID NO: 188598 - DNA, 13 bp, Unknown
  misc_feature (1)..( 13): Result.005 file - promoters50/4767515
ttatcaatgggat

SEQ ID NO: 188599 - DNA, 13 bp, Unknown
  misc_feature (1)..( 13): Result.005 file - promoters50/4767515
gattatcaataat

SEQ ID NO: 188600 - DNA, 13 bp, Unknown
  misc_feature (1)..( 13): Result.005 file - promoters50/4767515
ctatttcaaaaat

SEQ ID NO: 188601 - DNA, 13 bp, Unknown
  misc_feature (1)..( 13): Result.005 file - promoters50/4767515
tcgtatcataaag

SEQ ID NO: 188602 - DNA, 13 bp, Unknown
  misc_feature (1)..( 13): Result.005 file - promoters50/4767515
agaaaaaaaaaat

SEQ ID NO: 188603 - DNA, 13 bp, Unknown
  misc_feature (1)..( 13): Result.005 file - promoters50/4767515
tatatataaaaat

SEQ ID NO: 188604 - DNA, 13 bp, Unknown
  misc_feature (1)..( 13): Result.005 file - promoters50/4767515
ctagttcaaagat

SEQ ID NO: 188605 - DNA, 7 bp, Unknown
  misc_feature (1)..( 7): Result.005 file - promoters50/4767519
aagttat

SEQ ID NO: 188606 - DNA, 7 bp, Unknown
  misc_feature (1)..( 7): Result.005 file - promoters50/4767519
aagatat

SEQ ID NO: 188607 - DNA, 7 bp, Unknown
  misc_feature (1)..( 7): Result.005 file - promoters50/4767519
gatttat

SEQ ID NO: 188608 - DNA, 11 bp, Unknown
  misc_feature (1)..( 11): Result.005 file - promoters50/4767519
ttaggtatatg

SEQ ID NO: 188609 - DNA, 11 bp, Unknown
  misc_feature (1)..( 11): Result.005 file - promoters50/4767519
ataattatatg

SEQ ID NO: 188610 - DNA, 11 bp, Unknown
  misc_feature (1)..( 11): Result.005 file - promoters50/4767519
ataattttata

SEQ ID NO: 188611 - DNA, 7 bp, Unknown
  misc_feature (1)..( 7): Result.005 file - promoters50/4767519
tagaaac

SEQ ID NO: 188612 - DNA, 7 bp, Unknown
  misc_feature (1)..( 7): Result.005 file - promoters50/4767519
tagaaac

SEQ ID NO: 188613 - DNA, 7 bp, Unknown
  misc_feature (1)..( 7): Result.005 file - promoters50/4767519
aagaaac

SEQ ID NO: 188614 - DNA, 7 bp, Unknown
  misc_feature (1)..( 7): Result.005 file - promoters50/4767519
aaataaa

SEQ ID NO: 188615 - DNA, 7 bp, Unknown
  misc_feature (1)..( 7): Result.005 file - promoters50/4767519
aaataat

SEQ ID NO: 188616 - DNA, 7 bp, Unknown
  misc_feature (1)..( 7): Result.005 file - promoters50/4767519
aaataaa

SEQ ID NO: 188617 - DNA, 7 bp, Unknown
  misc_feature (1)..( 7): Result.005 file - promoters50/4767519
aaaaatt

SEQ ID NO: 188618 - DNA, 7 bp, Unknown
  misc_feature (1)..( 7): Result.005 file - promoters50/4767519
aaacatt

SEQ ID NO: 188619 - DNA, 8 bp, Unknown
  misc_feature (1)..( 8): Result.005 file - promoters50/4767519
aaatcata

SEQ ID NO: 188620 - DNA, 7 bp, Unknown
  misc_feature (1)..( 7): Result.005 file - promoters50/4767519
cgaaact

SEQ ID NO: 188621 - DNA, 7 bp, Unknown
  misc_feature (1)..( 7): Result.005 file - promoters50/4767519
agaaact

SEQ ID NO: 188622 - DNA, 7 bp, Unknown
  misc_feature (1)..( 7): Result.005 file - promoters50/4767519
agagact

SEQ ID NO: 188623 - DNA, 11 bp, Unknown
  misc_feature (1)..( 11): Result.005 file - promoters50/4767519
aaacactatat

SEQ ID NO: 188624 - DNA, 11 bp, Unknown
  misc_feature (1)..( 11): Result.005 file - promoters50/4767519
taacactttat

SEQ ID NO: 188625 - DNA, 11 bp, Unknown
  misc_feature (1)..( 11): Result.005 file - promoters50/4767519
aaacacacgta

SEQ ID NO: 188626 - DNA, 8 bp, Unknown
  misc_feature (1)..( 8): Result.005 file - promoters50/4767519
atttcaat

SEQ ID NO: 188627 - DNA, 8 bp, Unknown
  misc_feature (1)..( 8): Result.005 file - promoters50/4767519
atttaaat

SEQ ID NO: 188628 - DNA, 8 bp, Unknown
  misc_feature (1)..( 8): Result.005 file - promoters50/4767519
gtttaaat

SEQ ID NO: 188629 - DNA, 10 bp, Unknown
  misc_feature (1)..( 10): Result.005 file - promoters50/4767519
atttaaggtt

SEQ ID NO: 188630 - DNA, 10 bp, Unknown
  misc_feature (1)..( 10): Result.005 file - promoters50/4767519
atttaagaaa

SEQ ID NO: 188631 - DNA, 10 bp, Unknown
  misc_feature (1)..( 10): Result.005 file - promoters50/4767519
ccttaagaaa

SEQ ID NO: 188632 - DNA, 8 bp, Unknown
  misc_feature (1)..( 8): Result.005 file - promoters50/4767519
gtcatttt

SEQ ID NO: 188633 - DNA, 8 bp, Unknown
  misc_feature (1)..( 8): Result.005 file - promoters50/4767519
aacatttt

SEQ ID NO: 188634 - DNA, 8 bp, Unknown
  misc_feature (1)..( 8): Result.005 file - promoters50/4767519
aacacttt

SEQ ID NO: 188635 - DNA, 11 bp, Unknown
  misc_feature (1)..( 11): Result.005 file - promoters50/4767539
cgtctctgcag

SEQ ID NO: 188636 - DNA, 11 bp, Unknown
  misc_feature (1)..( 11): Result.005 file - promoters50/4767539
tatctctgcag

SEQ ID NO: 188637 - DNA, 11 bp, Unknown
  misc_feature (1)..( 11): Result.005 file - promoters50/4767539
actctttgctc

SEQ ID NO: 188638 - DNA, 11 bp, Unknown
  misc_feature (1)..( 11): Result.005 file - promoters50/4767539
gatctctttgg

SEQ ID NO: 188639 - DNA, 11 bp, Unknown
  misc_feature (1)..( 11): Result.005 file - promoters50/4767539
tttcttttttt

SEQ ID NO: 188640 - DNA, 11 bp, Unknown
  misc_feature (1)..( 11): Result.005 file - promoters50/4767539
tatcactgcac

SEQ ID NO: 188641 - DNA, 10 bp, Unknown
  misc_feature (1)..( 10): Result.005 file - promoters50/4767539
aataatactg

SEQ ID NO: 188642 - DNA, 10 bp, Unknown
  misc_feature (1)..( 10): Result.005 file - promoters50/4767539
tttaaaactc

SEQ ID NO: 188643 - DNA, 10 bp, Unknown
  misc_feature (1)..( 10): Result.005 file - promoters50/4767539
tataatagat

SEQ ID NO: 188644 - DNA, 10 bp, Unknown
  misc_feature (1)..( 10): Result.005 file - promoters50/4767539
cttaaatctc

SEQ ID NO: 188645 - DNA, 10 bp, Unknown
  misc_feature (1)..( 10): Result.005 file - promoters50/4767539
tataattttt

SEQ ID NO: 188646 - DNA, 10 bp, Unknown
  misc_feature (1)..( 10): Result.005 file - promoters50/4767539
taaaaatctg

SEQ ID NO: 188647 - DNA, 15 bp, Unknown
  misc_feature (1)..( 15): Result.005 file - promoters50/4767539
tagatcttggttaat

SEQ ID NO: 188648 - DNA, 15 bp, Unknown
  misc_feature (1)..( 15): Result.005 file - promoters50/4767539
gagatctacatgtaa

SEQ ID NO: 188649 - DNA, 15 bp, Unknown
  misc_feature (1)..( 15): Result.005 file - promoters50/4767539
tcgatctatcaccac

SEQ ID NO: 188650 - DNA, 15 bp, Unknown
  misc_feature (1)..( 15): Result.005 file - promoters50/4767539
tcggtcttcctacga

SEQ ID NO: 188651 - DNA, 15 bp, Unknown
  misc_feature (1)..( 15): Result.005 file - promoters50/4767539
atgatatattttagt

SEQ ID NO: 188652 - DNA, 15 bp, Unknown
  misc_feature (1)..( 15): Result.005 file - promoters50/4767539
actgtatttttgagt

SEQ ID NO: 188653 - DNA, 11 bp, Unknown
  misc_feature (1)..( 11): Result.005 file - promoters50/4767545
ctttctttaaa

SEQ ID NO: 188654 - DNA, 11 bp, Unknown
  misc_feature (1)..( 11): Result.005 file - promoters50/4767545
ctttcttcgta

SEQ ID NO: 188655 - DNA, 11 bp, Unknown
  misc_feature (1)..( 11): Result.005 file - promoters50/4767545
ttttcttgaaa

SEQ ID NO: 188656 - DNA, 11 bp, Unknown
  misc_feature (1)..( 11): Result.005 file - promoters50/4767545
cttcctttgat

SEQ ID NO: 188657 - DNA, 10 bp, Unknown
  misc_feature (1)..( 10): Result.005 file - promoters50/4767545
aaaaaataaa

SEQ ID NO: 188658 - DNA, 10 bp, Unknown
  misc_feature (1)..( 10): Result.005 file - promoters50/4767545
ggaaattaaa

SEQ ID NO: 188659 - DNA, 10 bp, Unknown
  misc_feature (1)..( 10): Result.005 file - promoters50/4767545
taaaaatatt

SEQ ID NO: 188660 - DNA, 10 bp, Unknown
  misc_feature (1)..( 10): Result.005 file - promoters50/4767545
taataataat

SEQ ID NO: 188661 - DNA, 10 bp, Unknown
  misc_feature (1)..( 10): Result.005 file - promoters50/4767545
aaataataat

SEQ ID NO: 188662 - DNA, 10 bp, Unknown
  misc_feature (1)..( 10): Result.005 file - promoters50/4767545
aaataaattt

SEQ ID NO: 188663 - DNA, 10 bp, Unknown
  misc_feature (1)..( 10): Result.005 file - promoters50/4767545
taataataat

SEQ ID NO: 188664 - DNA, 10 bp, Unknown
  misc_feature (1)..( 10): Result.005 file - promoters50/4767545
aaataatttt

SEQ ID NO: 188665 - DNA, 13 bp, Unknown
  misc_feature (1)..( 13): Result.005 file - promoters50/4767545
atttataaattta

SEQ ID NO: 188666 - DNA, 13 bp, Unknown
  misc_feature (1)..( 13): Result.005 file - promoters50/4767545
aaaaataatttta

SEQ ID NO: 188667 - DNA, 13 bp, Unknown
  misc_feature (1)..( 13): Result.005 file - promoters50/4767545
aaaactaattaaa

SEQ ID NO: 188668 - DNA, 13 bp, Unknown
  misc_feature (1)..( 13): Result.005 file - promoters50/4767545
aataataataata

SEQ ID NO: 188669 - DNA, 7 bp, Unknown
  misc_feature (1)..( 7): Result.005 file - promoters50/4767552
agagata

SEQ ID NO: 188670 - DNA, 7 bp, Unknown
  misc_feature (1)..( 7): Result.005 file - promoters50/4767552
agaaata

SEQ ID NO: 188671 - DNA, 7 bp, Unknown
  misc_feature (1)..( 7): Result.005 file - promoters50/4767552
agatatt

SEQ ID NO: 188672 - DNA, 9 bp, Unknown
  misc_feature (1)..( 9): Result.005 file - promoters50/4767574
agaatgatt

SEQ ID NO: 188673 - DNA, 9 bp, Unknown
  misc_feature (1)..( 9): Result.005 file - promoters50/4767574
ggaattatt

SEQ ID NO: 188674 - DNA, 9 bp, Unknown
  misc_feature (1)..( 9): Result.005 file - promoters50/4767574
agattgata

SEQ ID NO: 188675 - DNA, 8 bp, Unknown
  misc_feature (1)..( 8): Result.005 file - promoters50/4767574
tgacattg

SEQ ID NO: 188676 - DNA, 8 bp, Unknown
  misc_feature (1)..( 8): Result.005 file - promoters50/4767574
tgatattg

SEQ ID NO: 188677 - DNA, 8 bp, Unknown
  misc_feature (1)..( 8): Result.005 file - promoters50/4767574
gcatattg

SEQ ID NO: 188678 - DNA, 10 bp, Unknown
  misc_feature (1)..( 10): Result.005 file - promoters50/4767574
taacattctt

SEQ ID NO: 188679 - DNA, 10 bp, Unknown
  misc_feature (1)..( 10): Result.005 file - promoters50/4767574
agacaatctt

SEQ ID NO: 188680 - DNA, 10 bp, Unknown
  misc_feature (1)..( 10): Result.005 file - promoters50/4767574
agaaaatatc

SEQ ID NO: 188681 - DNA, 8 bp, Unknown
  misc_feature (1)..( 8): Result.005 file - promoters50/4767574
ggatttaa

SEQ ID NO: 188682 - DNA, 8 bp, Unknown
  misc_feature (1)..( 8): Result.005 file - promoters50/4767574
agatataa

SEQ ID NO: 188683 - DNA, 8 bp, Unknown
  misc_feature (1)..( 8): Result.005 file - promoters50/4767574
agatatga

SEQ ID NO: 188684 - DNA, 11 bp, Unknown
  misc_feature (1)..( 11): Result.005 file - promoters50/4767574
ttgctgtagaa

SEQ ID NO: 188685 - DNA, 11 bp, Unknown
  misc_feature (1)..( 11): Result.005 file - promoters50/4767574
ttgatgtaggg

SEQ ID NO: 188686 - DNA, 11 bp, Unknown
  misc_feature (1)..( 11): Result.005 file - promoters50/4767574
tatttgtagct

SEQ ID NO: 188687 - DNA, 10 bp, Unknown
  misc_feature (1)..( 10): Result.005 file - promoters50/4767578
gattttatct

SEQ ID NO: 188688 - DNA, 10 bp, Unknown
  misc_feature (1)..( 10): Result.005 file - promoters50/4767578
taatttatct

SEQ ID NO: 188689 - DNA, 10 bp, Unknown
  misc_feature (1)..( 10): Result.005 file - promoters50/4767578
taatgtatac

SEQ ID NO: 188690 - DNA, 11 bp, Unknown
  misc_feature (1)..( 11): Result.005 file - promoters50/4767578
aacaaaataca

SEQ ID NO: 188691 - DNA, 11 bp, Unknown
  misc_feature (1)..( 11): Result.005 file - promoters50/4767578
aacaaaatgta

SEQ ID NO: 188692 - DNA, 11 bp, Unknown
  misc_feature (1)..( 11): Result.005 file - promoters50/4767578
atgtaaattgt

SEQ ID NO: 188693 - DNA, 10 bp, Unknown
  misc_feature (1)..( 10): Result.005 file - promoters50/4767586
aaagttaatt

SEQ ID NO: 188694 - DNA, 10 bp, Unknown
  misc_feature (1)..( 10): Result.005 file - promoters50/4767586
aaatttaata

SEQ ID NO: 188695 - DNA, 10 bp, Unknown
  misc_feature (1)..( 10): Result.005 file - promoters50/4767586
tatttttata

SEQ ID NO: 188696 - DNA, 6 bp, Unknown
  misc_feature (1)..( 6): Result.005 file - promoters50/4767586
atataa

SEQ ID NO: 188697 - DNA, 6 bp, Unknown
  misc_feature (1)..( 6): Result.005 file - promoters50/4767586
atataa

SEQ ID NO: 188698 - DNA, 6 bp, Unknown
  misc_feature (1)..( 6): Result.005 file - promoters50/4767586
atataa

SEQ ID NO: 188699 - DNA, 7 bp, Unknown
  misc_feature (1)..( 7): Result.005 file - promoters50/4767588
ttggttc

SEQ ID NO: 188700 - DNA, 7 bp, Unknown
  misc_feature (1)..( 7): Result.005 file - promoters50/4767588
ttgtttc

SEQ ID NO: 188701 - DNA, 7 bp, Unknown
  misc_feature (1)..( 7): Result.005 file - promoters50/4767588
ttgtttg

SEQ ID NO: 188702 - DNA, 8 bp, Unknown
  misc_feature (1)..( 8): Result.005 file - promoters50/4767610
tattttaa

SEQ ID NO: 188703 - DNA, 8 bp, Unknown
  misc_feature (1)..( 8): Result.005 file - promoters50/4767610
tattttat

SEQ ID NO: 188704 - DNA, 8 bp, Unknown
  misc_feature (1)..( 8): Result.005 file - promoters50/4767610
tatcttaa

SEQ ID NO: 188705 - DNA, 8 bp, Unknown
  misc_feature (1)..( 8): Result.005 file - promoters50/4767610
cttaatta

SEQ ID NO: 188706 - DNA, 8 bp, Unknown
  misc_feature (1)..( 8): Result.005 file - promoters50/4767610
cttgattt

SEQ ID NO: 188707 - DNA, 8 bp, Unknown
  misc_feature (1)..( 8): Result.005 file - promoters50/4767610
ataaatat

SEQ ID NO: 188708 - DNA, 8 bp, Unknown
  misc_feature (1)..( 8): Result.005 file - promoters50/4767617
attcaatt

SEQ ID NO: 188709 - DNA, 8 bp, Unknown
  misc_feature (1)..( 8): Result.005 file - promoters50/4767617
attaaata

SEQ ID NO: 188710 - DNA, 8 bp, Unknown
  misc_feature (1)..( 8): Result.005 file - promoters50/4767617
attacata

SEQ ID NO: 188711 - DNA, 10 bp, Unknown
  misc_feature (1)..( 10): Result.005 file - promoters50/4767638
attttttaat

SEQ ID NO: 188712 - DNA, 10 bp, Unknown
  misc_feature (1)..( 10): Result.005 file - promoters50/4767638
ttttgttatt

SEQ ID NO: 188713 - DNA, 10 bp, Unknown
  misc_feature (1)..( 10): Result.005 file - promoters50/4767638
attctttctt

SEQ ID NO: 188714 - DNA, 10 bp, Unknown
  misc_feature (1)..( 10): Result.005 file - promoters50/4767638
atttttttaa

SEQ ID NO: 188715 - DNA, 10 bp, Unknown
  misc_feature (1)..( 10): Result.005 file - promoters50/4767638
tttctttaac

SEQ ID NO: 188716 - DNA, 10 bp, Unknown
  misc_feature (1)..( 10): Result.005 file - promoters50/4767638
tttctttctt

SEQ ID NO: 188717 - DNA, 11 bp, Unknown
  misc_feature (1)..( 11): Result.005 file - promoters50/4767638
gttatgattga

SEQ ID NO: 188718 - DNA, 11 bp, Unknown
  misc_feature (1)..( 11): Result.005 file - promoters50/4767638
gttatgataaa

SEQ ID NO: 188719 - DNA, 11 bp, Unknown
  misc_feature (1)..( 11): Result.005 file - promoters50/4767638
attataattag

SEQ ID NO: 188720 - DNA, 11 bp, Unknown
  misc_feature (1)..( 11): Result.005 file - promoters50/4767638
ctcataaatag

SEQ ID NO: 188721 - DNA, 11 bp, Unknown
  misc_feature (1)..( 11): Result.005 file - promoters50/4767638
atcataaataa

SEQ ID NO: 188722 - DNA, 11 bp, Unknown
  misc_feature (1)..( 11): Result.005 file - promoters50/4767638
tagataattaa

SEQ ID NO: 188723 - DNA, 10 bp, Unknown
  misc_feature (1)..( 10): Result.005 file - promoters50/4767638
aataaaaaaa

SEQ ID NO: 188724 - DNA, 10 bp, Unknown
  misc_feature (1)..( 10): Result.005 file - promoters50/4767638
gataaaatac

SEQ ID NO: 188725 - DNA, 10 bp, Unknown
  misc_feature (1)..( 10): Result.005 file - promoters50/4767638
agtaaaaaaa

SEQ ID NO: 188726 - DNA, 10 bp, Unknown
  misc_feature (1)..( 10): Result.005 file - promoters50/4767638
aataaaacat

SEQ ID NO: 188727 - DNA, 10 bp, Unknown
  misc_feature (1)..( 10): Result.005 file - promoters50/4767638
aataaaaaaa

SEQ ID NO: 188728 - DNA, 11 bp, Unknown
  misc_feature (1)..( 11): Result.005 file - promoters50/4767663
ataataagtaa

SEQ ID NO: 188729 - DNA, 11 bp, Unknown
  misc_feature (1)..( 11): Result.005 file - promoters50/4767663
aacataagttt

SEQ ID NO: 188730 - DNA, 11 bp, Unknown
  misc_feature (1)..( 11): Result.005 file - promoters50/4767663
taaataataaa

SEQ ID NO: 188731 - DNA, 11 bp, Unknown
  misc_feature (1)..( 11): Result.005 file - promoters50/4767663
gtcataaattt

SEQ ID NO: 188732 - DNA, 11 bp, Unknown
  misc_feature (1)..( 11): Result.005 file - promoters50/4767663
ccaatgataca

SEQ ID NO: 188733 - DNA, 11 bp, Unknown
  misc_feature (1)..( 11): Result.005 file - promoters50/4767663
agaatactaaa

SEQ ID NO: 188734 - DNA, 9 bp, Unknown
  misc_feature (1)..( 9): Result.005 file - promoters50/4767663
aaaatgata

SEQ ID NO: 188735 - DNA, 9 bp, Unknown
  misc_feature (1)..( 9): Result.005 file - promoters50/4767663
aaaataata

SEQ ID NO: 188736 - DNA, 9 bp, Unknown
  misc_feature (1)..( 9): Result.005 file - promoters50/4767663
aaaatgctc

SEQ ID NO: 188737 - DNA, 9 bp, Unknown
  misc_feature (1)..( 9): Result.005 file - promoters50/4767663
caaacaatg

SEQ ID NO: 188738 - DNA, 9 bp, Unknown
  misc_feature (1)..( 9): Result.005 file - promoters50/4767663
caaatcata

SEQ ID NO: 188739 - DNA, 9 bp, Unknown
  misc_feature (1)..( 9): Result.005 file - promoters50/4767663
taaatcaaa

SEQ ID NO: 188740 - DNA, 11 bp, Unknown
  misc_feature (1)..( 11): Result.005 file - promoters50/4767663
acaaatgaaaa

SEQ ID NO: 188741 - DNA, 11 bp, Unknown
  misc_feature (1)..( 11): Result.005 file - promoters50/4767663
ataaatgatag

SEQ ID NO: 188742 - DNA, 11 bp, Unknown
  misc_feature (1)..( 11): Result.005 file - promoters50/4767663
ctaaatcaaac

SEQ ID NO: 188743 - DNA, 11 bp, Unknown
  misc_feature (1)..( 11): Result.005 file - promoters50/4767663
aagaattaaac

SEQ ID NO: 188744 - DNA, 11 bp, Unknown
  misc_feature (1)..( 11): Result.005 file - promoters50/4767663
ataagcccata

SEQ ID NO: 188745 - DNA, 11 bp, Unknown
  misc_feature (1)..( 11): Result.005 file - promoters50/4767663
ttaaactctac

SEQ ID NO: 188746 - DNA, 11 bp, Unknown
  misc_feature (1)..( 11): Result.005 file - promoters50/4767663
ttacaccaaat

SEQ ID NO: 188747 - DNA, 11 bp, Unknown
  misc_feature (1)..( 11): Result.005 file - promoters50/4767663
gtatatatata

SEQ ID NO: 188748 - DNA, 11 bp, Unknown
  misc_feature (1)..( 11): Result.005 file - promoters50/4767663
ttatatataac

SEQ ID NO: 188749 - DNA, 11 bp, Unknown
  misc_feature (1)..( 11): Result.005 file - promoters50/4767663
atatatataac

SEQ ID NO: 188750 - DNA, 11 bp, Unknown
  misc_feature (1)..( 11): Result.005 file - promoters50/4767663
atatatttata

SEQ ID NO: 188751 - DNA, 11 bp, Unknown
  misc_feature (1)..( 11): Result.005 file - promoters50/4767663
ttatatataaa

SEQ ID NO: 188752 - DNA, 11 bp, Unknown
  misc_feature (1)..( 11): Result.005 file - promoters50/4767663
atataaataac

SEQ ID NO: 188753 - DNA, 11 bp, Unknown
  misc_feature (1)..( 11): Result.005 file - promoters50/4767663
gtatatatact

SEQ ID NO: 188754 - DNA, 10 bp, Unknown
  misc_feature (1)..( 10): Result.005 file - promoters50/4767663
attgcatttc

SEQ ID NO: 188755 - DNA, 10 bp, Unknown
  misc_feature (1)..( 10): Result.005 file - promoters50/4767663
tttgaatttt

SEQ ID NO: 188756 - DNA, 10 bp, Unknown
  misc_feature (1)..( 10): Result.005 file - promoters50/4767663
ttttaatttg

SEQ ID NO: 188757 - DNA, 10 bp, Unknown
  misc_feature (1)..( 10): Result.005 file - promoters50/4767663
atttaattaa

SEQ ID NO: 188758 - DNA, 10 bp, Unknown
  misc_feature (1)..( 10): Result.005 file - promoters50/4767663
tttaaattac

SEQ ID NO: 188759 - DNA, 11 bp, Unknown
  misc_feature (1)..( 11): Result.005 file - promoters50/4767663
ctgtaatgttc

SEQ ID NO: 188760 - DNA, 12 bp, Unknown
  misc_feature (1)..( 12): Result.005 file - promoters50/4767663
cgaattatatgt

SEQ ID NO: 188761 - DNA, 12 bp, Unknown
  misc_feature (1)..( 12): Result.005 file - promoters50/4767663
agaaatatatgt

SEQ ID NO: 188762 - DNA, 12 bp, Unknown
  misc_feature (1)..( 12): Result.005 file - promoters50/4767663
cgaataatataa

SEQ ID NO: 188763 - DNA, 12 bp, Unknown
  misc_feature (1)..( 12): Result.005 file - promoters50/4767663
acaaaaataaac

SEQ ID NO: 188764 - DNA, 12 bp, Unknown
  misc_feature (1)..( 12): Result.005 file - promoters50/4767663
cacaatatacac

SEQ ID NO: 188765 - DNA, 12 bp, Unknown
  misc_feature (1)..( 12): Result.005 file - promoters50/4767663
tgaaatatcata

SEQ ID NO: 188766 - DNA, 13 bp, Unknown
  misc_feature (1)..( 13): Result.005 file - promoters50/4767663
atttcatttaaac

SEQ ID NO: 188767 - DNA, 13 bp, Unknown
  misc_feature (1)..( 13): Result.005 file - promoters50/4767663
attttattataaa

SEQ ID NO: 188768 - DNA, 14 bp, Unknown
  misc_feature (1)..( 14): Result.005 file - promoters50/4767663
atctcacttatatc

SEQ ID NO: 188769 - DNA, 14 bp, Unknown
  misc_feature (1)..( 14): Result.005 file - promoters50/4767663
ttatttatttacta

SEQ ID NO: 188770 - DNA, 14 bp, Unknown
  misc_feature (1)..( 14): Result.005 file - promoters50/4767663
ttgtctaactcata

SEQ ID NO: 188771 - DNA, 14 bp, Unknown
  misc_feature (1)..( 14): Result.005 file - promoters50/4767663
catacaaatattaa

SEQ ID NO: 188772 - DNA, 10 bp, Unknown
  misc_feature (1)..( 10): Result.005 file - promoters50/4767663
ccaaaatata

SEQ ID NO: 188773 - DNA, 10 bp, Unknown
  misc_feature (1)..( 10): Result.005 file - promoters50/4767663
agaaaatata

SEQ ID NO: 188774 - DNA, 10 bp, Unknown
  misc_feature (1)..( 10): Result.005 file - promoters50/4767663
taataatata

SEQ ID NO: 188775 - DNA, 10 bp, Unknown
  misc_feature (1)..( 10): Result.005 file - promoters50/4767663
agaaaaaata

SEQ ID NO: 188776 - DNA, 10 bp, Unknown
  misc_feature (1)..( 10): Result.005 file - promoters50/4767663
agttaatata

SEQ ID NO: 188777 - DNA, 10 bp, Unknown
  misc_feature (1)..( 10): Result.005 file - promoters50/4767663
agagaatttt

SEQ ID NO: 188778 - DNA, 9 bp, Unknown
  misc_feature (1)..( 9): Result.005 file - promoters50/4767675
aaagcaaat

SEQ ID NO: 188779 - DNA, 9 bp, Unknown
  misc_feature (1)..( 9): Result.005 file - promoters50/4767675
gaagcaaaa

SEQ ID NO: 188780 - DNA, 9 bp, Unknown
  misc_feature (1)..( 9): Result.005 file - promoters50/4767675
aaaacaatt

SEQ ID NO: 188781 - DNA, 9 bp, Unknown
  misc_feature (1)..( 9): Result.005 file - promoters50/4767675
aaagaaaaa

SEQ ID NO: 188782 - DNA, 9 bp, Unknown
  misc_feature (1)..( 9): Result.005 file - promoters50/4767675
taagaaaaa

SEQ ID NO: 188783 - DNA, 9 bp, Unknown
  misc_feature (1)..( 9): Result.005 file - promoters50/4767675
gaaacaaaa

SEQ ID NO: 188784 - DNA, 8 bp, Unknown
  misc_feature (1)..( 8): Result.005 file - promoters50/4767679
aacaatca

SEQ ID NO: 188785 - DNA, 8 bp, Unknown
  misc_feature (1)..( 8): Result.005 file - promoters50/4767679
aacaattc

SEQ ID NO: 188786 - DNA, 8 bp, Unknown
  misc_feature (1)..( 8): Result.005 file - promoters50/4767679
tacaatca

SEQ ID NO: 188787 - DNA, 8 bp, Unknown
  misc_feature (1)..( 8): Result.005 file - promoters50/4767683
atatatat

SEQ ID NO: 188788 - DNA, 8 bp, Unknown
  misc_feature (1)..( 8): Result.005 file - promoters50/4767683
ttatataa

SEQ ID NO: 188789 - DNA, 8 bp, Unknown
  misc_feature (1)..( 8): Result.005 file - promoters50/4767683
atatatat

SEQ ID NO: 188790 - DNA, 8 bp, Unknown
  misc_feature (1)..( 8): Result.005 file - promoters50/4767683
ttatataa

SEQ ID NO: 188791 - DNA, 8 bp, Unknown
  misc_feature (1)..( 8): Result.005 file - promoters50/4767683
ttatatgt

SEQ ID NO: 188792 - DNA, 8 bp, Unknown
  misc_feature (1)..( 8): Result.005 file - promoters50/4767683
ctatataa

SEQ ID NO: 188793 - DNA, 22 bp, Unknown
  misc_feature (1)..( 22): Result.005 file - promoters50/4767683
gaagaaatattgataatatatg

SEQ ID NO: 188794 - DNA, 22 bp, Unknown
  misc_feature (1)..( 22): Result.005 file - promoters50/4767683
ttaaaaaaattaaggatggtaa

SEQ ID NO: 188795 - DNA, 22 bp, Unknown
  misc_feature (1)..( 22): Result.005 file - promoters50/4767683
atgctaatatttactgtaacat

SEQ ID NO: 188796 - DNA, 22 bp, Unknown
  misc_feature (1)..( 22): Result.005 file - promoters50/4767683
ttataaaaactaatgatgctaa

SEQ ID NO: 188797 - DNA, 22 bp, Unknown
  misc_feature (1)..( 22): Result.005 file - promoters50/4767683
atagaaaaataaattaacaatt

SEQ ID NO: 188798 - DNA, 22 bp, Unknown
  misc_feature (1)..( 22): Result.005 file - promoters50/4767683
gtagaaaaaatcaccttaaact

SEQ ID NO: 188799 - DNA, 12 bp, Unknown
  misc_feature (1)..( 12): Result.005 file - promoters50/4767701
cttaagttagtt

SEQ ID NO: 188800 - DNA, 12 bp, Unknown
  misc_feature (1)..( 12): Result.005 file - promoters50/4767701
cataatttagtc

SEQ ID NO: 188801 - DNA, 12 bp, Unknown
  misc_feature (1)..( 12): Result.005 file - promoters50/4767701
aacgccttagtt

SEQ ID NO: 188802 - DNA, 11 bp, Unknown
  misc_feature (1)..( 11): Result.005 file - promoters50/4767701
tgaatttattt

SEQ ID NO: 188803 - DNA, 12 bp, Unknown
  misc_feature (1)..( 12): Result.005 file - promoters50/4767701
cataatgtagaa

SEQ ID NO: 188804 - DNA, 12 bp, Unknown
  misc_feature (1)..( 12): Result.005 file - promoters50/4767701
cttaatgtttgc

SEQ ID NO: 188805 - DNA, 12 bp, Unknown
  misc_feature (1)..( 12): Result.005 file - promoters50/4767701
gctaatgtgaac

SEQ ID NO: 188806 - DNA, 13 bp, Unknown
  misc_feature (1)..( 13): Result.005 file - promoters50/4767701
ctcttgcatagaa

SEQ ID NO: 188807 - DNA, 13 bp, Unknown
  misc_feature (1)..( 13): Result.005 file - promoters50/4767701
tctttgaatattg

SEQ ID NO: 188808 - DNA, 13 bp, Unknown
  misc_feature (1)..( 13): Result.005 file - promoters50/4767701
tctatgaatcatg

SEQ ID NO: 188809 - DNA, 13 bp, Unknown
  misc_feature (1)..( 13): Result.005 file - promoters50/4767701
gttataaatcgtt

SEQ ID NO: 188810 - DNA, 13 bp, Unknown
  misc_feature (1)..( 13): Result.005 file - promoters50/4767701
tttatgaatctgc

SEQ ID NO: 188811 - DNA, 13 bp, Unknown
  misc_feature (1)..( 13): Result.005 file - promoters50/4767701
tgtagaaatcgtt

SEQ ID NO: 188812 - DNA, 10 bp, Unknown
  misc_feature (1)..( 10): Result.005 file - promoters50/4767701
gtgaacttaa

SEQ ID NO: 188813 - DNA, 9 bp, Unknown
  misc_feature (1)..( 9): Result.005 file - promoters50/4767701
tgaatttat

SEQ ID NO: 188814 - DNA, 10 bp, Unknown
  misc_feature (1)..( 10): Result.005 file - promoters50/4767701
cataatttag

SEQ ID NO: 188815 - DNA, 10 bp, Unknown
  misc_feature (1)..( 10): Result.005 file - promoters50/4767701
cataatgtag

SEQ ID NO: 188816 - DNA, 10 bp, Unknown
  misc_feature (1)..( 10): Result.005 file - promoters50/4767701
cttaatgttt

SEQ ID NO: 188817 - DNA, 10 bp, Unknown
  misc_feature (1)..( 10): Result.005 file - promoters50/4767701
gctaatgtga

SEQ ID NO: 188818 - DNA, 12 bp, Unknown
  misc_feature (1)..( 12): Result.005 file - promoters50/4767701
acaataatgggc

SEQ ID NO: 188819 - DNA, 12 bp, Unknown
  misc_feature (1)..( 12): Result.005 file - promoters50/4767701
ctaataatagaa

SEQ ID NO: 188820 - DNA, 12 bp, Unknown
  misc_feature (1)..( 12): Result.005 file - promoters50/4767701
ctaattatacaa

SEQ ID NO: 188821 - DNA, 12 bp, Unknown
  misc_feature (1)..( 12): Result.005 file - promoters50/4767701
tctcttatccaa

SEQ ID NO: 188822 - DNA, 12 bp, Unknown
  misc_feature (1)..( 12): Result.005 file - promoters50/4767701
catgttaaccac

SEQ ID NO: 188823 - DNA, 12 bp, Unknown
  misc_feature (1)..( 12): Result.005 file - promoters50/4767701
gcgcttttccag

SEQ ID NO: 188824 - DNA, 11 bp, Unknown
  misc_feature (1)..( 11): Result.005 file - promoters50/4767701
gcaagaaattc

SEQ ID NO: 188825 - DNA, 11 bp, Unknown
  misc_feature (1)..( 11): Result.005 file - promoters50/4767701
ccaagaacttc

SEQ ID NO: 188826 - DNA, 11 bp, Unknown
  misc_feature (1)..( 11): Result.005 file - promoters50/4767701
attcaaaattc

SEQ ID NO: 188827 - DNA, 11 bp, Unknown
  misc_feature (1)..( 11): Result.005 file - promoters50/4767701
acaaaaaaaaa

SEQ ID NO: 188828 - DNA, 11 bp, Unknown
  misc_feature (1)..( 11): Result.005 file - promoters50/4767701
ctaagaacatt

SEQ ID NO: 188829 - DNA, 11 bp, Unknown
  misc_feature (1)..( 11): Result.005 file - promoters50/4767701
ccacgaaacta

SEQ ID NO: 188830 - DNA, 22 bp, Unknown
  misc_feature (1)..( 22): Result.005 file - promoters50/4767705
tgacaaaatttatctgtaaatg

SEQ ID NO: 188831 - DNA, 22 bp, Unknown
  misc_feature (1)..( 22): Result.005 file - promoters50/4767705
aagaataatgtatacgatgtaa

SEQ ID NO: 188832 - DNA, 22 bp, Unknown
  misc_feature (1)..( 22): Result.005 file - promoters50/4767705
tcttatggtttctctgagtttg

SEQ ID NO: 188833 - DNA, 22 bp, Unknown
  misc_feature (1)..( 22): Result.005 file - promoters50/4767705
caagaaaaattattaaagtata

SEQ ID NO: 188834 - DNA, 22 bp, Unknown
  misc_feature (1)..( 22): Result.005 file - promoters50/4767705
tctttgaattttgtttttggga

SEQ ID NO: 188835 - DNA, 22 bp, Unknown
  misc_feature (1)..( 22): Result.005 file - promoters50/4767705
taataaagattattaaattata

SEQ ID NO: 188836 - DNA, 22 bp, Unknown
  misc_feature (1)..( 22): Result.005 file - promoters50/4767705
tcgactaattttagggtttagt

SEQ ID NO: 188837 - DNA, 14 bp, Unknown
  misc_feature (1)..( 14): Result.005 file - promoters50/4767705
ataataattgaact

SEQ ID NO: 188838 - DNA, 14 bp, Unknown
  misc_feature (1)..( 14): Result.005 file - promoters50/4767705
agaataatgtatac

SEQ ID NO: 188839 - DNA, 14 bp, Unknown
  misc_feature (1)..( 14): Result.005 file - promoters50/4767705
atactaattttttt

SEQ ID NO: 188840 - DNA, 14 bp, Unknown
  misc_feature (1)..( 14): Result.005 file - promoters50/4767705
aaaattattaaagt

SEQ ID NO: 188841 - DNA, 14 bp, Unknown
  misc_feature (1)..( 14): Result.005 file - promoters50/4767705
gtaatgatgagatg

SEQ ID NO: 188842 - DNA, 14 bp, Unknown
  misc_feature (1)..( 14): Result.005 file - promoters50/4767705
ttactaatagaaga

SEQ ID NO: 188843 - DNA, 14 bp, Unknown
  misc_feature (1)..( 14): Result.005 file - promoters50/4767705
atcggattttgcta

SEQ ID NO: 188844 - DNA, 11 bp, Unknown
  misc_feature (1)..( 11): Result.005 file - promoters50/4767705
aaaaatgttat

SEQ ID NO: 188845 - DNA, 11 bp, Unknown
  misc_feature (1)..( 11): Result.005 file - promoters50/4767705
taaattgtctt

SEQ ID NO: 188846 - DNA, 11 bp, Unknown
  misc_feature (1)..( 11): Result.005 file - promoters50/4767705
ctaattttaat

SEQ ID NO: 188847 - DNA, 11 bp, Unknown
  misc_feature (1)..( 11): Result.005 file - promoters50/4767705
aaaaattatta

SEQ ID NO: 188848 - DNA, 11 bp, Unknown
  misc_feature (1)..( 11): Result.005 file - promoters50/4767705
ctaattttagg

SEQ ID NO: 188849 - DNA, 11 bp, Unknown
  misc_feature (1)..( 11): Result.005 file - promoters50/4767705
gggattatctt

SEQ ID NO: 188850 - DNA, 11 bp, Unknown
  misc_feature (1)..( 11): Result.005 file - promoters50/4767705
tgttttttaat

SEQ ID NO: 188851 - DNA, 15 bp, Unknown
  misc_feature (1)..( 15): Result.005 file - promoters50/4767705
atgttatatttttaa

SEQ ID NO: 188852 - DNA, 15 bp, Unknown
  misc_feature (1)..( 15): Result.005 file - promoters50/4767705
catttaaatttatta

SEQ ID NO: 188853 - DNA, 15 bp, Unknown
  misc_feature (1)..( 15): Result.005 file - promoters50/4767705
tgattatttttttaa

SEQ ID NO: 188854 - DNA, 15 bp, Unknown
  misc_feature (1)..( 15): Result.005 file - promoters50/4767705
attttaattttgtta

SEQ ID NO: 188855 - DNA, 15 bp, Unknown
  misc_feature (1)..( 15): Result.005 file - promoters50/4767705
agtctaattttaatt

SEQ ID NO: 188856 - DNA, 15 bp, Unknown
  misc_feature (1)..( 15): Result.005 file - promoters50/4767705
ttagtagatttgtta

SEQ ID NO: 188857 - DNA, 15 bp, Unknown
  misc_feature (1)..( 15): Result.005 file - promoters50/4767705
ctttgaattttgttt

SEQ ID NO: 188858 - DNA, 11 bp, Unknown
  misc_feature (1)..( 11): Result.005 file - promoters50/4767705
tctatataaac

SEQ ID NO: 188859 - DNA, 11 bp, Unknown
  misc_feature (1)..( 11): Result.005 file - promoters50/4767705
ctgttataaaa

SEQ ID NO: 188860 - DNA, 11 bp, Unknown
  misc_feature (1)..( 11): Result.005 file - promoters50/4767705
tctatataaac

SEQ ID NO: 188861 - DNA, 11 bp, Unknown
  misc_feature (1)..( 11): Result.005 file - promoters50/4767705
tatatataaat

SEQ ID NO: 188862 - DNA, 11 bp, Unknown
  misc_feature (1)..( 11): Result.005 file - promoters50/4767705
cctatatatat

SEQ ID NO: 188863 - DNA, 11 bp, Unknown
  misc_feature (1)..( 11): Result.005 file - promoters50/4767705
actatatatat

SEQ ID NO: 188864 - DNA, 11 bp, Unknown
  misc_feature (1)..( 11): Result.005 file - promoters50/4767705
tttatttatat

SEQ ID NO: 188865 - DNA, 12 bp, Unknown
  misc_feature (1)..( 12): Result.005 file - promoters50/4767705
aaaaaaattgat

SEQ ID NO: 188866 - DNA, 12 bp, Unknown
  misc_feature (1)..( 12): Result.005 file - promoters50/4767705
ctctaaattgag

SEQ ID NO: 188867 - DNA, 12 bp, Unknown
  misc_feature (1)..( 12): Result.005 file - promoters50/4767705
tgaaaaattcta

SEQ ID NO: 188868 - DNA, 12 bp, Unknown
  misc_feature (1)..( 12): Result.005 file - promoters50/4767705
cgtataatggat

SEQ ID NO: 188869 - DNA, 12 bp, Unknown
  misc_feature (1)..( 12): Result.005 file - promoters50/4767705
aaaataattgat

SEQ ID NO: 188870 - DNA, 12 bp, Unknown
  misc_feature (1)..( 12): Result.005 file - promoters50/4767705
caaacaatcatt

SEQ ID NO: 188871 - DNA, 9 bp, Unknown
  misc_feature (1)..( 9): Result.005 file - promoters50/4767705
ggataaaat

SEQ ID NO: 188872 - DNA, 9 bp, Unknown
  misc_feature (1)..( 9): Result.005 file - promoters50/4767705
tgataaaaa

SEQ ID NO: 188873 - DNA, 9 bp, Unknown
  misc_feature (1)..( 9): Result.005 file - promoters50/4767705
gtatataat

SEQ ID NO: 188874 - DNA, 9 bp, Unknown
  misc_feature (1)..( 9): Result.005 file - promoters50/4767705
aaatataat

SEQ ID NO: 188875 - DNA, 9 bp, Unknown
  misc_feature (1)..( 9): Result.005 file - promoters50/4767705
gactaaaaa

SEQ ID NO: 188876 - DNA, 9 bp, Unknown
  misc_feature (1)..( 9): Result.005 file - promoters50/4767705
gaccaaaat

SEQ ID NO: 188877 - DNA, 15 bp, Unknown
  misc_feature (1)..( 15): Result.005 file - promoters50/4767705
atgcaaataattatt

SEQ ID NO: 188878 - DNA, 15 bp, Unknown
  misc_feature (1)..( 15): Result.005 file - promoters50/4767705
tgataaaaaatatat

SEQ ID NO: 188879 - DNA, 15 bp, Unknown
  misc_feature (1)..( 15): Result.005 file - promoters50/4767705
cagtatataatttta

SEQ ID NO: 188880 - DNA, 15 bp, Unknown
  misc_feature (1)..( 15): Result.005 file - promoters50/4767705
gactaaaaattttaa

SEQ ID NO: 188881 - DNA, 15 bp, Unknown
  misc_feature (1)..( 15): Result.005 file - promoters50/4767705
gaccaaaattacaaa

SEQ ID NO: 188882 - DNA, 15 bp, Unknown
  misc_feature (1)..( 15): Result.005 file - promoters50/4767705
aagagtctaatttta

SEQ ID NO: 188883 - DNA, 15 bp, Unknown
  misc_feature (1)..( 15): Result.005 file - promoters50/4767705
ttgttaattaacaat

SEQ ID NO: 188884 - DNA, 15 bp, Unknown
  misc_feature (1)..( 15): Result.005 file - promoters50/4767705
cacttatttattctc

SEQ ID NO: 188885 - DNA, 15 bp, Unknown
  misc_feature (1)..( 15): Result.005 file - promoters50/4767705
aaataaattaacaat

SEQ ID NO: 188886 - DNA, 15 bp, Unknown
  misc_feature (1)..( 15): Result.005 file - promoters50/4767705
ctaatatttactgta

SEQ ID NO: 188887 - DNA, 15 bp, Unknown
  misc_feature (1)..( 15): Result.005 file - promoters50/4767705
aaaaaaattaaggat

SEQ ID NO: 188888 - DNA, 15 bp, Unknown
  misc_feature (1)..( 15): Result.005 file - promoters50/4767705
ctcacaattcataaa

SEQ ID NO: 188889 - DNA, 11 bp, Unknown
  misc_feature (1)..( 11): Result.005 file - promoters50/4767705
tctatataaac

SEQ ID NO: 188890 - DNA, 11 bp, Unknown
  misc_feature (1)..( 11): Result.005 file - promoters50/4767705
tatatatagag

SEQ ID NO: 188891 - DNA, 11 bp, Unknown
  misc_feature (1)..( 11): Result.005 file - promoters50/4767705
actatatatat

SEQ ID NO: 188892 - DNA, 11 bp, Unknown
  misc_feature (1)..( 11): Result.005 file - promoters50/4767705
tctatataaac

SEQ ID NO: 188893 - DNA, 11 bp, Unknown
  misc_feature (1)..( 11): Result.005 file - promoters50/4767705
cgtatatataa

SEQ ID NO: 188894 - DNA, 11 bp, Unknown
  misc_feature (1)..( 11): Result.005 file - promoters50/4767705
tttatttatat

SEQ ID NO: 188895 - DNA, 17 bp, Unknown
  misc_feature (1)..( 17): Result.005 file - promoters50/4767705
aataattgaactaaaaa

SEQ ID NO: 188896 - DNA, 17 bp, Unknown
  misc_feature (1)..( 17): Result.005 file - promoters50/4767705
actaatagaagagtcta

SEQ ID NO: 188897 - DNA, 17 bp, Unknown
  misc_feature (1)..( 17): Result.005 file - promoters50/4767705
aaaaattattaaagtat

SEQ ID NO: 188898 - DNA, 17 bp, Unknown
  misc_feature (1)..( 17): Result.005 file - promoters50/4767705
tcttattaaaatcaatg

SEQ ID NO: 188899 - DNA, 17 bp, Unknown
  misc_feature (1)..( 17): Result.005 file - promoters50/4767705
aatgattatttttttaa

SEQ ID NO: 188900 - DNA, 17 bp, Unknown
  misc_feature (1)..( 17): Result.005 file - promoters50/4767705
tgggattatcttgtcca

SEQ ID NO: 188901 - DNA, 17 bp, Unknown
  misc_feature (1)..( 17): Result.005 file - promoters50/4767705
ctgtttagatgagtcac

SEQ ID NO: 188902 - DNA, 17 bp, Unknown
  misc_feature (1)..( 17): Result.005 file - promoters50/4767705
actaattttagggttta

SEQ ID NO: 188903 - DNA, 11 bp, Unknown
  misc_feature (1)..( 11): Result.005 file - promoters50/4767709
caacaatcttt

SEQ ID NO: 188904 - DNA, 11 bp, Unknown
  misc_feature (1)..( 11): Result.005 file - promoters50/4767709
caaaaatagac

SEQ ID NO: 188905 - DNA, 11 bp, Unknown
  misc_feature (1)..( 11): Result.005 file - promoters50/4767709
aaaaaatagac

SEQ ID NO: 188906 - DNA, 7 bp, Unknown
  misc_feature (1)..( 7): Result.005 file - promoters50/4767709
attgtgg

SEQ ID NO: 188907 - DNA, 7 bp, Unknown
  misc_feature (1)..( 7): Result.005 file - promoters50/4767709
attgtga

SEQ ID NO: 188908 - DNA, 7 bp, Unknown
  misc_feature (1)..( 7): Result.005 file - promoters50/4767709
attttga

SEQ ID NO: 188909 - DNA, 9 bp, Unknown
  misc_feature (1)..( 9): Result.005 file - promoters50/4767715
gtattatat

SEQ ID NO: 188910 - DNA, 9 bp, Unknown
  misc_feature (1)..( 9): Result.005 file - promoters50/4767715
gtattatta

SEQ ID NO: 188911 - DNA, 9 bp, Unknown
  misc_feature (1)..( 9): Result.005 file - promoters50/4767715
ttataatac

SEQ ID NO: 188912 - DNA, 9 bp, Unknown
  misc_feature (1)..( 9): Result.005 file - promoters50/4767715
ctatgattc

SEQ ID NO: 188913 - DNA, 9 bp, Unknown
  misc_feature (1)..( 9): Result.005 file - promoters50/4767715
aaataatac

SEQ ID NO: 188914 - DNA, 9 bp, Unknown
  misc_feature (1)..( 9): Result.005 file - promoters50/4767715
acataatac

SEQ ID NO: 188915 - DNA, 14 bp, Unknown
  misc_feature (1)..( 14): Result.005 file - promoters50/4767722
agtttaattattcc

SEQ ID NO: 188916 - DNA, 14 bp, Unknown
  misc_feature (1)..( 14): Result.005 file - promoters50/4767722
aattttattaaaaa

SEQ ID NO: 188917 - DNA, 14 bp, Unknown
  misc_feature (1)..( 14): Result.005 file - promoters50/4767722
attttaatgaagta

SEQ ID NO: 188918 - DNA, 14 bp, Unknown
  misc_feature (1)..( 14): Result.005 file - promoters50/4767722
aatttaattctaat

SEQ ID NO: 188919 - DNA, 14 bp, Unknown
  misc_feature (1)..( 14): Result.005 file - promoters50/4767722
ttttttataaagaa

SEQ ID NO: 188920 - DNA, 14 bp, Unknown
  misc_feature (1)..( 14): Result.005 file - promoters50/4767722
tttttgatagagaa

SEQ ID NO: 188921 - DNA, 11 bp, Unknown
  misc_feature (1)..( 11): Result.005 file - promoters50/4767722
gcctattacaa

SEQ ID NO: 188922 - DNA, 11 bp, Unknown
  misc_feature (1)..( 11): Result.005 file - promoters50/4767722
cccttttatgt

SEQ ID NO: 188923 - DNA, 11 bp, Unknown
  misc_feature (1)..( 11): Result.005 file - promoters50/4767722
tagttttatgt

SEQ ID NO: 188924 - DNA, 11 bp, Unknown
  misc_feature (1)..( 11): Result.005 file - promoters50/4767722
ggtttttattc

SEQ ID NO: 188925 - DNA, 11 bp, Unknown
  misc_feature (1)..( 11): Result.005 file - promoters50/4767722
ggttattatca

SEQ ID NO: 188926 - DNA, 11 bp, Unknown
  misc_feature (1)..( 11): Result.005 file - promoters50/4767722
tgttatttgaa

SEQ ID NO: 188927 - DNA, 14 bp, Unknown
  misc_feature (1)..( 14): Result.005 file - promoters50/4767722
ctttcaaagaatca

SEQ ID NO: 188928 - DNA, 14 bp, Unknown
  misc_feature (1)..( 14): Result.005 file - promoters50/4767722
ttctgaaagaaagc

SEQ ID NO: 188929 - DNA, 14 bp, Unknown
  misc_feature (1)..( 14): Result.005 file - promoters50/4767722
ttgttaaaaaatca

SEQ ID NO: 188930 - DNA, 14 bp, Unknown
  misc_feature (1)..( 14): Result.005 file - promoters50/4767722
gttataaatttgta

SEQ ID NO: 188931 - DNA, 14 bp, Unknown
  misc_feature (1)..( 14): Result.005 file - promoters50/4767722
agattaaaaaaaaa

SEQ ID NO: 188932 - DNA, 7 bp, Unknown
  misc_feature (1)..( 7): Result.005 file - promoters50/4767733
gagaaaa

SEQ ID NO: 188933 - DNA, 7 bp, Unknown
  misc_feature (1)..( 7): Result.005 file - promoters50/4767733
gagaaag

SEQ ID NO: 188934 - DNA, 7 bp, Unknown
  misc_feature (1)..( 7): Result.005 file - promoters50/4767733
gagaaag

SEQ ID NO: 188935 - DNA, 7 bp, Unknown
  misc_feature (1)..( 7): Result.005 file - promoters50/4767733
tcaaaat

SEQ ID NO: 188936 - DNA, 7 bp, Unknown
  misc_feature (1)..( 7): Result.005 file - promoters50/4767733
tcaaaag

SEQ ID NO: 188937 - DNA, 7 bp, Unknown
  misc_feature (1)..( 7): Result.005 file - promoters50/4767733
ccaaaag

SEQ ID NO: 188938 - DNA, 12 bp, Unknown
  misc_feature (1)..( 12): Result.005 file - promoters50/4767748
tcaatatatttt

SEQ ID NO: 188939 - DNA, 12 bp, Unknown
  misc_feature (1)..( 12): Result.005 file - promoters50/4767748
ttaataaatttt

SEQ ID NO: 188940 - DNA, 12 bp, Unknown
  misc_feature (1)..( 12): Result.005 file - promoters50/4767748
ataataactctt

SEQ ID NO: 188941 - DNA, 12 bp, Unknown
  misc_feature (1)..( 12): Result.005 file - promoters50/4767748
ctaaaaaatatt

SEQ ID NO: 188942 - DNA, 12 bp, Unknown
  misc_feature (1)..( 12): Result.005 file - promoters50/4767748
atactaaagttt

SEQ ID NO: 188943 - DNA, 12 bp, Unknown
  misc_feature (1)..( 12): Result.005 file - promoters50/4767748
ttaaaaaagtgt

SEQ ID NO: 188944 - DNA, 12 bp, Unknown
  misc_feature (1)..( 12): Result.005 file - promoters50/4767748
aacaaacataac

SEQ ID NO: 188945 - DNA, 10 bp, Unknown
  misc_feature (1)..( 10): Result.005 file - promoters50/4767748
tatagcaaaa

SEQ ID NO: 188946 - DNA, 10 bp, Unknown
  misc_feature (1)..( 10): Result.005 file - promoters50/4767748
tttagtaaaa

SEQ ID NO: 188947 - DNA, 10 bp, Unknown
  misc_feature (1)..( 10): Result.005 file - promoters50/4767748
aatatcaaag

SEQ ID NO: 188948 - DNA, 10 bp, Unknown
  misc_feature (1)..( 10): Result.005 file - promoters50/4767748
ttttgtatta

SEQ ID NO: 188949 - DNA, 10 bp, Unknown
  misc_feature (1)..( 10): Result.005 file - promoters50/4767748
ttttgtttaa

SEQ ID NO: 188950 - DNA, 10 bp, Unknown
  misc_feature (1)..( 10): Result.005 file - promoters50/4767748
aagagtgaaa

SEQ ID NO: 188951 - DNA, 9 bp, Unknown
  misc_feature (1)..( 9): Result.005 file - promoters50/4767755
ttattatac

SEQ ID NO: 188952 - DNA, 9 bp, Unknown
  misc_feature (1)..( 9): Result.005 file - promoters50/4767755
ttaatatta

SEQ ID NO: 188953 - DNA, 9 bp, Unknown
  misc_feature (1)..( 9): Result.005 file - promoters50/4767755
gtaaaatta

SEQ ID NO: 188954 - DNA, 8 bp, Unknown
  misc_feature (1)..( 8): Result.005 file - promoters50/4767755
gtattttt

SEQ ID NO: 188955 - DNA, 8 bp, Unknown
  misc_feature (1)..( 8): Result.005 file - promoters50/4767755
agattttt

SEQ ID NO: 188956 - DNA, 8 bp, Unknown
  misc_feature (1)..( 8): Result.005 file - promoters50/4767755
agagtttg

SEQ ID NO: 188957 - DNA, 8 bp, Unknown
  misc_feature (1)..( 8): Result.005 file - promoters50/4767755
caaatttt

SEQ ID NO: 188958 - DNA, 8 bp, Unknown
  misc_feature (1)..( 8): Result.005 file - promoters50/4767755
caattttt

SEQ ID NO: 188959 - DNA, 8 bp, Unknown
  misc_feature (1)..( 8): Result.005 file - promoters50/4767755
taaatttg

SEQ ID NO: 188960 - DNA, 8 bp, Unknown
  misc_feature (1)..( 8): Result.005 file - promoters50/4767755
aattttct

SEQ ID NO: 188961 - DNA, 8 bp, Unknown
  misc_feature (1)..( 8): Result.005 file - promoters50/4767755
ttttttct

SEQ ID NO: 188962 - DNA, 8 bp, Unknown
  misc_feature (1)..( 8): Result.005 file - promoters50/4767755
ttttttca

SEQ ID NO: 188963 - DNA, 7 bp, Unknown
  misc_feature (1)..( 7): Result.005 file - promoters50/4767755
ataaaac

SEQ ID NO: 188964 - DNA, 7 bp, Unknown
  misc_feature (1)..( 7): Result.005 file - promoters50/4767755
ataaaag

SEQ ID NO: 188965 - DNA, 7 bp, Unknown
  misc_feature (1)..( 7): Result.005 file - promoters50/4767755
ataaaac

SEQ ID NO: 188966 - DNA, 11 bp, Unknown
  misc_feature (1)..( 11): Result.005 file - promoters50/4767755
caaaaaaaaaa

SEQ ID NO: 188967 - DNA, 11 bp, Unknown
  misc_feature (1)..( 11): Result.005 file - promoters50/4767755
caaaagaaaaa

SEQ ID NO: 188968 - DNA, 11 bp, Unknown
  misc_feature (1)..( 11): Result.005 file - promoters50/4767755
agagagacaaa

SEQ ID NO: 188969 - DNA, 15 bp, Unknown
  misc_feature (1)..( 15): Result.005 file - promoters50/4767764
gcattggatagatat

SEQ ID NO: 188970 - DNA, 15 bp, Unknown
  misc_feature (1)..( 15): Result.005 file - promoters50/4767764
aaattgtatacatat

SEQ ID NO: 188971 - DNA, 15 bp, Unknown
  misc_feature (1)..( 15): Result.005 file - promoters50/4767764
aaattggatccgaaa

SEQ ID NO: 188972 - DNA, 15 bp, Unknown
  misc_feature (1)..( 15): Result.005 file - promoters50/4767764
taattctatgtattt

SEQ ID NO: 188973 - DNA, 15 bp, Unknown
  misc_feature (1)..( 15): Result.005 file - promoters50/4767764
aaattgtttcaaacg

SEQ ID NO: 188974 - DNA, 15 bp, Unknown
  misc_feature (1)..( 15): Result.005 file - promoters50/4767764
ttattttataggtcc

SEQ ID NO: 188975 - DNA, 15 bp, Unknown
  misc_feature (1)..( 15): Result.005 file - promoters50/4767764
acattttatccttca

SEQ ID NO: 188976 - DNA, 14 bp, Unknown
  misc_feature (1)..( 14): Result.005 file - promoters50/4767764
ttataatctttaat

SEQ ID NO: 188977 - DNA, 14 bp, Unknown
  misc_feature (1)..( 14): Result.005 file - promoters50/4767764
tgaaaatgtttata

SEQ ID NO: 188978 - DNA, 14 bp, Unknown
  misc_feature (1)..( 14): Result.005 file - promoters50/4767764
attcgatctttttg

SEQ ID NO: 188979 - DNA, 14 bp, Unknown
  misc_feature (1)..( 14): Result.005 file - promoters50/4767764
tcatcatccttatc

SEQ ID NO: 188980 - DNA, 14 bp, Unknown
  misc_feature (1)..( 14): Result.005 file - promoters50/4767764
attagattttttac

SEQ ID NO: 188981 - DNA, 14 bp, Unknown
  misc_feature (1)..( 14): Result.005 file - promoters50/4767764
aaaaaattggatcc

SEQ ID NO: 188982 - DNA, 14 bp, Unknown
  misc_feature (1)..( 14): Result.005 file - promoters50/4767764
accttttcttgttg

SEQ ID NO: 188983 - DNA, 12 bp, Unknown
  misc_feature (1)..( 12): Result.005 file - promoters50/4767764
gagatctttata

SEQ ID NO: 188984 - DNA, 12 bp, Unknown
  misc_feature (1)..( 12): Result.005 file - promoters50/4767764
tagattttttac

SEQ ID NO: 188985 - DNA, 12 bp, Unknown
  misc_feature (1)..( 12): Result.005 file - promoters50/4767764
tcgatctttttg

SEQ ID NO: 188986 - DNA, 12 bp, Unknown
  misc_feature (1)..( 12): Result.005 file - promoters50/4767764
atcatccttatc

SEQ ID NO: 188987 - DNA, 12 bp, Unknown
  misc_feature (1)..( 12): Result.005 file - promoters50/4767764
tagattgctgat

SEQ ID NO: 188988 - DNA, 12 bp, Unknown
  misc_feature (1)..( 12): Result.005 file - promoters50/4767764
cttttcttgttg

SEQ ID NO: 188989 - DNA, 9 bp, Unknown
  misc_feature (1)..( 9): Result.005 file - promoters50/4767764
caaaataac

SEQ ID NO: 188990 - DNA, 9 bp, Unknown
  misc_feature (1)..( 9): Result.005 file - promoters50/4767764
aaaaaaaac

SEQ ID NO: 188991 - DNA, 9 bp, Unknown
  misc_feature (1)..( 9): Result.005 file - promoters50/4767764
aaaaataga

SEQ ID NO: 188992 - DNA, 9 bp, Unknown
  misc_feature (1)..( 9): Result.005 file - promoters50/4767764
gaaaatact

SEQ ID NO: 188993 - DNA, 9 bp, Unknown
  misc_feature (1)..( 9): Result.005 file - promoters50/4767764
gaacaaaag

SEQ ID NO: 188994 - DNA, 9 bp, Unknown
  misc_feature (1)..( 9): Result.005 file - promoters50/4767764
taaaacagc

SEQ ID NO: 188995 - DNA, 10 bp, Unknown
  misc_feature (1)..( 10): Result.005 file - promoters50/4767767
aaccttgaaa

SEQ ID NO: 188996 - DNA, 10 bp, Unknown
  misc_feature (1)..( 10): Result.005 file - promoters50/4767767
aaccttaaaa

SEQ ID NO: 188997 - DNA, 10 bp, Unknown
  misc_feature (1)..( 10): Result.005 file - promoters50/4767767
aacattataa

SEQ ID NO: 188998 - DNA, 10 bp, Unknown
  misc_feature (1)..( 10): Result.005 file - promoters50/4767767
aacctgaaaa

SEQ ID NO: 188999 - DNA, 10 bp, Unknown
  misc_feature (1)..( 10): Result.005 file - promoters50/4767767
aaaatctata

SEQ ID NO: 189000 - DNA, 10 bp, Unknown
  misc_feature (1)..( 10): Result.005 file - promoters50/4767767
tttatctatt

SEQ ID NO: 189001 - DNA, 10 bp, Unknown
  misc_feature (1)..( 10): Result.005 file - promoters50/4767767
cgaatccata

SEQ ID NO: 189002 - DNA, 10 bp, Unknown
  misc_feature (1)..( 10): Result.005 file - promoters50/4767767
cgaaaccaac

SEQ ID NO: 189003 - DNA, 10 bp, Unknown
  misc_feature (1)..( 10): Result.005 file - promoters50/4767767
cacagtatta

SEQ ID NO: 189004 - DNA, 10 bp, Unknown
  misc_feature (1)..( 10): Result.005 file - promoters50/4767767
aacattataa

SEQ ID NO: 189005 - DNA, 10 bp, Unknown
  misc_feature (1)..( 10): Result.005 file - promoters50/4767767
aaccttaaaa

SEQ ID NO: 189006 - DNA, 10 bp, Unknown
  misc_feature (1)..( 10): Result.005 file - promoters50/4767767
aacctgaaaa

SEQ ID NO: 189007 - DNA, 14 bp, Unknown
  misc_feature (1)..( 14): Result.005 file - promoters50/4767795
ctcaaaattgatta

SEQ ID NO: 189008 - DNA, 14 bp, Unknown
  misc_feature (1)..( 14): Result.005 file - promoters50/4767795
ctcaaacttgtttc

SEQ ID NO: 189009 - DNA, 14 bp, Unknown
  misc_feature (1)..( 14): Result.005 file - promoters50/4767795
cataaaatcataat

SEQ ID NO: 189010 - DNA, 10 bp, Unknown
  misc_feature (1)..( 10): Result.005 file - promoters50/4767795
tgattagtta

SEQ ID NO: 189011 - DNA, 10 bp, Unknown
  misc_feature (1)..( 10): Result.005 file - promoters50/4767795
tcattagtta

SEQ ID NO: 189012 - DNA, 10 bp, Unknown
  misc_feature (1)..( 10): Result.005 file - promoters50/4767795
tgattagcaa

SEQ ID NO: 189013 - DNA, 8 bp, Unknown
  misc_feature (1)..( 8): Result.005 file - promoters50/4767795
tttcataa

SEQ ID NO: 189014 - DNA, 8 bp, Unknown
  misc_feature (1)..( 8): Result.005 file - promoters50/4767795
tttcttaa

SEQ ID NO: 189015 - DNA, 8 bp, Unknown
  misc_feature (1)..( 8): Result.005 file - promoters50/4767795
tttattaa

SEQ ID NO: 189016 - DNA, 9 bp, Unknown
  misc_feature (1)..( 9): Result.005 file - promoters50/4767799
tttattgag

SEQ ID NO: 189017 - DNA, 9 bp, Unknown
  misc_feature (1)..( 9): Result.005 file - promoters50/4767799
gagattgag

SEQ ID NO: 189018 - DNA, 9 bp, Unknown
  misc_feature (1)..( 9): Result.005 file - promoters50/4767799
gagcttgag

SEQ ID NO: 189019 - DNA, 10 bp, Unknown
  misc_feature (1)..( 10): Result.005 file - promoters50/4767799
tgagctttat

SEQ ID NO: 189020 - DNA, 10 bp, Unknown
  misc_feature (1)..( 10): Result.005 file - promoters50/4767799
tgagcttgag

SEQ ID NO: 189021 - DNA, 10 bp, Unknown
  misc_feature (1)..( 10): Result.005 file - promoters50/4767799
agagattgag

SEQ ID NO: 189022 - DNA, 8 bp, Unknown
  misc_feature (1)..( 8): Result.005 file - promoters50/4767799
ttaaacat

SEQ ID NO: 189023 - DNA, 8 bp, Unknown
  misc_feature (1)..( 8): Result.005 file - promoters50/4767799
ctaaacat

SEQ ID NO: 189024 - DNA, 8 bp, Unknown
  misc_feature (1)..( 8): Result.005 file - promoters50/4767799
ctaaacaa

SEQ ID NO: 189025 - DNA, 9 bp, Unknown
  misc_feature (1)..( 9): Result.005 file - promoters50/4767803
tgagttttt

SEQ ID NO: 189026 - DNA, 9 bp, Unknown
  misc_feature (1)..( 9): Result.005 file - promoters50/4767803
atagtttta

SEQ ID NO: 189027 - DNA, 9 bp, Unknown
  misc_feature (1)..( 9): Result.005 file - promoters50/4767803
tttgttttt

SEQ ID NO: 189028 - DNA, 10 bp, Unknown
  misc_feature (1)..( 10): Result.005 file - promoters50/4767803
tgagttcttt

SEQ ID NO: 189029 - DNA, 10 bp, Unknown
  misc_feature (1)..( 10): Result.005 file - promoters50/4767803
aaatctttta

SEQ ID NO: 189030 - DNA, 10 bp, Unknown
  misc_feature (1)..( 10): Result.005 file - promoters50/4767803
ctatctttct

SEQ ID NO: 189031 - DNA, 10 bp, Unknown
  misc_feature (1)..( 10): Result.005 file - promoters50/4767803
ctaactttct

SEQ ID NO: 189032 - DNA, 10 bp, Unknown
  misc_feature (1)..( 10): Result.005 file - promoters50/4767803
ataaatttat

SEQ ID NO: 189033 - DNA, 12 bp, Unknown
  misc_feature (1)..( 12): Result.005 file - promoters50/4767803
taatatttttgt

SEQ ID NO: 189034 - DNA, 12 bp, Unknown
  misc_feature (1)..( 12): Result.005 file - promoters50/4767803
ctatctttctgt

SEQ ID NO: 189035 - DNA, 12 bp, Unknown
  misc_feature (1)..( 12): Result.005 file - promoters50/4767803
ctaactttctcg

SEQ ID NO: 189036 - DNA, 12 bp, Unknown
  misc_feature (1)..( 12): Result.005 file - promoters50/4767803
ataaatttattt

SEQ ID NO: 189037 - DNA, 8 bp, Unknown
  misc_feature (1)..( 8): Result.005 file - promoters50/4767803
atattttt

SEQ ID NO: 189038 - DNA, 8 bp, Unknown
  misc_feature (1)..( 8): Result.005 file - promoters50/4767803
ttattttc

SEQ ID NO: 189039 - DNA, 8 bp, Unknown
  misc_feature (1)..( 8): Result.005 file - promoters50/4767803
atatcttc

SEQ ID NO: 189040 - DNA, 8 bp, Unknown
  misc_feature (1)..( 8): Result.005 file - promoters50/4767803
ataccttt

SEQ ID NO: 189041 - DNA, 8 bp, Unknown
  misc_feature (1)..( 8): Result.005 file - promoters50/4767821
aaaaataa

SEQ ID NO: 189042 - DNA, 8 bp, Unknown
  misc_feature (1)..( 8): Result.005 file - promoters50/4767821
taaattaa

SEQ ID NO: 189043 - DNA, 8 bp, Unknown
  misc_feature (1)..( 8): Result.005 file - promoters50/4767821
taaattga

SEQ ID NO: 189044 - DNA, 10 bp, Unknown
  misc_feature (1)..( 10): Result.005 file - promoters50/4767821
caaatcgaaa

SEQ ID NO: 189045 - DNA, 10 bp, Unknown
  misc_feature (1)..( 10): Result.005 file - promoters50/4767821
taaattgaaa

SEQ ID NO: 189046 - DNA, 10 bp, Unknown
  misc_feature (1)..( 10): Result.005 file - promoters50/4767821
taaattaaat

SEQ ID NO: 189047 - DNA, 9 bp, Unknown
  misc_feature (1)..( 9): Result.005 file - promoters50/4767821
ttagatact

SEQ ID NO: 189048 - DNA, 9 bp, Unknown
  misc_feature (1)..( 9): Result.005 file - promoters50/4767821
ttatatata

SEQ ID NO: 189049 - DNA, 9 bp, Unknown
  misc_feature (1)..( 9): Result.005 file - promoters50/4767821
ctatatata

SEQ ID NO: 189050 - DNA, 6 bp, Unknown
  misc_feature (1)..( 6): Result.005 file - promoters50/4767829
aaattt

SEQ ID NO: 189051 - DNA, 6 bp, Unknown
  misc_feature (1)..( 6): Result.005 file - promoters50/4767829
aaattt

SEQ ID NO: 189052 - DNA, 7 bp, Unknown
  misc_feature (1)..( 7): Result.005 file - promoters50/4767829
aaagttt

SEQ ID NO: 189053 - DNA, 10 bp, Unknown
  misc_feature (1)..( 10): Result.005 file - promoters50/4767829
taacaatttt

SEQ ID NO: 189054 - DNA, 10 bp, Unknown
  misc_feature (1)..( 10): Result.005 file - promoters50/4767829
taaaaatttt

SEQ ID NO: 189055 - DNA, 10 bp, Unknown
  misc_feature (1)..( 10): Result.005 file - promoters50/4767829
taaaaagctc

SEQ ID NO: 189056 - DNA, 8 bp, Unknown
  misc_feature (1)..( 8): Result.005 file - promoters50/4767829
ataccaac

SEQ ID NO: 189057 - DNA, 8 bp, Unknown
  misc_feature (1)..( 8): Result.005 file - promoters50/4767829
ttacaaac

SEQ ID NO: 189058 - DNA, 8 bp, Unknown
  misc_feature (1)..( 8): Result.005 file - promoters50/4767829
atatcaac

SEQ ID NO: 189059 - DNA, 9 bp, Unknown
  misc_feature (1)..( 9): Result.005 file - promoters50/4767829
aacaaaatg

SEQ ID NO: 189060 - DNA, 9 bp, Unknown
  misc_feature (1)..( 9): Result.005 file - promoters50/4767829
aacgaaaga

SEQ ID NO: 189061 - DNA, 9 bp, Unknown
  misc_feature (1)..( 9): Result.005 file - promoters50/4767829
gtcgaaaga

SEQ ID NO: 189062 - DNA, 9 bp, Unknown
  misc_feature (1)..( 9): Result.005 file - promoters50/4767829
tttttttta

SEQ ID NO: 189063 - DNA, 9 bp, Unknown
  misc_feature (1)..( 9): Result.005 file - promoters50/4767829
catttatta

SEQ ID NO: 189064 - DNA, 9 bp, Unknown
  misc_feature (1)..( 9): Result.005 file - promoters50/4767829
catttatca

SEQ ID NO: 189065 - DNA, 10 bp, Unknown
  misc_feature (1)..( 10): Result.005 file - promoters50/4767829
ttttcgaaag

SEQ ID NO: 189066 - DNA, 10 bp, Unknown
  misc_feature (1)..( 10): Result.005 file - promoters50/4767829
ttttggaaat

SEQ ID NO: 189067 - DNA, 10 bp, Unknown
  misc_feature (1)..( 10): Result.005 file - promoters50/4767829
ccaaggaaat

SEQ ID NO: 189068 - DNA, 8 bp, Unknown
  misc_feature (1)..( 8): Result.005 file - promoters50/4767829
ttatcaga

SEQ ID NO: 189069 - DNA, 8 bp, Unknown
  misc_feature (1)..( 8): Result.005 file - promoters50/4767829
ttatcatt

SEQ ID NO: 189070 - DNA, 8 bp, Unknown
  misc_feature (1)..( 8): Result.005 file - promoters50/4767829
ctatcatt

SEQ ID NO: 189071 - DNA, 9 bp, Unknown
  misc_feature (1)..( 9): Result.005 file - promoters50/4767829
ataattttg

SEQ ID NO: 189072 - DNA, 9 bp, Unknown
  misc_feature (1)..( 9): Result.005 file - promoters50/4767829
ataattttc

SEQ ID NO: 189073 - DNA, 9 bp, Unknown
  misc_feature (1)..( 9): Result.005 file - promoters50/4767829
tgtattttc

SEQ ID NO: 189074 - DNA, 9 bp, Unknown
  misc_feature (1)..( 9): Result.005 file - promoters50/4767829
aagataaga

SEQ ID NO: 189075 - DNA, 9 bp, Unknown
  misc_feature (1)..( 9): Result.005 file - promoters50/4767829
aagaaaaga

SEQ ID NO: 189076 - DNA, 9 bp, Unknown
  misc_feature (1)..( 9): Result.005 file - promoters50/4767829
aataaaatt

SEQ ID NO: 189077 - DNA, 9 bp, Unknown
  misc_feature (1)..( 9): Result.005 file - promoters50/4767837
ttcttcaat

SEQ ID NO: 189078 - DNA, 9 bp, Unknown
  misc_feature (1)..( 9): Result.005 file - promoters50/4767837
ctcttcata

SEQ ID NO: 189079 - DNA, 9 bp, Unknown
  misc_feature (1)..( 9): Result.005 file - promoters50/4767837
ttctacaat

SEQ ID NO: 189080 - DNA, 12 bp, Unknown
  misc_feature (1)..( 12): Result.005 file - promoters50/4767837
acaaaaaacaat

SEQ ID NO: 189081 - DNA, 12 bp, Unknown
  misc_feature (1)..( 12): Result.005 file - promoters50/4767837
acaacaaaaaat

SEQ ID NO: 189082 - DNA, 12 bp, Unknown
  misc_feature (1)..( 12): Result.005 file - promoters50/4767837
ctaaaaaaccgg

SEQ ID NO: 189083 - DNA, 10 bp, Unknown
  misc_feature (1)..( 10): Result.005 file - promoters50/4767863
ataaaacata

SEQ ID NO: 189084 - DNA, 10 bp, Unknown
  misc_feature (1)..( 10): Result.005 file - promoters50/4767863
ttaaaatata

SEQ ID NO: 189085 - DNA, 10 bp, Unknown
  misc_feature (1)..( 10): Result.005 file - promoters50/4767863
ataaaagagg

SEQ ID NO: 189086 - DNA, 8 bp, Unknown
  misc_feature (1)..( 8): Result.005 file - promoters50/4767863
tagagaaa

SEQ ID NO: 189087 - DNA, 8 bp, Unknown
  misc_feature (1)..( 8): Result.005 file - promoters50/4767863
aagaaaaa

SEQ ID NO: 189088 - DNA, 8 bp, Unknown
  misc_feature (1)..( 8): Result.005 file - promoters50/4767863
aagaaagc

SEQ ID NO: 189089 - DNA, 8 bp, Unknown
  misc_feature (1)..( 8): Result.005 file - promoters50/4767871
ttagaagc

SEQ ID NO: 189090 - DNA, 8 bp, Unknown
  misc_feature (1)..( 8): Result.005 file - promoters50/4767871
ttagtagc

SEQ ID NO: 189091 - DNA, 8 bp, Unknown
  misc_feature (1)..( 8): Result.005 file - promoters50/4767871
ttagtaaa

SEQ ID NO: 189092 - DNA, 8 bp, Unknown
  misc_feature (1)..( 8): Result.005 file - promoters50/4767871
ttagtatt

SEQ ID NO: 189093 - DNA, 11 bp, Unknown
  misc_feature (1)..( 11): Result.005 file - promoters50/4767871
tagcactagac

SEQ ID NO: 189094 - DNA, 11 bp, Unknown
  misc_feature (1)..( 11): Result.005 file - promoters50/4767871
tagcaatagtg

SEQ ID NO: 189095 - DNA, 11 bp, Unknown
  misc_feature (1)..( 11): Result.005 file - promoters50/4767871
ttacaagagtg

SEQ ID NO: 189096 - DNA, 11 bp, Unknown
  misc_feature (1)..( 11): Result.005 file - promoters50/4767871
gatcaaaagta

SEQ ID NO: 189097 - DNA, 10 bp, Unknown
  misc_feature (1)..( 10): Result.005 file - promoters50/4767871
aaatttaatt

SEQ ID NO: 189098 - DNA, 10 bp, Unknown
  misc_feature (1)..( 10): Result.005 file - promoters50/4767871
caatctaact

SEQ ID NO: 189099 - DNA, 10 bp, Unknown
  misc_feature (1)..( 10): Result.005 file - promoters50/4767871
aaagttaatt

SEQ ID NO: 189100 - DNA, 10 bp, Unknown
  misc_feature (1)..( 10): Result.005 file - promoters50/4767871
gaatataatt

SEQ ID NO: 189101 - DNA, 9 bp, Unknown
  misc_feature (1)..( 9): Result.005 file - promoters50/4767871
ttatttatt

SEQ ID NO: 189102 - DNA, 9 bp, Unknown
  misc_feature (1)..( 9): Result.005 file - promoters50/4767871
ttatttaaa

SEQ ID NO: 189103 - DNA, 9 bp, Unknown
  misc_feature (1)..( 9): Result.005 file - promoters50/4767871
gaattaaaa

SEQ ID NO: 189104 - DNA, 9 bp, Unknown
  misc_feature (1)..( 9): Result.005 file - promoters50/4767871
atatataac

SEQ ID NO: 189105 - DNA, 8 bp, Unknown
  misc_feature (1)..( 8): Result.005 file - promoters50/4767871
ctttttta

SEQ ID NO: 189106 - DNA, 8 bp, Unknown
  misc_feature (1)..( 8): Result.005 file - promoters50/4767871
ttttgtta

SEQ ID NO: 189107 - DNA, 8 bp, Unknown
  misc_feature (1)..( 8): Result.005 file - promoters50/4767871
ctttttgt

SEQ ID NO: 189108 - DNA, 8 bp, Unknown
  misc_feature (1)..( 8): Result.005 file - promoters50/4767871
ttttctgt

SEQ ID NO: 189109 - DNA, 12 bp, Unknown
  misc_feature (1)..( 12): Result.005 file - promoters50/4767871
atttaaacattt

SEQ ID NO: 189110 - DNA, 12 bp, Unknown
  misc_feature (1)..( 12): Result.005 file - promoters50/4767871
taataaacattt

SEQ ID NO: 189111 - DNA, 12 bp, Unknown
  misc_feature (1)..( 12): Result.005 file - promoters50/4767871
gaataaacttat

SEQ ID NO: 189112 - DNA, 12 bp, Unknown
  misc_feature (1)..( 12): Result.005 file - promoters50/4767871
gaagaaattatg

SEQ ID NO: 189113 - DNA, 13 bp, Unknown
  misc_feature (1)..( 13): Result.005 file - promoters50/4767877
tgtgaagattaga

SEQ ID NO: 189114 - DNA, 13 bp, Unknown
  misc_feature (1)..( 13): Result.005 file - promoters50/4767877
aatgaaaatttgt

SEQ ID NO: 189115 - DNA, 13 bp, Unknown
  misc_feature (1)..( 13): Result.005 file - promoters50/4767877
tgtcaagctccga

SEQ ID NO: 189116 - DNA, 13 bp, Unknown
  misc_feature (1)..( 13): Result.005 file - promoters50/4767877
ctttacaattaaa

SEQ ID NO: 189117 - DNA, 14 bp, Unknown
  misc_feature (1)..( 14): Result.005 file - promoters50/4767884
ttctacatagtttc

SEQ ID NO: 189118 - DNA, 14 bp, Unknown
  misc_feature (1)..( 14): Result.005 file - promoters50/4767884
tagaatatactttc

SEQ ID NO: 189119 - DNA, 13 bp, Unknown
  misc_feature (1)..( 13): Result.005 file - promoters50/4767884
ttaatatacgttc

SEQ ID NO: 189120 - DNA, 13 bp, Unknown
  misc_feature (1)..( 13): Result.005 file - promoters50/4767884
ttaaaatattcga

SEQ ID NO: 189121 - DNA, 13 bp, Unknown
  misc_feature (1)..( 13): Result.005 file - promoters50/4767884
gtaaaattagata

SEQ ID NO: 189122 - DNA, 14 bp, Unknown
  misc_feature (1)..( 14): Result.005 file - promoters50/4767884
acaaagatttgagg

SEQ ID NO: 189123 - DNA, 12 bp, Unknown
  misc_feature (1)..( 12): Result.005 file - promoters50/4767884
taacccaaaaag

SEQ ID NO: 189124 - DNA, 12 bp, Unknown
  misc_feature (1)..( 12): Result.005 file - promoters50/4767884
taatccaaaata

SEQ ID NO: 189125 - DNA, 13 bp, Unknown
  misc_feature (1)..( 13): Result.005 file - promoters50/4767884
gcaaacaacaaga

SEQ ID NO: 189126 - DNA, 13 bp, Unknown
  misc_feature (1)..( 13): Result.005 file - promoters50/4767884
taacccgaaccgg

SEQ ID NO: 189127 - DNA, 13 bp, Unknown
  misc_feature (1)..( 13): Result.005 file - promoters50/4767884
cttatcaagatag

SEQ ID NO: 189128 - DNA, 13 bp, Unknown
  misc_feature (1)..( 13): Result.005 file - promoters50/4767884
cgcttcagaaagg

SEQ ID NO: 189129 - DNA, 11 bp, Unknown
  misc_feature (1)..( 11): Result.005 file - promoters50/4767884
aaaaagaatta

SEQ ID NO: 189130 - DNA, 11 bp, Unknown
  misc_feature (1)..( 11): Result.005 file - promoters50/4767884
taaaataataa

SEQ ID NO: 189131 - DNA, 12 bp, Unknown
  misc_feature (1)..( 12): Result.005 file - promoters50/4767884
caacaagatttc

SEQ ID NO: 189132 - DNA, 12 bp, Unknown
  misc_feature (1)..( 12): Result.005 file - promoters50/4767884
agaaaggaacta

SEQ ID NO: 189133 - DNA, 12 bp, Unknown
  misc_feature (1)..( 12): Result.005 file - promoters50/4767884
cataaaatctgg

SEQ ID NO: 189134 - DNA, 12 bp, Unknown
  misc_feature (1)..( 12): Result.005 file - promoters50/4767884
tatcaagatagg

SEQ ID NO: 189135 - DNA, 12 bp, Unknown
  misc_feature (1)..( 12): Result.005 file - promoters50/4767892
acttacaaaaac

SEQ ID NO: 189136 - DNA, 12 bp, Unknown
  misc_feature (1)..( 12): Result.005 file - promoters50/4767892
tattacgaaaac

SEQ ID NO: 189137 - DNA, 12 bp, Unknown
  misc_feature (1)..( 12): Result.005 file - promoters50/4767892
taatactaaata

SEQ ID NO: 189138 - DNA, 12 bp, Unknown
  misc_feature (1)..( 12): Result.005 file - promoters50/4767892
tattataaagtt

SEQ ID NO: 189139 - DNA, 12 bp, Unknown
  misc_feature (1)..( 12): Result.005 file - promoters50/4767892
gaatactaatcc

SEQ ID NO: 189140 - DNA, 12 bp, Unknown
  misc_feature (1)..( 12): Result.005 file - promoters50/4767892
ctatataaatta

SEQ ID NO: 189141 - DNA, 12 bp, Unknown
  misc_feature (1)..( 12): Result.005 file - promoters50/4767892
tcatataatatt

SEQ ID NO: 189142 - DNA, 9 bp, Unknown
  misc_feature (1)..( 9): Result.005 file - promoters50/4767892
tcgtatact

SEQ ID NO: 189143 - DNA, 9 bp, Unknown
  misc_feature (1)..( 9): Result.005 file - promoters50/4767892
atgtaaact

SEQ ID NO: 189144 - DNA, 9 bp, Unknown
  misc_feature (1)..( 9): Result.005 file - promoters50/4767892
ttgttaaca

SEQ ID NO: 189145 - DNA, 9 bp, Unknown
  misc_feature (1)..( 9): Result.005 file - promoters50/4767892
ttgtcaacc

SEQ ID NO: 189146 - DNA, 9 bp, Unknown
  misc_feature (1)..( 9): Result.005 file - promoters50/4767892
ttgttatgg

SEQ ID NO: 189147 - DNA, 9 bp, Unknown
  misc_feature (1)..( 9): Result.005 file - promoters50/4767892
ttggtatga

SEQ ID NO: 189148 - DNA, 7 bp, Unknown
  misc_feature (1)..( 7): Result.005 file - promoters50/4767929
ttgatct

SEQ ID NO: 189149 - DNA, 7 bp, Unknown
  misc_feature (1)..( 7): Result.005 file - promoters50/4767929
ttgatca

SEQ ID NO: 189150 - DNA, 7 bp, Unknown
  misc_feature (1)..( 7): Result.005 file - promoters50/4767929
ctgatca

SEQ ID NO: 189151 - DNA, 7 bp, Unknown
  misc_feature (1)..( 7): Result.005 file - promoters50/4767929
atttgtt

SEQ ID NO: 189152 - DNA, 7 bp, Unknown
  misc_feature (1)..( 7): Result.005 file - promoters50/4767929
atttgtg

SEQ ID NO: 189153 - DNA, 7 bp, Unknown
  misc_feature (1)..( 7): Result.005 file - promoters50/4767929
ttttgtt

SEQ ID NO: 189154 - DNA, 9 bp, Unknown
  misc_feature (1)..( 9): Result.005 file - promoters50/4767929
ttaataaca

SEQ ID NO: 189155 - DNA, 9 bp, Unknown
  misc_feature (1)..( 9): Result.005 file - promoters50/4767929
gtaaaaaca

SEQ ID NO: 189156 - DNA, 9 bp, Unknown
  misc_feature (1)..( 9): Result.005 file - promoters50/4767929
ttaatatag

SEQ ID NO: 189157 - DNA, 8 bp, Unknown
  misc_feature (1)..( 8): Result.005 file - promoters50/4767929
tctcagtg

SEQ ID NO: 189158 - DNA, 8 bp, Unknown
  misc_feature (1)..( 8): Result.005 file - promoters50/4767929
tcttagtg

SEQ ID NO: 189159 - DNA, 8 bp, Unknown
  misc_feature (1)..( 8): Result.005 file - promoters50/4767929
tctaagta

SEQ ID NO: 189160 - DNA, 8 bp, Unknown
  misc_feature (1)..( 8): Result.005 file - promoters50/4767929
tttcaaga

SEQ ID NO: 189161 - DNA, 8 bp, Unknown
  misc_feature (1)..( 8): Result.005 file - promoters50/4767929
tttcaatt

SEQ ID NO: 189162 - DNA, 8 bp, Unknown
  misc_feature (1)..( 8): Result.005 file - promoters50/4767929
gttcaatt

SEQ ID NO: 189163 - DNA, 8 bp, Unknown
  misc_feature (1)..( 8): Result.005 file - promoters50/4767933
atcgaaaa

SEQ ID NO: 189164 - DNA, 8 bp, Unknown
  misc_feature (1)..( 8): Result.005 file - promoters50/4767933
atccaaaa

SEQ ID NO: 189165 - DNA, 8 bp, Unknown
  misc_feature (1)..( 8): Result.005 file - promoters50/4767933
atccaaat

SEQ ID NO: 189166 - DNA, 7 bp, Unknown
  misc_feature (1)..( 7): Result.005 file - promoters50/4767933
tcctttt

SEQ ID NO: 189167 - DNA, 7 bp, Unknown
  misc_feature (1)..( 7): Result.005 file - promoters50/4767933
tccttta

SEQ ID NO: 189168 - DNA, 7 bp, Unknown
  misc_feature (1)..( 7): Result.005 file - promoters50/4767933
tccatta

SEQ ID NO: 189169 - DNA, 10 bp, Unknown
  misc_feature (1)..( 10): Result.005 file - promoters50/4767933
ttacaaatta

SEQ ID NO: 189170 - DNA, 10 bp, Unknown
  misc_feature (1)..( 10): Result.005 file - promoters50/4767933
ttaaaaactc

SEQ ID NO: 189171 - DNA, 10 bp, Unknown
  misc_feature (1)..( 10): Result.005 file - promoters50/4767933
gaaaaaactc

SEQ ID NO: 189172 - DNA, 10 bp, Unknown
  misc_feature (1)..( 10): Result.005 file - promoters50/4767933
aaattgaaac

SEQ ID NO: 189173 - DNA, 10 bp, Unknown
  misc_feature (1)..( 10): Result.005 file - promoters50/4767933
ccgttgaaaa

SEQ ID NO: 189174 - DNA, 10 bp, Unknown
  misc_feature (1)..( 10): Result.005 file - promoters50/4767933
aaatggaaac

SEQ ID NO: 189175 - DNA, 10 bp, Unknown
  misc_feature (1)..( 10): Result.005 file - promoters50/4767948
gtatacaaaa

SEQ ID NO: 189176 - DNA, 10 bp, Unknown
  misc_feature (1)..( 10): Result.005 file - promoters50/4767948
atatacgaaa

SEQ ID NO: 189177 - DNA, 10 bp, Unknown
  misc_feature (1)..( 10): Result.005 file - promoters50/4767948
gtaaacaaaa

SEQ ID NO: 189178 - DNA, 9 bp, Unknown
  misc_feature (1)..( 9): Result.005 file - promoters50/4767952
aattaaatt

SEQ ID NO: 189179 - DNA, 9 bp, Unknown
  misc_feature (1)..( 9): Result.005 file - promoters50/4767952
ttttacatt

SEQ ID NO: 189180 - DNA, 9 bp, Unknown
  misc_feature (1)..( 9): Result.005 file - promoters50/4767952
tattaaatg

SEQ ID NO: 189181 - DNA, 9 bp, Unknown
  misc_feature (1)..( 9): Result.005 file - promoters50/4767952
tattaaatg

SEQ ID NO: 189182 - DNA, 9 bp, Unknown
  misc_feature (1)..( 9): Result.005 file - promoters50/4767952
aatgaaacg

SEQ ID NO: 189183 - DNA, 9 bp, Unknown
  misc_feature (1)..( 9): Result.005 file - promoters50/4767952
tttgacata

SEQ ID NO: 189184 - DNA, 9 bp, Unknown
  misc_feature (1)..( 9): Result.005 file - promoters50/4767952
agatcaatt

SEQ ID NO: 189185 - DNA, 9 bp, Unknown
  misc_feature (1)..( 9): Result.005 file - promoters50/4767952
ggatcaaag

SEQ ID NO: 189186 - DNA, 9 bp, Unknown
  misc_feature (1)..( 9): Result.005 file - promoters50/4767952
agaccaaaa

SEQ ID NO: 189187 - DNA, 9 bp, Unknown
  misc_feature (1)..( 9): Result.005 file - promoters50/4767952
ttatcgatt

SEQ ID NO: 189188 - DNA, 9 bp, Unknown
  misc_feature (1)..( 9): Result.005 file - promoters50/4767952
gaatcaaat

SEQ ID NO: 189189 - DNA, 9 bp, Unknown
  misc_feature (1)..( 9): Result.005 file - promoters50/4767952
aaatcaaaa

SEQ ID NO: 189190 - DNA, 11 bp, Unknown
  misc_feature (1)..( 11): Result.005 file - promoters50/4767956
aaaacataatt

SEQ ID NO: 189191 - DNA, 11 bp, Unknown
  misc_feature (1)..( 11): Result.005 file - promoters50/4767956
tgaacttaatt

SEQ ID NO: 189192 - DNA, 11 bp, Unknown
  misc_feature (1)..( 11): Result.005 file - promoters50/4767956
caaacatatcc

SEQ ID NO: 189193 - DNA, 11 bp, Unknown
  misc_feature (1)..( 11): Result.005 file - promoters50/4767956
caaccattcag

SEQ ID NO: 189194 - DNA, 9 bp, Unknown
  misc_feature (1)..( 9): Result.005 file - promoters50/4767956
caaacaaag

SEQ ID NO: 189195 - DNA, 9 bp, Unknown
  misc_feature (1)..( 9): Result.005 file - promoters50/4767956
gaaaaaaat

SEQ ID NO: 189196 - DNA, 9 bp, Unknown
  misc_feature (1)..( 9): Result.005 file - promoters50/4767956
caaacatat

SEQ ID NO: 189197 - DNA, 9 bp, Unknown
  misc_feature (1)..( 9): Result.005 file - promoters50/4767956
gaaggaaaa

SEQ ID NO: 189198 - DNA, 7 bp, Unknown
  misc_feature (1)..( 7): Result.005 file - promoters50/4767960
actttga

SEQ ID NO: 189199 - DNA, 7 bp, Unknown
  misc_feature (1)..( 7): Result.005 file - promoters50/4767960
tctttga

SEQ ID NO: 189200 - DNA, 7 bp, Unknown
  misc_feature (1)..( 7): Result.005 file - promoters50/4767960
tctttgg

SEQ ID NO: 189201 - DNA, 8 bp, Unknown
  misc_feature (1)..( 8): Result.005 file - promoters50/4767960
tcaacaaa

SEQ ID NO: 189202 - DNA, 8 bp, Unknown
  misc_feature (1)..( 8): Result.005 file - promoters50/4767960
tcatcaat

SEQ ID NO: 189203 - DNA, 8 bp, Unknown
  misc_feature (1)..( 8): Result.005 file - promoters50/4767960
acaagaaa

SEQ ID NO: 189204 - DNA, 8 bp, Unknown
  misc_feature (1)..( 8): Result.005 file - promoters50/4767960
tcatcaag

SEQ ID NO: 189205 - DNA, 7 bp, Unknown
  misc_feature (1)..( 7): Result.005 file - promoters50/4767960
gcagaat

SEQ ID NO: 189206 - DNA, 7 bp, Unknown
  misc_feature (1)..( 7): Result.005 file - promoters50/4767960
tcagaat

SEQ ID NO: 189207 - DNA, 7 bp, Unknown
  misc_feature (1)..( 7): Result.005 file - promoters50/4767960
gcagaat

SEQ ID NO: 189208 - DNA, 7 bp, Unknown
  misc_feature (1)..( 7): Result.005 file - promoters50/4767972
taaaatt

SEQ ID NO: 189209 - DNA, 7 bp, Unknown
  misc_feature (1)..( 7): Result.005 file - promoters50/4767972
taaaatc

SEQ ID NO: 189210 - DNA, 7 bp, Unknown
  misc_feature (1)..( 7): Result.005 file - promoters50/4767972
aaaaatc

SEQ ID NO: 189211 - DNA, 7 bp, Unknown
  misc_feature (1)..( 7): Result.005 file - promoters50/4767972
aaaaatg

SEQ ID NO: 189212 - DNA, 10 bp, Unknown
  misc_feature (1)..( 10): Result.005 file - promoters50/4767972
gaaaatgatt

SEQ ID NO: 189213 - DNA, 10 bp, Unknown
  misc_feature (1)..( 10): Result.005 file - promoters50/4767972
gtaaataatt

SEQ ID NO: 189214 - DNA, 10 bp, Unknown
  misc_feature (1)..( 10): Result.005 file - promoters50/4767972
gaaaatgaaa

SEQ ID NO: 189215 - DNA, 10 bp, Unknown
  misc_feature (1)..( 10): Result.005 file - promoters50/4767972
caaaaaaatt

SEQ ID NO: 189216 - DNA, 10 bp, Unknown
  misc_feature (1)..( 10): Result.005 file - promoters50/4767972
tgaaacgaat

SEQ ID NO: 189217 - DNA, 13 bp, Unknown
  misc_feature (1)..( 13): Result.005 file - promoters50/4767972
aacaaaaatattt

SEQ ID NO: 189218 - DNA, 13 bp, Unknown
  misc_feature (1)..( 13): Result.005 file - promoters50/4767972
taaaaaaagattt

SEQ ID NO: 189219 - DNA, 13 bp, Unknown
  misc_feature (1)..( 13): Result.005 file - promoters50/4767972
aacaaaaataatc

SEQ ID NO: 189220 - DNA, 13 bp, Unknown
  misc_feature (1)..( 13): Result.005 file - promoters50/4767972
agaaaaaattgtt

SEQ ID NO: 189221 - DNA, 15 bp, Unknown
  misc_feature (1)..( 15): Result.005 file - promoters50/4767972
tatttagaatatctt

SEQ ID NO: 189222 - DNA, 15 bp, Unknown
  misc_feature (1)..( 15): Result.005 file - promoters50/4767972
tatttaaaataatat

SEQ ID NO: 189223 - DNA, 15 bp, Unknown
  misc_feature (1)..( 15): Result.005 file - promoters50/4767972
tatttattggttatt

SEQ ID NO: 189224 - DNA, 15 bp, Unknown
  misc_feature (1)..( 15): Result.005 file - promoters50/4767972
actcgaaaatataca

SEQ ID NO: 189225 - DNA, 15 bp, Unknown
  misc_feature (1)..( 15): Result.005 file - promoters50/4767972
gcgggaagataaaca

SEQ ID NO: 189226 - DNA, 12 bp, Unknown
  misc_feature (1)..( 12): Result.005 file - promoters50/4767972
tcttataatatt

SEQ ID NO: 189227 - DNA, 12 bp, Unknown
  misc_feature (1)..( 12): Result.005 file - promoters50/4767972
taaaataatata

SEQ ID NO: 189228 - DNA, 12 bp, Unknown
  misc_feature (1)..( 12): Result.005 file - promoters50/4767972
ttatgtaatatt

SEQ ID NO: 189229 - DNA, 12 bp, Unknown
  misc_feature (1)..( 12): Result.005 file - promoters50/4767972
ctcgaaaatata

SEQ ID NO: 189230 - DNA, 12 bp, Unknown
  misc_feature (1)..( 12): Result.005 file - promoters50/4767972
gaagataaacat

SEQ ID NO: 189231 - DNA, 10 bp, Unknown
  misc_feature (1)..( 10): Result.005 file - promoters50/4767972
atgaagaatc

SEQ ID NO: 189232 - DNA, 10 bp, Unknown
  misc_feature (1)..( 10): Result.005 file - promoters50/4767972
aagaaaaata

SEQ ID NO: 189233 - DNA, 10 bp, Unknown
  misc_feature (1)..( 10): Result.005 file - promoters50/4767972
gaaaacaatt

SEQ ID NO: 189234 - DNA, 10 bp, Unknown
  misc_feature (1)..( 10): Result.005 file - promoters50/4767972
aagaaaaaga

SEQ ID NO: 189235 - DNA, 10 bp, Unknown
  misc_feature (1)..( 10): Result.005 file - promoters50/4767972
ttcctaattt

SEQ ID NO: 189236 - DNA, 10 bp, Unknown
  misc_feature (1)..( 10): Result.005 file - promoters50/4767972
ttcgtaatta

SEQ ID NO: 189237 - DNA, 10 bp, Unknown
  misc_feature (1)..( 10): Result.005 file - promoters50/4767972
taactatttt

SEQ ID NO: 189238 - DNA, 10 bp, Unknown
  misc_feature (1)..( 10): Result.005 file - promoters50/4767972
aacttatttt

SEQ ID NO: 189239 - DNA, 8 bp, Unknown
  misc_feature (1)..( 8): Result.005 file - promoters50/4767976
tttcaata

SEQ ID NO: 189240 - DNA, 8 bp, Unknown
  misc_feature (1)..( 8): Result.005 file - promoters50/4767976
ttttaatt

SEQ ID NO: 189241 - DNA, 8 bp, Unknown
  misc_feature (1)..( 8): Result.005 file - promoters50/4767976
gcttaatt

SEQ ID NO: 189242 - DNA, 11 bp, Unknown
  misc_feature (1)..( 11): Result.005 file - promoters50/4767976
tgtattaactt

SEQ ID NO: 189243 - DNA, 11 bp, Unknown
  misc_feature (1)..( 11): Result.005 file - promoters50/4767976
tgtgttaataa

SEQ ID NO: 189244 - DNA, 11 bp, Unknown
  misc_feature (1)..( 11): Result.005 file - promoters50/4767976
cgaatttactt

SEQ ID NO: 189245 - DNA, 8 bp, Unknown
  misc_feature (1)..( 8): Result.005 file - promoters50/4767976
tcaaatat

SEQ ID NO: 189246 - DNA, 8 bp, Unknown
  misc_feature (1)..( 8): Result.005 file - promoters50/4767976
tcaaatca

SEQ ID NO: 189247 - DNA, 8 bp, Unknown
  misc_feature (1)..( 8): Result.005 file - promoters50/4767976
tcatatca

SEQ ID NO: 189248 - DNA, 9 bp, Unknown
  misc_feature (1)..( 9): Result.005 file - promoters50/4767978
ttggtaaag

SEQ ID NO: 189249 - DNA, 9 bp, Unknown
  misc_feature (1)..( 9): Result.005 file - promoters50/4767978
ttggtaaat

SEQ ID NO: 189250 - DNA, 9 bp, Unknown
  misc_feature (1)..( 9): Result.005 file - promoters50/4767978
ttggaaaaa

SEQ ID NO: 189251 - DNA, 9 bp, Unknown
  misc_feature (1)..( 9): Result.005 file - promoters50/4767978
ttggaaagt

SEQ ID NO: 189252 - DNA, 9 bp, Unknown
  misc_feature (1)..( 9): Result.005 file - promoters50/4767978
atggtaaga

SEQ ID NO: 189253 - DNA, 9 bp, Unknown
  misc_feature (1)..( 9): Result.005 file - promoters50/4767978
ttggaaaga

SEQ ID NO: 189254 - DNA, 8 bp, Unknown
  misc_feature (1)..( 8): Result.005 file - promoters50/4767990
gtaatttg

SEQ ID NO: 189255 - DNA, 8 bp, Unknown
  misc_feature (1)..( 8): Result.005 file - promoters50/4767990
caaatttg

SEQ ID NO: 189256 - DNA, 8 bp, Unknown
  misc_feature (1)..( 8): Result.005 file - promoters50/4767990
caaagttg

SEQ ID NO: 189257 - DNA, 8 bp, Unknown
  misc_feature (1)..( 8): Result.005 file - promoters50/4768000
ctcaattt

SEQ ID NO: 189258 - DNA, 8 bp, Unknown
  misc_feature (1)..( 8): Result.005 file - promoters50/4768000
ctcaattc

SEQ ID NO: 189259 - DNA, 8 bp, Unknown
  misc_feature (1)..( 8): Result.005 file - promoters50/4768000
cacaattt

SEQ ID NO: 189260 - DNA, 9 bp, Unknown
  misc_feature (1)..( 9): Result.005 file - promoters50/4768000
taattgaaa

SEQ ID NO: 189261 - DNA, 9 bp, Unknown
  misc_feature (1)..( 9): Result.005 file - promoters50/4768000
taattcaaa

SEQ ID NO: 189262 - DNA, 9 bp, Unknown
  misc_feature (1)..( 9): Result.005 file - promoters50/4768000
taatggaac

SEQ ID NO: 189263 - DNA, 7 bp, Unknown
  misc_feature (1)..( 7): Result.005 file - promoters50/4768000
ttagtta

SEQ ID NO: 189264 - DNA, 7 bp, Unknown
  misc_feature (1)..( 7): Result.005 file - promoters50/4768000
ttattta

SEQ ID NO: 189265 - DNA, 7 bp, Unknown
  misc_feature (1)..( 7): Result.005 file - promoters50/4768000
ttatttt

SEQ ID NO: 189266 - DNA, 7 bp, Unknown
  misc_feature (1)..( 7): Result.005 file - promoters50/4768000
ttagttt

SEQ ID NO: 189267 - DNA, 7 bp, Unknown
  misc_feature (1)..( 7): Result.005 file - promoters50/4768000
ttatttt

SEQ ID NO: 189268 - DNA, 7 bp, Unknown
  misc_feature (1)..( 7): Result.005 file - promoters50/4768000
ttattta

SEQ ID NO: 189269 - DNA, 10 bp, Unknown
  misc_feature (1)..( 10): Result.005 file - promoters50/4768000
tttttttatc

SEQ ID NO: 189270 - DNA, 10 bp, Unknown
  misc_feature (1)..( 10): Result.005 file - promoters50/4768000
tttttttaaa

SEQ ID NO: 189271 - DNA, 10 bp, Unknown
  misc_feature (1)..( 10): Result.005 file - promoters50/4768000
tcttttgaaa

SEQ ID NO: 189272 - DNA, 7 bp, Unknown
  misc_feature (1)..( 7): Result.005 file - promoters50/4768000
ttaaatt

SEQ ID NO: 189273 - DNA, 7 bp, Unknown
  misc_feature (1)..( 7): Result.005 file - promoters50/4768000
ttacatt

SEQ ID NO: 189274 - DNA, 7 bp, Unknown
  misc_feature (1)..( 7): Result.005 file - promoters50/4768000
ttacatc

SEQ ID NO: 189275 - DNA, 15 bp, Unknown
  misc_feature (1)..( 15): Result.005 file - promoters50/4768007
aaagaaaataataat

SEQ ID NO: 189276 - DNA, 15 bp, Unknown
  misc_feature (1)..( 15): Result.005 file - promoters50/4768007
aaaaaaaataagaat

SEQ ID NO: 189277 - DNA, 15 bp, Unknown
  misc_feature (1)..( 15): Result.005 file - promoters50/4768007
tttaaaaatactata

SEQ ID NO: 189278 - DNA, 15 bp, Unknown
  misc_feature (1)..( 15): Result.005 file - promoters50/4768007
tgtttgtataataaa

SEQ ID NO: 189279 - DNA, 15 bp, Unknown
  misc_feature (1)..( 15): Result.005 file - promoters50/4768007
ctaaattttaataaa

SEQ ID NO: 189280 - DNA, 15 bp, Unknown
  misc_feature (1)..( 15): Result.005 file - promoters50/4768007
aaacaacccaagaat

SEQ ID NO: 189281 - DNA, 15 bp, Unknown
  misc_feature (1)..( 15): Result.005 file - promoters50/4768007
gagatagataagacg

SEQ ID NO: 189282 - DNA, 10 bp, Unknown
  misc_feature (1)..( 10): Result.005 file - promoters50/4768007
ctttccacac

SEQ ID NO: 189283 - DNA, 10 bp, Unknown
  misc_feature (1)..( 10): Result.005 file - promoters50/4768007
ctttccatct

SEQ ID NO: 189284 - DNA, 10 bp, Unknown
  misc_feature (1)..( 10): Result.005 file - promoters50/4768007
ctttcctctc

SEQ ID NO: 189285 - DNA, 10 bp, Unknown
  misc_feature (1)..( 10): Result.005 file - promoters50/4768007
gtttccttct

SEQ ID NO: 189286 - DNA, 10 bp, Unknown
  misc_feature (1)..( 10): Result.005 file - promoters50/4768007
cattccatta

SEQ ID NO: 189287 - DNA, 10 bp, Unknown
  misc_feature (1)..( 10): Result.005 file - promoters50/4768007
ggttcctttg

SEQ ID NO: 189288 - DNA, 10 bp, Unknown
  misc_feature (1)..( 10): Result.005 file - promoters50/4768007
ctatatatag

SEQ ID NO: 189289 - DNA, 10 bp, Unknown
  misc_feature (1)..( 10): Result.005 file - promoters50/4768007
ttatatatag

SEQ ID NO: 189290 - DNA, 10 bp, Unknown
  misc_feature (1)..( 10): Result.005 file - promoters50/4768007
atatataaat

SEQ ID NO: 189291 - DNA, 10 bp, Unknown
  misc_feature (1)..( 10): Result.005 file - promoters50/4768007
ctatatataa

SEQ ID NO: 189292 - DNA, 10 bp, Unknown
  misc_feature (1)..( 10): Result.005 file - promoters50/4768007
ttatatcttt

SEQ ID NO: 189293 - DNA, 10 bp, Unknown
  misc_feature (1)..( 10): Result.005 file - promoters50/4768007
ttatatcttc

SEQ ID NO: 189294 - DNA, 15 bp, Unknown
  misc_feature (1)..( 15): Result.005 file - promoters50/4768007
atccaaataaaatat

SEQ ID NO: 189295 - DNA, 15 bp, Unknown
  misc_feature (1)..( 15): Result.005 file - promoters50/4768007
ttcgtaataaaaaac

SEQ ID NO: 189296 - DNA, 15 bp, Unknown
  misc_feature (1)..( 15): Result.005 file - promoters50/4768007
agcgaaacaaaaaaa

SEQ ID NO: 189297 - DNA, 15 bp, Unknown
  misc_feature (1)..( 15): Result.005 file - promoters50/4768007
atttctttaaactat

SEQ ID NO: 189298 - DNA, 15 bp, Unknown
  misc_feature (1)..( 15): Result.005 file - promoters50/4768007
tgtttaacaaaaaaa

SEQ ID NO: 189299 - DNA, 15 bp, Unknown
  misc_feature (1)..( 15): Result.005 file - promoters50/4768007
tgtttcacatatagt

SEQ ID NO: 189300 - DNA, 15 bp, Unknown
  misc_feature (1)..( 15): Result.005 file - promoters50/4768007
ttcttaatctagtcg

SEQ ID NO: 189301 - DNA, 15 bp, Unknown
  misc_feature (1)..( 15): Result.005 file - promoters50/4768007
aaagaaacaagaaag

SEQ ID NO: 189302 - DNA, 10 bp, Unknown
  misc_feature (1)..( 10): Result.005 file - promoters50/4768007
aaataaaagc

SEQ ID NO: 189303 - DNA, 10 bp, Unknown
  misc_feature (1)..( 10): Result.005 file - promoters50/4768007
atataaaaaa

SEQ ID NO: 189304 - DNA, 10 bp, Unknown
  misc_feature (1)..( 10): Result.005 file - promoters50/4768007
caataaaatt

SEQ ID NO: 189305 - DNA, 10 bp, Unknown
  misc_feature (1)..( 10): Result.005 file - promoters50/4768007
gtatcaaaca

SEQ ID NO: 189306 - DNA, 10 bp, Unknown
  misc_feature (1)..( 10): Result.005 file - promoters50/4768007
atatgaaact

SEQ ID NO: 189307 - DNA, 10 bp, Unknown
  misc_feature (1)..( 10): Result.005 file - promoters50/4768007
agataatatt

SEQ ID NO: 189308 - DNA, 8 bp, Unknown
  misc_feature (1)..( 8): Result.005 file - promoters50/4768011
taatacaa

SEQ ID NO: 189309 - DNA, 8 bp, Unknown
  misc_feature (1)..( 8): Result.005 file - promoters50/4768011
taaaacaa

SEQ ID NO: 189310 - DNA, 8 bp, Unknown
  misc_feature (1)..( 8): Result.005 file - promoters50/4768011
aaatccaa

SEQ ID NO: 189311 - DNA, 11 bp, Unknown
  misc_feature (1)..( 11): Result.005 file - promoters50/4768011
aaaatcagtaa

SEQ ID NO: 189312 - DNA, 11 bp, Unknown
  misc_feature (1)..( 11): Result.005 file - promoters50/4768011
attagcagtaa

SEQ ID NO: 189313 - DNA, 11 bp, Unknown
  misc_feature (1)..( 11): Result.005 file - promoters50/4768011
aaaatccgtat

SEQ ID NO: 189314 - DNA, 8 bp, Unknown
  misc_feature (1)..( 8): Result.005 file - promoters50/4768011
caaatatt

SEQ ID NO: 189315 - DNA, 8 bp, Unknown
  misc_feature (1)..( 8): Result.005 file - promoters50/4768011
tgaatatt

SEQ ID NO: 189316 - DNA, 8 bp, Unknown
  misc_feature (1)..( 8): Result.005 file - promoters50/4768011
tgaatatg

SEQ ID NO: 189317 - DNA, 10 bp, Unknown
  misc_feature (1)..( 10): Result.005 file - promoters50/4768011
ccacaaaaca

SEQ ID NO: 189318 - DNA, 10 bp, Unknown
  misc_feature (1)..( 10): Result.005 file - promoters50/4768011
gtacaaaata

SEQ ID NO: 189319 - DNA, 10 bp, Unknown
  misc_feature (1)..( 10): Result.005 file - promoters50/4768011
gtaccaaata

SEQ ID NO: 189320 - DNA, 9 bp, Unknown
  misc_feature (1)..( 9): Result.005 file - promoters50/4768011
ttttttaat

SEQ ID NO: 189321 - DNA, 9 bp, Unknown
  misc_feature (1)..( 9): Result.005 file - promoters50/4768011
gatttaaat

SEQ ID NO: 189322 - DNA, 9 bp, Unknown
  misc_feature (1)..( 9): Result.005 file - promoters50/4768011
aattgaaaa

SEQ ID NO: 189323 - DNA, 9 bp, Unknown
  misc_feature (1)..( 9): Result.005 file - promoters50/4768011
aattcaaat

SEQ ID NO: 189324 - DNA, 8 bp, Unknown
  misc_feature (1)..( 8): Result.005 file - promoters50/4768011
gtttccac

SEQ ID NO: 189325 - DNA, 8 bp, Unknown
  misc_feature (1)..( 8): Result.005 file - promoters50/4768011
atttccaa

SEQ ID NO: 189326 - DNA, 8 bp, Unknown
  misc_feature (1)..( 8): Result.005 file - promoters50/4768011
attttcaa

SEQ ID NO: 189327 - DNA, 12 bp, Unknown
  misc_feature (1)..( 12): Result.005 file - promoters50/4768011
ccacaaaacaaa

SEQ ID NO: 189328 - DNA, 12 bp, Unknown
  misc_feature (1)..( 12): Result.005 file - promoters50/4768011
gtaccaaataaa

SEQ ID NO: 189329 - DNA, 12 bp, Unknown
  misc_feature (1)..( 12): Result.005 file - promoters50/4768011
gtacaaaatata

SEQ ID NO: 189330 - DNA, 11 bp, Unknown
  misc_feature (1)..( 11): Result.005 file - promoters50/4768011
aatagattttt

SEQ ID NO: 189331 - DNA, 11 bp, Unknown
  misc_feature (1)..( 11): Result.005 file - promoters50/4768011
tttagactttt

SEQ ID NO: 189332 - DNA, 11 bp, Unknown
  misc_feature (1)..( 11): Result.005 file - promoters50/4768011
tttagacacga

SEQ ID NO: 189333 - DNA, 11 bp, Unknown
  misc_feature (1)..( 11): Result.005 file - promoters50/4768027
aaaagcttgtt

SEQ ID NO: 189334 - DNA, 11 bp, Unknown
  misc_feature (1)..( 11): Result.005 file - promoters50/4768027
aaaaccttagt

SEQ ID NO: 189335 - DNA, 11 bp, Unknown
  misc_feature (1)..( 11): Result.005 file - promoters50/4768027
gaaagattgtt

SEQ ID NO: 189336 - DNA, 8 bp, Unknown
  misc_feature (1)..( 8): Result.005 file - promoters50/4768027
gtttattc

SEQ ID NO: 189337 - DNA, 8 bp, Unknown
  misc_feature (1)..( 8): Result.005 file - promoters50/4768027
gttaatta

SEQ ID NO: 189338 - DNA, 8 bp, Unknown
  misc_feature (1)..( 8): Result.005 file - promoters50/4768027
gttagtta

SEQ ID NO: 189339 - DNA, 12 bp, Unknown
  misc_feature (1)..( 12): Result.005 file - promoters50/4768027
aggatttgtgat

SEQ ID NO: 189340 - DNA, 12 bp, Unknown
  misc_feature (1)..( 12): Result.005 file - promoters50/4768027
aaagtttctgaa

SEQ ID NO: 189341 - DNA, 12 bp, Unknown
  misc_feature (1)..( 12): Result.005 file - promoters50/4768027
aggaattgagat

SEQ ID NO: 189342 - DNA, 13 bp, Unknown
  misc_feature (1)..( 13): Result.005 file - promoters50/4768027
gaggatttgtgat

SEQ ID NO: 189343 - DNA, 13 bp, Unknown
  misc_feature (1)..( 13): Result.005 file - promoters50/4768027
tgggatttggtat

SEQ ID NO: 189344 - DNA, 13 bp, Unknown
  misc_feature (1)..( 13): Result.005 file - promoters50/4768027
aaggaattgagat

SEQ ID NO: 189345 - DNA, 13 bp, Unknown
  misc_feature (1)..( 13): Result.005 file - promoters50/4768027
gagcatttatgtg

SEQ ID NO: 189346 - DNA, 11 bp, Unknown
  misc_feature (1)..( 11): Result.005 file - promoters50/4768027
agaaaaaagga

SEQ ID NO: 189347 - DNA, 11 bp, Unknown
  misc_feature (1)..( 11): Result.005 file - promoters50/4768027
agataaaacag

SEQ ID NO: 189348 - DNA, 11 bp, Unknown
  misc_feature (1)..( 11): Result.005 file - promoters50/4768027
ggttaaaacag

SEQ ID NO: 189349 - DNA, 9 bp, Unknown
  misc_feature (1)..( 9): Result.005 file - promoters50/4768027
ggacaaagg

SEQ ID NO: 189350 - DNA, 9 bp, Unknown
  misc_feature (1)..( 9): Result.005 file - promoters50/4768027
tgacacagg

SEQ ID NO: 189351 - DNA, 9 bp, Unknown
  misc_feature (1)..( 9): Result.005 file - promoters50/4768027
tgatacatt

SEQ ID NO: 189352 - DNA, 8 bp, Unknown
  misc_feature (1)..( 8): Result.005 file - promoters50/4768027
gagttaaa

SEQ ID NO: 189353 - DNA, 8 bp, Unknown
  misc_feature (1)..( 8): Result.005 file - promoters50/4768027
gagttaac

SEQ ID NO: 189354 - DNA, 8 bp, Unknown
  misc_feature (1)..( 8): Result.005 file - promoters50/4768027
tagtcaaa

SEQ ID NO: 189355 - DNA, 6 bp, Unknown
  misc_feature (1)..( 6): Result.005 file - promoters50/4768027
aaaaca

SEQ ID NO: 189356 - DNA, 6 bp, Unknown
  misc_feature (1)..( 6): Result.005 file - promoters50/4768027
aaaaca

SEQ ID NO: 189357 - DNA, 6 bp, Unknown
  misc_feature (1)..( 6): Result.005 file - promoters50/4768027
aaaaca

SEQ ID NO: 189358 - DNA, 12 bp, Unknown
  misc_feature (1)..( 12): Result.005 file - promoters50/4768035
aattatgcatgt

SEQ ID NO: 189359 - DNA, 12 bp, Unknown
  misc_feature (1)..( 12): Result.005 file - promoters50/4768035
gttcatgcctgt

SEQ ID NO: 189360 - DNA, 12 bp, Unknown
  misc_feature (1)..( 12): Result.005 file - promoters50/4768035
gttcatgccaag

SEQ ID NO: 189361 - DNA, 12 bp, Unknown
  misc_feature (1)..( 12): Result.005 file - promoters50/4768039
attaatataata

SEQ ID NO: 189362 - DNA, 12 bp, Unknown
  misc_feature (1)..( 12): Result.005 file - promoters50/4768039
tttattatagat

SEQ ID NO: 189363 - DNA, 12 bp, Unknown
  misc_feature (1)..( 12): Result.005 file - promoters50/4768039
cacattatcgat

SEQ ID NO: 189364 - DNA, 12 bp, Unknown
  misc_feature (1)..( 12): Result.005 file - promoters50/4768039
ttttttattttt

SEQ ID NO: 189365 - DNA, 12 bp, Unknown
  misc_feature (1)..( 12): Result.005 file - promoters50/4768039
tttgttagaaag

SEQ ID NO: 189366 - DNA, 12 bp, Unknown
  misc_feature (1)..( 12): Result.005 file - promoters50/4768039
atttctatgtgt

SEQ ID NO: 189367 - DNA, 11 bp, Unknown
  misc_feature (1)..( 11): Result.005 file - promoters50/4768039
caaaaaaaaag

SEQ ID NO: 189368 - DNA, 11 bp, Unknown
  misc_feature (1)..( 11): Result.005 file - promoters50/4768039
caaacaaaaat

SEQ ID NO: 189369 - DNA, 11 bp, Unknown
  misc_feature (1)..( 11): Result.005 file - promoters50/4768039
ggaagaaaaag

SEQ ID NO: 189370 - DNA, 12 bp, Unknown
  misc_feature (1)..( 12): Result.005 file - promoters50/4768039
ataacaataaat

SEQ ID NO: 189371 - DNA, 12 bp, Unknown
  misc_feature (1)..( 12): Result.005 file - promoters50/4768039
ttaaaaataaac

SEQ ID NO: 189372 - DNA, 12 bp, Unknown
  misc_feature (1)..( 12): Result.005 file - promoters50/4768039
ataacaacaaaa

SEQ ID NO: 189373 - DNA, 9 bp, Unknown
  misc_feature (1)..( 9): Result.005 file - promoters50/4768039
aaataaata

SEQ ID NO: 189374 - DNA, 9 bp, Unknown
  misc_feature (1)..( 9): Result.005 file - promoters50/4768039
aaataaaag

SEQ ID NO: 189375 - DNA, 10 bp, Unknown
  misc_feature (1)..( 10): Result.005 file - promoters50/4768039
aaattaaaaa

SEQ ID NO: 189376 - DNA, 10 bp, Unknown
  misc_feature (1)..( 10): Result.005 file - promoters50/4768039
aaaacaaagg

SEQ ID NO: 189377 - DNA, 10 bp, Unknown
  misc_feature (1)..( 10): Result.005 file - promoters50/4768039
tatacaagaa

SEQ ID NO: 189378 - DNA, 10 bp, Unknown
  misc_feature (1)..( 10): Result.005 file - promoters50/4768039
aaagcaaaca

SEQ ID NO: 189379 - DNA, 9 bp, Unknown
  misc_feature (1)..( 9): Result.005 file - promoters50/4768063
caaaaaaga

SEQ ID NO: 189380 - DNA, 9 bp, Unknown
  misc_feature (1)..( 9): Result.005 file - promoters50/4768063
aaaacaaga

SEQ ID NO: 189381 - DNA, 9 bp, Unknown
  misc_feature (1)..( 9): Result.005 file - promoters50/4768063
caaaaaata

SEQ ID NO: 189382 - DNA, 9 bp, Unknown
  misc_feature (1)..( 9): Result.005 file - promoters50/4768063
ggaacaaga

SEQ ID NO: 189383 - DNA, 9 bp, Unknown
  misc_feature (1)..( 9): Result.005 file - promoters50/4768063
caaacacaa

SEQ ID NO: 189384 - DNA, 9 bp, Unknown
  misc_feature (1)..( 9): Result.005 file - promoters50/4768063
tatttaacc

SEQ ID NO: 189385 - DNA, 9 bp, Unknown
  misc_feature (1)..( 9): Result.005 file - promoters50/4768063
tatataaat

SEQ ID NO: 189386 - DNA, 9 bp, Unknown
  misc_feature (1)..( 9): Result.005 file - promoters50/4768063
tctataaat

SEQ ID NO: 189387 - DNA, 9 bp, Unknown
  misc_feature (1)..( 9): Result.005 file - promoters50/4768063
aatagaaaa

SEQ ID NO: 189388 - DNA, 6 bp, Unknown
  misc_feature (1)..( 6): Result.005 file - promoters50/4768066
gtatat

SEQ ID NO: 189389 - DNA, 6 bp, Unknown
  misc_feature (1)..( 6): Result.005 file - promoters50/4768066
gtatat

SEQ ID NO: 189390 - DNA, 6 bp, Unknown
  misc_feature (1)..( 6): Result.005 file - promoters50/4768066
gtatat

SEQ ID NO: 189391 - DNA, 7 bp, Unknown
  misc_feature (1)..( 7): Result.005 file - promoters50/4768077
catgttt

SEQ ID NO: 189392 - DNA, 7 bp, Unknown
  misc_feature (1)..( 7): Result.005 file - promoters50/4768077
catcttt

SEQ ID NO: 189393 - DNA, 7 bp, Unknown
  misc_feature (1)..( 7): Result.005 file - promoters50/4768077
tgtgttt

SEQ ID NO: 189394 - DNA, 8 bp, Unknown
  misc_feature (1)..( 8): Result.005 file - promoters50/4768077
tttggaat

SEQ ID NO: 189395 - DNA, 8 bp, Unknown
  misc_feature (1)..( 8): Result.005 file - promoters50/4768077
tttcgaaa

SEQ ID NO: 189396 - DNA, 8 bp, Unknown
  misc_feature (1)..( 8): Result.005 file - promoters50/4768077
tctggaat

SEQ ID NO: 189397 - DNA, 11 bp, Unknown
  misc_feature (1)..( 11): Result.005 file - promoters50/4768093
tttttacaacc

SEQ ID NO: 189398 - DNA, 11 bp, Unknown
  misc_feature (1)..( 11): Result.005 file - promoters50/4768093
tttttataaca

SEQ ID NO: 189399 - DNA, 6 bp, Unknown
  misc_feature (1)..( 6): Result.005 file - promoters50/4768093
acaacc

SEQ ID NO: 189400 - DNA, 10 bp, Unknown
  misc_feature (1)..( 10): Result.005 file - promoters50/4768093
tatattaatt

SEQ ID NO: 189401 - DNA, 10 bp, Unknown
  misc_feature (1)..( 10): Result.005 file - promoters50/4768093
tatattcata

SEQ ID NO: 189402 - DNA, 10 bp, Unknown
  misc_feature (1)..( 10): Result.005 file - promoters50/4768093
cataatcatt

SEQ ID NO: 189403 - DNA, 10 bp, Unknown
  misc_feature (1)..( 10): Result.005 file - promoters50/4768093
tatatacata

SEQ ID NO: 189404 - DNA, 9 bp, Unknown
  misc_feature (1)..( 9): Result.005 file - promoters50/4768093
agtttaatc

SEQ ID NO: 189405 - DNA, 9 bp, Unknown
  misc_feature (1)..( 9): Result.005 file - promoters50/4768093
tatttaatt

SEQ ID NO: 189406 - DNA, 9 bp, Unknown
  misc_feature (1)..( 9): Result.005 file - promoters50/4768093
tatttcatt

SEQ ID NO: 189407 - DNA, 10 bp, Unknown
  misc_feature (1)..( 10): Result.005 file - promoters50/4768093
agatttcaat

SEQ ID NO: 189408 - DNA, 10 bp, Unknown
  misc_feature (1)..( 10): Result.005 file - promoters50/4768093
agattttaga

SEQ ID NO: 189409 - DNA, 10 bp, Unknown
  misc_feature (1)..( 10): Result.005 file - promoters50/4768093
agattttaat

SEQ ID NO: 189410 - DNA, 14 bp, Unknown
  misc_feature (1)..( 14): Result.005 file - promoters50/4768093
ttagattaaataat

SEQ ID NO: 189411 - DNA, 14 bp, Unknown
  misc_feature (1)..( 14): Result.005 file - promoters50/4768093
ttagattttactat

SEQ ID NO: 189412 - DNA, 14 bp, Unknown
  misc_feature (1)..( 14): Result.005 file - promoters50/4768093
agagattttaatat

SEQ ID NO: 189413 - DNA, 7 bp, Unknown
  misc_feature (1)..( 7): Result.005 file - promoters50/4768093
ctaatta

SEQ ID NO: 189414 - DNA, 7 bp, Unknown
  misc_feature (1)..( 7): Result.005 file - promoters50/4768093
ctattta

SEQ ID NO: 189415 - DNA, 7 bp, Unknown
  misc_feature (1)..( 7): Result.005 file - promoters50/4768093
ataatta

SEQ ID NO: 189416 - DNA, 16 bp, Unknown
  misc_feature (1)..( 16): Result.005 file - promoters50/4768093
aaaagtatattttcga

SEQ ID NO: 189417 - DNA, 16 bp, Unknown
  misc_feature (1)..( 16): Result.005 file - promoters50/4768093
aaaagtatatttcatt

SEQ ID NO: 189418 - DNA, 16 bp, Unknown
  misc_feature (1)..( 16): Result.005 file - promoters50/4768093
tttggtatatagttac

SEQ ID NO: 189419 - DNA, 16 bp, Unknown
  misc_feature (1)..( 16): Result.005 file - promoters50/4768093
gttaatttatttaatt

SEQ ID NO: 189420 - DNA, 11 bp, Unknown
  misc_feature (1)..( 11): Result.005 file - promoters50/4768093
aatcaaatttt

SEQ ID NO: 189421 - DNA, 11 bp, Unknown
  misc_feature (1)..( 11): Result.005 file - promoters50/4768093
aattaaatttt

SEQ ID NO: 189422 - DNA, 11 bp, Unknown
  misc_feature (1)..( 11): Result.005 file - promoters50/4768093
aatcaacaatg

SEQ ID NO: 189423 - DNA, 8 bp, Unknown
  misc_feature (1)..( 8): Result.005 file - promoters50/4768093
attaaata

SEQ ID NO: 189424 - DNA, 8 bp, Unknown
  misc_feature (1)..( 8): Result.005 file - promoters50/4768093
attacata

SEQ ID NO: 189425 - DNA, 8 bp, Unknown
  misc_feature (1)..( 8): Result.005 file - promoters50/4768093
attacact

SEQ ID NO: 189426 - DNA, 10 bp, Unknown
  misc_feature (1)..( 10): Result.005 file - promoters50/4768093
tatatattaa

SEQ ID NO: 189427 - DNA, 10 bp, Unknown
  misc_feature (1)..( 10): Result.005 file - promoters50/4768093
tatatacata

SEQ ID NO: 189428 - DNA, 10 bp, Unknown
  misc_feature (1)..( 10): Result.005 file - promoters50/4768093
tatattcata

SEQ ID NO: 189429 - DNA, 9 bp, Unknown
  misc_feature (1)..( 9): Result.005 file - promoters50/4768104
aacgaaaag

SEQ ID NO: 189430 - DNA, 9 bp, Unknown
  misc_feature (1)..( 9): Result.005 file - promoters50/4768104
cacgaaaat

SEQ ID NO: 189431 - DNA, 9 bp, Unknown
  misc_feature (1)..( 9): Result.005 file - promoters50/4768104
cacgaagaa

SEQ ID NO: 189432 - DNA, 9 bp, Unknown
  misc_feature (1)..( 9): Result.005 file - promoters50/4768104
caccaagaa

SEQ ID NO: 189433 - DNA, 11 bp, Unknown
  misc_feature (1)..( 11): Result.005 file - promoters50/4768104
agcaaaagatt

SEQ ID NO: 189434 - DNA, 11 bp, Unknown
  misc_feature (1)..( 11): Result.005 file - promoters50/4768104
accaagagatc

SEQ ID NO: 189435 - DNA, 12 bp, Unknown
  misc_feature (1)..( 12): Result.005 file - promoters50/4768104
cccaaaaatatt

SEQ ID NO: 189436 - DNA, 12 bp, Unknown
  misc_feature (1)..( 12): Result.005 file - promoters50/4768104
cccataaattga

SEQ ID NO: 189437 - DNA, 10 bp, Unknown
  misc_feature (1)..( 10): Result.005 file - promoters50/4768104
atacattttg

SEQ ID NO: 189438 - DNA, 10 bp, Unknown
  misc_feature (1)..( 10): Result.005 file - promoters50/4768104
aaacatttaa

SEQ ID NO: 189439 - DNA, 10 bp, Unknown
  misc_feature (1)..( 10): Result.005 file - promoters50/4768104
gaccatgtaa

SEQ ID NO: 189440 - DNA, 10 bp, Unknown
  misc_feature (1)..( 10): Result.005 file - promoters50/4768104
aaagattcca

SEQ ID NO: 189441 - DNA, 10 bp, Unknown
  misc_feature (1)..( 10): Result.005 file - promoters50/4768112
tgtgatttat

SEQ ID NO: 189442 - DNA, 10 bp, Unknown
  misc_feature (1)..( 10): Result.005 file - promoters50/4768112
tgtgttttgc

SEQ ID NO: 189443 - DNA, 10 bp, Unknown
  misc_feature (1)..( 10): Result.005 file - promoters50/4768112
tgagttttga

SEQ ID NO: 189444 - DNA, 11 bp, Unknown
  misc_feature (1)..( 11): Result.005 file - promoters50/4768112
atttataactt

SEQ ID NO: 189445 - DNA, 11 bp, Unknown
  misc_feature (1)..( 11): Result.005 file - promoters50/4768112
tcatatcactt

SEQ ID NO: 189446 - DNA, 11 bp, Unknown
  misc_feature (1)..( 11): Result.005 file - promoters50/4768112
atttctaagga

SEQ ID NO: 189447 - DNA, 10 bp, Unknown
  misc_feature (1)..( 10): Result.005 file - promoters50/4768112
atatcttcat

SEQ ID NO: 189448 - DNA, 10 bp, Unknown
  misc_feature (1)..( 10): Result.005 file - promoters50/4768112
ttatgttcct

SEQ ID NO: 189449 - DNA, 10 bp, Unknown
  misc_feature (1)..( 10): Result.005 file - promoters50/4768112
atattttcat

SEQ ID NO: 189450 - DNA, 7 bp, Unknown
  misc_feature (1)..( 7): Result.005 file - promoters50/4768143
aaagaaa

SEQ ID NO: 189451 - DNA, 7 bp, Unknown
  misc_feature (1)..( 7): Result.005 file - promoters50/4768143
caagaaa

SEQ ID NO: 189452 - DNA, 7 bp, Unknown
  misc_feature (1)..( 7): Result.005 file - promoters50/4768143
aaacaaa

SEQ ID NO: 189453 - DNA, 10 bp, Unknown
  misc_feature (1)..( 10): Result.005 file - promoters50/4768143
atatgacttt

SEQ ID NO: 189454 - DNA, 10 bp, Unknown
  misc_feature (1)..( 10): Result.005 file - promoters50/4768143
atatgactca

SEQ ID NO: 189455 - DNA, 10 bp, Unknown
  misc_feature (1)..( 10): Result.005 file - promoters50/4768143
ttttgacttt

SEQ ID NO: 189456 - DNA, 13 bp, Unknown
  misc_feature (1)..( 13): Result.005 file - promoters50/4768147
ctctactttctcc

SEQ ID NO: 189457 - DNA, 13 bp, Unknown
  misc_feature (1)..( 13): Result.005 file - promoters50/4768147
caataatttttcc

SEQ ID NO: 189458 - DNA, 13 bp, Unknown
  misc_feature (1)..( 13): Result.005 file - promoters50/4768147
ataatgtttgagt

SEQ ID NO: 189459 - DNA, 7 bp, Unknown
  misc_feature (1)..( 7): Result.005 file - promoters50/4768147
tattata

SEQ ID NO: 189460 - DNA, 7 bp, Unknown
  misc_feature (1)..( 7): Result.005 file - promoters50/4768147
tattatg

SEQ ID NO: 189461 - DNA, 7 bp, Unknown
  misc_feature (1)..( 7): Result.005 file - promoters50/4768147
tattata

SEQ ID NO: 189462 - DNA, 10 bp, Unknown
  misc_feature (1)..( 10): Result.005 file - promoters50/4768147
aaaacaataa

SEQ ID NO: 189463 - DNA, 10 bp, Unknown
  misc_feature (1)..( 10): Result.005 file - promoters50/4768147
taaataataa

SEQ ID NO: 189464 - DNA, 10 bp, Unknown
  misc_feature (1)..( 10): Result.005 file - promoters50/4768147
aaaacacaaa

SEQ ID NO: 189465 - DNA, 8 bp, Unknown
  misc_feature (1)..( 8): Result.005 file - promoters50/4768155
ttatctaa

SEQ ID NO: 189466 - DNA, 8 bp, Unknown
  misc_feature (1)..( 8): Result.005 file - promoters50/4768155
atatataa

SEQ ID NO: 189467 - DNA, 8 bp, Unknown
  misc_feature (1)..( 8): Result.005 file - promoters50/4768155
atatatat

SEQ ID NO: 189468 - DNA, 7 bp, Unknown
  misc_feature (1)..( 7): Result.005 file - promoters50/4768159
caagggt

SEQ ID NO: 189469 - DNA, 7 bp, Unknown
  misc_feature (1)..( 7): Result.005 file - promoters50/4768159
caagggg

SEQ ID NO: 189470 - DNA, 7 bp, Unknown
  misc_feature (1)..( 7): Result.005 file - promoters50/4768159
caaaggt

SEQ ID NO: 189471 - DNA, 8 bp, Unknown
  misc_feature (1)..( 8): Result.005 file - promoters50/4768169
gtttgaaa

SEQ ID NO: 189472 - DNA, 8 bp, Unknown
  misc_feature (1)..( 8): Result.005 file - promoters50/4768169
gttagaac

SEQ ID NO: 189473 - DNA, 8 bp, Unknown
  misc_feature (1)..( 8): Result.005 file - promoters50/4768169
ttttcaaa

SEQ ID NO: 189474 - DNA, 11 bp, Unknown
  misc_feature (1)..( 11): Result.005 file - promoters50/4768198
ttaaaatagtg

SEQ ID NO: 189475 - DNA, 11 bp, Unknown
  misc_feature (1)..( 11): Result.005 file - promoters50/4768198
ttaaaatcaac

SEQ ID NO: 189476 - DNA, 11 bp, Unknown
  misc_feature (1)..( 11): Result.005 file - promoters50/4768198
ttaaaatttat

SEQ ID NO: 189477 - DNA, 11 bp, Unknown
  misc_feature (1)..( 11): Result.005 file - promoters50/4768198
ctgaaatttta

SEQ ID NO: 189478 - DNA, 11 bp, Unknown
  misc_feature (1)..( 11): Result.005 file - promoters50/4768198
aatcaattgtt

SEQ ID NO: 189479 - DNA, 11 bp, Unknown
  misc_feature (1)..( 11): Result.005 file - promoters50/4768198
ttccgattgtt

SEQ ID NO: 189480 - DNA, 11 bp, Unknown
  misc_feature (1)..( 11): Result.005 file - promoters50/4768198
aatcaatggtt

SEQ ID NO: 189481 - DNA, 11 bp, Unknown
  misc_feature (1)..( 11): Result.005 file - promoters50/4768198
aataaattact

SEQ ID NO: 189482 - DNA, 11 bp, Unknown
  misc_feature (1)..( 11): Result.005 file - promoters50/4768198
tgtcatattgt

SEQ ID NO: 189483 - DNA, 11 bp, Unknown
  misc_feature (1)..( 11): Result.005 file - promoters50/4768198
tgtcaaattag

SEQ ID NO: 189484 - DNA, 11 bp, Unknown
  misc_feature (1)..( 11): Result.005 file - promoters50/4768198
gaaaatattgt

SEQ ID NO: 189485 - DNA, 11 bp, Unknown
  misc_feature (1)..( 11): Result.005 file - promoters50/4768198
cttcaaatcaa

SEQ ID NO: 189486 - DNA, 11 bp, Unknown
  misc_feature (1)..( 11): Result.005 file - promoters50/4768198
aaacaaatcat

SEQ ID NO: 189487 - DNA, 9 bp, Unknown
  misc_feature (1)..( 9): Result.005 file - promoters50/4768198
ctagtcttc

SEQ ID NO: 189488 - DNA, 9 bp, Unknown
  misc_feature (1)..( 9): Result.005 file - promoters50/4768198
tgtgtcttc

SEQ ID NO: 189489 - DNA, 7 bp, Unknown
  misc_feature (1)..( 7): Result.005 file - promoters50/4768198
tgtattc

SEQ ID NO: 189490 - DNA, 9 bp, Unknown
  misc_feature (1)..( 9): Result.005 file - promoters50/4768198
tgtttcttt

SEQ ID NO: 189491 - DNA, 12 bp, Unknown
  misc_feature (1)..( 12): Result.005 file - promoters50/4768209
gttattttcata

SEQ ID NO: 189492 - DNA, 12 bp, Unknown
  misc_feature (1)..( 12): Result.005 file - promoters50/4768209
tttattgtcatc

SEQ ID NO: 189493 - DNA, 12 bp, Unknown
  misc_feature (1)..( 12): Result.005 file - promoters50/4768209
gttgtttattta

SEQ ID NO: 189494 - DNA, 12 bp, Unknown
  misc_feature (1)..( 12): Result.005 file - promoters50/4768209
tttttttggaat

SEQ ID NO: 189495 - DNA, 12 bp, Unknown
  misc_feature (1)..( 12): Result.005 file - promoters50/4768209
gattttgtctat

SEQ ID NO: 189496 - DNA, 9 bp, Unknown
  misc_feature (1)..( 9): Result.005 file - promoters50/4768217
aaaggtttt

SEQ ID NO: 189497 - DNA, 9 bp, Unknown
  misc_feature (1)..( 9): Result.005 file - promoters50/4768217
taagattta

SEQ ID NO: 189498 - DNA, 10 bp, Unknown
  misc_feature (1)..( 10): Result.005 file - promoters50/4768217
ataggtgttg

SEQ ID NO: 189499 - DNA, 10 bp, Unknown
  misc_feature (1)..( 10): Result.005 file - promoters50/4768217
aaagattgtg

SEQ ID NO: 189500 - DNA, 10 bp, Unknown
  misc_feature (1)..( 10): Result.005 file - promoters50/4768217
agagattttg

SEQ ID NO: 189501 - DNA, 10 bp, Unknown
  misc_feature (1)..( 10): Result.005 file - promoters50/4768217
aaagattttt

SEQ ID NO: 189502 - DNA, 13 bp, Unknown
  misc_feature (1)..( 13): Result.005 file - promoters50/4768236
ccaaaactaatca

SEQ ID NO: 189503 - DNA, 13 bp, Unknown
  misc_feature (1)..( 13): Result.005 file - promoters50/4768236
tgaaaaataaact

SEQ ID NO: 189504 - DNA, 13 bp, Unknown
  misc_feature (1)..( 13): Result.005 file - promoters50/4768236
attaaaatattcg

SEQ ID NO: 189505 - DNA, 13 bp, Unknown
  misc_feature (1)..( 13): Result.005 file - promoters50/4768236
tgacaaataaaca

SEQ ID NO: 189506 - DNA, 11 bp, Unknown
  misc_feature (1)..( 11): Result.005 file - promoters50/4768236
ccatttaaatc

SEQ ID NO: 189507 - DNA, 13 bp, Unknown
  misc_feature (1)..( 13): Result.005 file - promoters50/4768236
attattttatatc

SEQ ID NO: 189508 - DNA, 13 bp, Unknown
  misc_feature (1)..( 13): Result.005 file - promoters50/4768236
ctgaataaaaaaa

SEQ ID NO: 189509 - DNA, 13 bp, Unknown
  misc_feature (1)..( 13): Result.005 file - promoters50/4768236
ctggatatgtgtg

SEQ ID NO: 189510 - DNA, 13 bp, Unknown
  misc_feature (1)..( 13): Result.005 file - promoters50/4768236
gtgaatagtagtt

SEQ ID NO: 189511 - DNA, 13 bp, Unknown
  misc_feature (1)..( 13): Result.005 file - promoters50/4768236
ttgaaaaaaaaaa

SEQ ID NO: 189512 - DNA, 13 bp, Unknown
  misc_feature (1)..( 13): Result.005 file - promoters50/4768236
ttggaaattctgg

SEQ ID NO: 189513 - DNA, 13 bp, Unknown
  misc_feature (1)..( 13): Result.005 file - promoters50/4768236
aagaagaaaaaat

SEQ ID NO: 189514 - DNA, 14 bp, Unknown
  misc_feature (1)..( 14): Result.005 file - promoters50/4768236
ttataaaaaaatat

SEQ ID NO: 189515 - DNA, 14 bp, Unknown
  misc_feature (1)..( 14): Result.005 file - promoters50/4768236
gtccaaaaaagaaa

SEQ ID NO: 189516 - DNA, 14 bp, Unknown
  misc_feature (1)..( 14): Result.005 file - promoters50/4768236
gttcaaacaatcat

SEQ ID NO: 189517 - DNA, 14 bp, Unknown
  misc_feature (1)..( 14): Result.005 file - promoters50/4768236
tcctaaaaacattg

SEQ ID NO: 189518 - DNA, 14 bp, Unknown
  misc_feature (1)..( 14): Result.005 file - promoters50/4768236
ttagaaaaaaaatt

SEQ ID NO: 189519 - DNA, 14 bp, Unknown
  misc_feature (1)..( 14): Result.005 file - promoters50/4768236
atagcaaaaatgaa

SEQ ID NO: 189520 - DNA, 10 bp, Unknown
  misc_feature (1)..( 10): Result.005 file - promoters50/4768236
aaaaaatatt

SEQ ID NO: 189521 - DNA, 10 bp, Unknown
  misc_feature (1)..( 10): Result.005 file - promoters50/4768236
agaaattata

SEQ ID NO: 189522 - DNA, 10 bp, Unknown
  misc_feature (1)..( 10): Result.005 file - promoters50/4768236
tcaaacaatc

SEQ ID NO: 189523 - DNA, 10 bp, Unknown
  misc_feature (1)..( 10): Result.005 file - promoters50/4768236
taaaaacatt

SEQ ID NO: 189524 - DNA, 10 bp, Unknown
  misc_feature (1)..( 10): Result.005 file - promoters50/4768236
agcaaaaatg

SEQ ID NO: 189525 - DNA, 10 bp, Unknown
  misc_feature (1)..( 10): Result.005 file - promoters50/4768236
aaaaaaaatt

SEQ ID NO: 189526 - DNA, 17 bp, Unknown
  misc_feature (1)..( 17): Result.005 file - promoters50/4768236
gaaaataattatattta

SEQ ID NO: 189527 - DNA, 17 bp, Unknown
  misc_feature (1)..( 17): Result.005 file - promoters50/4768236
aaattctattttattgt

SEQ ID NO: 189528 - DNA, 17 bp, Unknown
  misc_feature (1)..( 17): Result.005 file - promoters50/4768236
gaaagtaactatcttat

SEQ ID NO: 189529 - DNA, 17 bp, Unknown
  misc_feature (1)..( 17): Result.005 file - promoters50/4768236
cacccaaattttacaga

SEQ ID NO: 189530 - DNA, 17 bp, Unknown
  misc_feature (1)..( 17): Result.005 file - promoters50/4768236
ttatcttcttattggat

SEQ ID NO: 189531 - DNA, 17 bp, Unknown
  misc_feature (1)..( 17): Result.005 file - promoters50/4768236
acgatgtcgtttagtgt

SEQ ID NO: 189532 - DNA, 13 bp, Unknown
  misc_feature (1)..( 13): Result.005 file - promoters50/4768239
atatgatagatta

SEQ ID NO: 189533 - DNA, 13 bp, Unknown
  misc_feature (1)..( 13): Result.005 file - promoters50/4768239
ttattataaaata

SEQ ID NO: 189534 - DNA, 13 bp, Unknown
  misc_feature (1)..( 13): Result.005 file - promoters50/4768239
agattacaaaatt

SEQ ID NO: 189535 - DNA, 13 bp, Unknown
  misc_feature (1)..( 13): Result.005 file - promoters50/4768239
gtacgaaagaaaa

SEQ ID NO: 189536 - DNA, 13 bp, Unknown
  misc_feature (1)..( 13): Result.005 file - promoters50/4768239
agattaccttaga

SEQ ID NO: 189537 - DNA, 13 bp, Unknown
  misc_feature (1)..( 13): Result.005 file - promoters50/4768239
tcgtaaaaattta

SEQ ID NO: 189538 - DNA, 13 bp, Unknown
  misc_feature (1)..( 13): Result.005 file - promoters50/4768239
ggattacgtggcg

SEQ ID NO: 189539 - DNA, 13 bp, Unknown
  misc_feature (1)..( 13): Result.005 file - promoters50/4768239
gcaaaatcgaaaa

SEQ ID NO: 189540 - DNA, 13 bp, Unknown
  misc_feature (1)..( 13): Result.005 file - promoters50/4768239
ttacaattgaaaa

SEQ ID NO: 189541 - DNA, 13 bp, Unknown
  misc_feature (1)..( 13): Result.005 file - promoters50/4768239
gttaaattgatct

SEQ ID NO: 189542 - DNA, 13 bp, Unknown
  misc_feature (1)..( 13): Result.005 file - promoters50/4768239
ttataattggttc

SEQ ID NO: 189543 - DNA, 13 bp, Unknown
  misc_feature (1)..( 13): Result.005 file - promoters50/4768239
taataatttaact

SEQ ID NO: 189544 - DNA, 14 bp, Unknown
  misc_feature (1)..( 14): Result.005 file - promoters50/4768239
aactaacttagttt

SEQ ID NO: 189545 - DNA, 13 bp, Unknown
  misc_feature (1)..( 13): Result.005 file - promoters50/4768239
ttttaatacaaaa

SEQ ID NO: 189546 - DNA, 13 bp, Unknown
  misc_feature (1)..( 13): Result.005 file - promoters50/4768239
atgtaaaacaaaa

SEQ ID NO: 189547 - DNA, 13 bp, Unknown
  misc_feature (1)..( 13): Result.005 file - promoters50/4768239
cattaataatcct

SEQ ID NO: 189548 - DNA, 13 bp, Unknown
  misc_feature (1)..( 13): Result.005 file - promoters50/4768239
acttaaaactcgt

SEQ ID NO: 189549 - DNA, 13 bp, Unknown
  misc_feature (1)..( 13): Result.005 file - promoters50/4768239
ttgcaaatctcgc

SEQ ID NO: 189550 - DNA, 13 bp, Unknown
  misc_feature (1)..( 13): Result.005 file - promoters50/4768239
cattaattatgat

SEQ ID NO: 189551 - DNA, 9 bp, Unknown
  misc_feature (1)..( 9): Result.005 file - promoters50/4768246
tttaagatt

SEQ ID NO: 189552 - DNA, 9 bp, Unknown
  misc_feature (1)..( 9): Result.005 file - promoters50/4768246
ttttagatc

SEQ ID NO: 189553 - DNA, 9 bp, Unknown
  misc_feature (1)..( 9): Result.005 file - promoters50/4768246
aataatatt

SEQ ID NO: 189554 - DNA, 9 bp, Unknown
  misc_feature (1)..( 9): Result.005 file - promoters50/4768246
gatttaatt

SEQ ID NO: 189555 - DNA, 9 bp, Unknown
  misc_feature (1)..( 9): Result.005 file - promoters50/4768246
tatttaaat

SEQ ID NO: 189556 - DNA, 9 bp, Unknown
  misc_feature (1)..( 9): Result.005 file - promoters50/4768246
tatgtaaat

SEQ ID NO: 189557 - DNA, 7 bp, Unknown
  misc_feature (1)..( 7): Result.005 file - promoters50/4768246
tatatta

SEQ ID NO: 189558 - DNA, 7 bp, Unknown
  misc_feature (1)..( 7): Result.005 file - promoters50/4768246
tatattt

SEQ ID NO: 189559 - DNA, 7 bp, Unknown
  misc_feature (1)..( 7): Result.005 file - promoters50/4768246
aatatta

SEQ ID NO: 189560 - DNA, 9 bp, Unknown
  misc_feature (1)..( 9): Result.005 file - promoters50/4768246
gtttgtgtt

SEQ ID NO: 189561 - DNA, 9 bp, Unknown
  misc_feature (1)..( 9): Result.005 file - promoters50/4768246
ttttgggtt

SEQ ID NO: 189562 - DNA, 9 bp, Unknown
  misc_feature (1)..( 9): Result.005 file - promoters50/4768246
ttttggaag

SEQ ID NO: 189563 - DNA, 11 bp, Unknown
  misc_feature (1)..( 11): Result.005 file - promoters50/4768250
tcttttagtta

SEQ ID NO: 189564 - DNA, 11 bp, Unknown
  misc_feature (1)..( 11): Result.005 file - promoters50/4768250
acttgtagtac

SEQ ID NO: 189565 - DNA, 11 bp, Unknown
  misc_feature (1)..( 11): Result.005 file - promoters50/4768250
taatttattta

SEQ ID NO: 189566 - DNA, 11 bp, Unknown
  misc_feature (1)..( 11): Result.005 file - promoters50/4768250
tgttttggttg

SEQ ID NO: 189567 - DNA, 11 bp, Unknown
  misc_feature (1)..( 11): Result.005 file - promoters50/4768250
tctttttcttg

SEQ ID NO: 189568 - DNA, 11 bp, Unknown
  misc_feature (1)..( 11): Result.005 file - promoters50/4768250
gactttattat

SEQ ID NO: 189569 - DNA, 13 bp, Unknown
  misc_feature (1)..( 13): Result.005 file - promoters50/4768250
ggtagaaaaacct

SEQ ID NO: 189570 - DNA, 13 bp, Unknown
  misc_feature (1)..( 13): Result.005 file - promoters50/4768250
agaagaaaaaaat

SEQ ID NO: 189571 - DNA, 13 bp, Unknown
  misc_feature (1)..( 13): Result.005 file - promoters50/4768250
gatacaaaaccct

SEQ ID NO: 189572 - DNA, 13 bp, Unknown
  misc_feature (1)..( 13): Result.005 file - promoters50/4768250
tttctaaaataat

SEQ ID NO: 189573 - DNA, 13 bp, Unknown
  misc_feature (1)..( 13): Result.005 file - promoters50/4768250
attttaaaaaata

SEQ ID NO: 189574 - DNA, 13 bp, Unknown
  misc_feature (1)..( 13): Result.005 file - promoters50/4768250
tttataatatata

SEQ ID NO: 189575 - DNA, 13 bp, Unknown
  misc_feature (1)..( 13): Result.005 file - promoters50/4768250
gtaataatattga

SEQ ID NO: 189576 - DNA, 10 bp, Unknown
  misc_feature (1)..( 10): Result.005 file - promoters50/4768250
ttaaataata

SEQ ID NO: 189577 - DNA, 10 bp, Unknown
  misc_feature (1)..( 10): Result.005 file - promoters50/4768250
gaaaaaaatt

SEQ ID NO: 189578 - DNA, 10 bp, Unknown
  misc_feature (1)..( 10): Result.005 file - promoters50/4768250
taaaataata

SEQ ID NO: 189579 - DNA, 10 bp, Unknown
  misc_feature (1)..( 10): Result.005 file - promoters50/4768250
ttaattaaaa

SEQ ID NO: 189580 - DNA, 10 bp, Unknown
  misc_feature (1)..( 10): Result.005 file - promoters50/4768250
ttaaaaaata

SEQ ID NO: 189581 - DNA, 10 bp, Unknown
  misc_feature (1)..( 10): Result.005 file - promoters50/4768250
agaataaaaa

SEQ ID NO: 189582 - DNA, 10 bp, Unknown
  misc_feature (1)..( 10): Result.005 file - promoters50/4768250
agatttaaag

SEQ ID NO: 189583 - DNA, 14 bp, Unknown
  misc_feature (1)..( 14): Result.005 file - promoters50/4768250
taccgatttctttt

SEQ ID NO: 189584 - DNA, 14 bp, Unknown
  misc_feature (1)..( 14): Result.005 file - promoters50/4768250
taataatttattta

SEQ ID NO: 189585 - DNA, 14 bp, Unknown
  misc_feature (1)..( 14): Result.005 file - promoters50/4768250
cagcgacttcacgc

SEQ ID NO: 189586 - DNA, 14 bp, Unknown
  misc_feature (1)..( 14): Result.005 file - promoters50/4768250
tttttctctctttt

SEQ ID NO: 189587 - DNA, 14 bp, Unknown
  misc_feature (1)..( 14): Result.005 file - promoters50/4768250
tctgactttattat

SEQ ID NO: 189588 - DNA, 14 bp, Unknown
  misc_feature (1)..( 14): Result.005 file - promoters50/4768250
cagagacatcaatt

SEQ ID NO: 189589 - DNA, 10 bp, Unknown
  misc_feature (1)..( 10): Result.005 file - promoters50/4768250
aataatattg

SEQ ID NO: 189590 - DNA, 10 bp, Unknown
  misc_feature (1)..( 10): Result.005 file - promoters50/4768250
tacaatattt

SEQ ID NO: 189591 - DNA, 11 bp, Unknown
  misc_feature (1)..( 11): Result.005 file - promoters50/4768250
caaaattatat

SEQ ID NO: 189592 - DNA, 11 bp, Unknown
  misc_feature (1)..( 11): Result.005 file - promoters50/4768250
aatcaatatgt

SEQ ID NO: 189593 - DNA, 11 bp, Unknown
  misc_feature (1)..( 11): Result.005 file - promoters50/4768250
caaacttatcc

SEQ ID NO: 189594 - DNA, 11 bp, Unknown
  misc_feature (1)..( 11): Result.005 file - promoters50/4768250
aaaactttaaa

SEQ ID NO: 189595 - DNA, 12 bp, Unknown
  misc_feature (1)..( 12): Result.005 file - promoters50/4768250
aaaatgaaacca

SEQ ID NO: 189596 - DNA, 12 bp, Unknown
  misc_feature (1)..( 12): Result.005 file - promoters50/4768250
aaactgagttta

SEQ ID NO: 189597 - DNA, 12 bp, Unknown
  misc_feature (1)..( 12): Result.005 file - promoters50/4768250
gaaataaattgt

SEQ ID NO: 189598 - DNA, 12 bp, Unknown
  misc_feature (1)..( 12): Result.005 file - promoters50/4768250
taattaaatcaa

SEQ ID NO: 189599 - DNA, 12 bp, Unknown
  misc_feature (1)..( 12): Result.005 file - promoters50/4768250
atgttagatcgc

SEQ ID NO: 189600 - DNA, 12 bp, Unknown
  misc_feature (1)..( 12): Result.005 file - promoters50/4768250
tgatcaaaatag

SEQ ID NO: 189601 - DNA, 10 bp, Unknown
  misc_feature (1)..( 10): Result.005 file - promoters50/4768253
tttaagaaac

SEQ ID NO: 189602 - DNA, 10 bp, Unknown
  misc_feature (1)..( 10): Result.005 file - promoters50/4768253
aaaaagaaaa

SEQ ID NO: 189603 - DNA, 11 bp, Unknown
  misc_feature (1)..( 11): Result.005 file - promoters50/4768253
cataagacaaa

SEQ ID NO: 189604 - DNA, 11 bp, Unknown
  misc_feature (1)..( 11): Result.005 file - promoters50/4768253
aaaaacaaaac

SEQ ID NO: 189605 - DNA, 9 bp, Unknown
  misc_feature (1)..( 9): Result.005 file - promoters50/4768253
aaagaaaaa

SEQ ID NO: 189606 - DNA, 9 bp, Unknown
  misc_feature (1)..( 9): Result.005 file - promoters50/4768253
taagacaaa

SEQ ID NO: 189607 - DNA, 9 bp, Unknown
  misc_feature (1)..( 9): Result.005 file - promoters50/4768253
aaacaaaac

SEQ ID NO: 189608 - DNA, 9 bp, Unknown
  misc_feature (1)..( 9): Result.005 file - promoters50/4768253
aaattgact

SEQ ID NO: 189609 - DNA, 9 bp, Unknown
  misc_feature (1)..( 9): Result.005 file - promoters50/4768253
taattgaaa

SEQ ID NO: 189610 - DNA, 9 bp, Unknown
  misc_feature (1)..( 9): Result.005 file - promoters50/4768253
taaatgaaa

SEQ ID NO: 189611 - DNA, 11 bp, Unknown
  misc_feature (1)..( 11): Result.005 file - promoters50/4768265
tatttatgtgg

SEQ ID NO: 189612 - DNA, 11 bp, Unknown
  misc_feature (1)..( 11): Result.005 file - promoters50/4768265
aatttatttaa

SEQ ID NO: 189613 - DNA, 11 bp, Unknown
  misc_feature (1)..( 11): Result.005 file - promoters50/4768265
gattgattgat

SEQ ID NO: 189614 - DNA, 11 bp, Unknown
  misc_feature (1)..( 11): Result.005 file - promoters50/4768265
catttttttct

SEQ ID NO: 189615 - DNA, 11 bp, Unknown
  misc_feature (1)..( 11): Result.005 file - promoters50/4768265
cattttcgttt

SEQ ID NO: 189616 - DNA, 11 bp, Unknown
  misc_feature (1)..( 11): Result.005 file - promoters50/4768265
gtctgatggat

SEQ ID NO: 189617 - DNA, 13 bp, Unknown
  misc_feature (1)..( 13): Result.005 file - promoters50/4768265
tgttattagggat

SEQ ID NO: 189618 - DNA, 13 bp, Unknown
  misc_feature (1)..( 13): Result.005 file - promoters50/4768265
ctgtattagtgat

SEQ ID NO: 189619 - DNA, 13 bp, Unknown
  misc_feature (1)..( 13): Result.005 file - promoters50/4768265
gtttattataata

SEQ ID NO: 189620 - DNA, 13 bp, Unknown
  misc_feature (1)..( 13): Result.005 file - promoters50/4768265
tcggattagggtt

SEQ ID NO: 189621 - DNA, 13 bp, Unknown
  misc_feature (1)..( 13): Result.005 file - promoters50/4768265
acatattaggact

SEQ ID NO: 189622 - DNA, 13 bp, Unknown
  misc_feature (1)..( 13): Result.005 file - promoters50/4768265
gttttttaggctt

SEQ ID NO: 189623 - DNA, 10 bp, Unknown
  misc_feature (1)..( 10): Result.005 file - promoters50/4768265
cctaatttgc

SEQ ID NO: 189624 - DNA, 10 bp, Unknown
  misc_feature (1)..( 10): Result.005 file - promoters50/4768265
tataatttac

SEQ ID NO: 189625 - DNA, 10 bp, Unknown
  misc_feature (1)..( 10): Result.005 file - promoters50/4768265
aagaatttgt

SEQ ID NO: 189626 - DNA, 10 bp, Unknown
  misc_feature (1)..( 10): Result.005 file - promoters50/4768265
ataaatgtgt

SEQ ID NO: 189627 - DNA, 10 bp, Unknown
  misc_feature (1)..( 10): Result.005 file - promoters50/4768265
agaaattgcg

SEQ ID NO: 189628 - DNA, 10 bp, Unknown
  misc_feature (1)..( 10): Result.005 file - promoters50/4768265
ctgaattgca

SEQ ID NO: 189629 - DNA, 12 bp, Unknown
  misc_feature (1)..( 12): Result.005 file - promoters50/4768265
gtcaagtttgag

SEQ ID NO: 189630 - DNA, 12 bp, Unknown
  misc_feature (1)..( 12): Result.005 file - promoters50/4768265
atcaattttgct

SEQ ID NO: 189631 - DNA, 12 bp, Unknown
  misc_feature (1)..( 12): Result.005 file - promoters50/4768265
gaagagtctgat

SEQ ID NO: 189632 - DNA, 12 bp, Unknown
  misc_feature (1)..( 12): Result.005 file - promoters50/4768265
actaattttaat

SEQ ID NO: 189633 - DNA, 12 bp, Unknown
  misc_feature (1)..( 12): Result.005 file - promoters50/4768265
atcatttttttc

SEQ ID NO: 189634 - DNA, 12 bp, Unknown
  misc_feature (1)..( 12): Result.005 file - promoters50/4768265
gacgagcctgat

SEQ ID NO: 189635 - DNA, 9 bp, Unknown
  misc_feature (1)..( 9): Result.005 file - promoters50/4768265
aaaacattg

SEQ ID NO: 189636 - DNA, 9 bp, Unknown
  misc_feature (1)..( 9): Result.005 file - promoters50/4768265
aaaacagtg

SEQ ID NO: 189637 - DNA, 9 bp, Unknown
  misc_feature (1)..( 9): Result.005 file - promoters50/4768265
aaaaaattc

SEQ ID NO: 189638 - DNA, 9 bp, Unknown
  misc_feature (1)..( 9): Result.005 file - promoters50/4768265
aaaacattg

SEQ ID NO: 189639 - DNA, 9 bp, Unknown
  misc_feature (1)..( 9): Result.005 file - promoters50/4768265
aaaataata

SEQ ID NO: 189640 - DNA, 9 bp, Unknown
  misc_feature (1)..( 9): Result.005 file - promoters50/4768265
ttaacattt

SEQ ID NO: 189641 - DNA, 11 bp, Unknown
  misc_feature (1)..( 11): Result.005 file - promoters50/4768285
attacataatt

SEQ ID NO: 189642 - DNA, 11 bp, Unknown
  misc_feature (1)..( 11): Result.005 file - promoters50/4768285
attacaaaata

SEQ ID NO: 189643 - DNA, 11 bp, Unknown
  misc_feature (1)..( 11): Result.005 file - promoters50/4768285
ttttaataatt

SEQ ID NO: 189644 - DNA, 11 bp, Unknown
  misc_feature (1)..( 11): Result.005 file - promoters50/4768285
gctaaaaatcc

SEQ ID NO: 189645 - DNA, 11 bp, Unknown
  misc_feature (1)..( 11): Result.005 file - promoters50/4768285
actaaaaaggt

SEQ ID NO: 189646 - DNA, 11 bp, Unknown
  misc_feature (1)..( 11): Result.005 file - promoters50/4768285
aataaataata

SEQ ID NO: 189647 - DNA, 9 bp, Unknown
  misc_feature (1)..( 9): Result.005 file - promoters50/4768289
gtttattaa

SEQ ID NO: 189648 - DNA, 9 bp, Unknown
  misc_feature (1)..( 9): Result.005 file - promoters50/4768289
atttattaa

SEQ ID NO: 189649 - DNA, 9 bp, Unknown
  misc_feature (1)..( 9): Result.005 file - promoters50/4768289
gtttatgaa

SEQ ID NO: 189650 - DNA, 7 bp, Unknown
  misc_feature (1)..( 7): Result.005 file - promoters50/4768289
tgagatt

SEQ ID NO: 189651 - DNA, 7 bp, Unknown
  misc_feature (1)..( 7): Result.005 file - promoters50/4768289
cgagatt

SEQ ID NO: 189652 - DNA, 7 bp, Unknown
  misc_feature (1)..( 7): Result.005 file - promoters50/4768289
cgagatc

SEQ ID NO: 189653 - DNA, 8 bp, Unknown
  misc_feature (1)..( 8): Result.005 file - promoters50/4768293
cattttgt

SEQ ID NO: 189654 - DNA, 8 bp, Unknown
  misc_feature (1)..( 8): Result.005 file - promoters50/4768293
cattttca

SEQ ID NO: 189655 - DNA, 8 bp, Unknown
  misc_feature (1)..( 8): Result.005 file - promoters50/4768293
gattctca

SEQ ID NO: 189656 - DNA, 10 bp, Unknown
  misc_feature (1)..( 10): Result.005 file - promoters50/4768293
ttttacagat

SEQ ID NO: 189657 - DNA, 10 bp, Unknown
  misc_feature (1)..( 10): Result.005 file - promoters50/4768293
attttcagat

SEQ ID NO: 189658 - DNA, 10 bp, Unknown
  misc_feature (1)..( 10): Result.005 file - promoters50/4768293
attctcaccc

SEQ ID NO: 189659 - DNA, 9 bp, Unknown
  misc_feature (1)..( 9): Result.005 file - promoters50/4768300
acaagatta

SEQ ID NO: 189660 - DNA, 9 bp, Unknown
  misc_feature (1)..( 9): Result.005 file - promoters50/4768300
ctaagatta

SEQ ID NO: 189661 - DNA, 9 bp, Unknown
  misc_feature (1)..( 9): Result.005 file - promoters50/4768300
acatgattt

SEQ ID NO: 189662 - DNA, 9 bp, Unknown
  misc_feature (1)..( 9): Result.005 file - promoters50/4768300
ttttcttaa

SEQ ID NO: 189663 - DNA, 9 bp, Unknown
  misc_feature (1)..( 9): Result.005 file - promoters50/4768300
tttacttaa

SEQ ID NO: 189664 - DNA, 9 bp, Unknown
  misc_feature (1)..( 9): Result.005 file - promoters50/4768300
attactttt

SEQ ID NO: 189665 - DNA, 16 bp, Unknown
  misc_feature (1)..( 16): Result.005 file - promoters50/4768319
cattttctttttgtag

SEQ ID NO: 189666 - DNA, 16 bp, Unknown
  misc_feature (1)..( 16): Result.005 file - promoters50/4768319
catcttcctttgtctc

SEQ ID NO: 189667 - DNA, 16 bp, Unknown
  misc_feature (1)..( 16): Result.005 file - promoters50/4768319
attcttcgtttgttaa

SEQ ID NO: 189668 - DNA, 16 bp, Unknown
  misc_feature (1)..( 16): Result.005 file - promoters50/4768319
ctttttctgatcgacg

SEQ ID NO: 189669 - DNA, 16 bp, Unknown
  misc_feature (1)..( 16): Result.005 file - promoters50/4768319
ccgaatctgtttgtag

SEQ ID NO: 189670 - DNA, 16 bp, Unknown
  misc_feature (1)..( 16): Result.005 file - promoters50/4768319
actcttcgtcaataaa

SEQ ID NO: 189671 - DNA, 13 bp, Unknown
  misc_feature (1)..( 13): Result.005 file - promoters50/4768319
atagacaattgta

SEQ ID NO: 189672 - DNA, 13 bp, Unknown
  misc_feature (1)..( 13): Result.005 file - promoters50/4768319
gtagataattgtt

SEQ ID NO: 189673 - DNA, 13 bp, Unknown
  misc_feature (1)..( 13): Result.005 file - promoters50/4768319
aatgacaaatgtc

SEQ ID NO: 189674 - DNA, 13 bp, Unknown
  misc_feature (1)..( 13): Result.005 file - promoters50/4768319
atatacaattgtc

SEQ ID NO: 189675 - DNA, 13 bp, Unknown
  misc_feature (1)..( 13): Result.005 file - promoters50/4768319
acagataagtctt

SEQ ID NO: 189676 - DNA, 13 bp, Unknown
  misc_feature (1)..( 13): Result.005 file - promoters50/4768319
gttggatattgtt

SEQ ID NO: 189677 - DNA, 12 bp, Unknown
  misc_feature (1)..( 12): Result.005 file - promoters50/4768319
ttttaaaatttg

SEQ ID NO: 189678 - DNA, 12 bp, Unknown
  misc_feature (1)..( 12): Result.005 file - promoters50/4768319
attacaaatttt

SEQ ID NO: 189679 - DNA, 12 bp, Unknown
  misc_feature (1)..( 12): Result.005 file - promoters50/4768319
agataagattca

SEQ ID NO: 189680 - DNA, 12 bp, Unknown
  misc_feature (1)..( 12): Result.005 file - promoters50/4768319
aaaaaaaattgt

SEQ ID NO: 189681 - DNA, 12 bp, Unknown
  misc_feature (1)..( 12): Result.005 file - promoters50/4768319
ttttataatctt

SEQ ID NO: 189682 - DNA, 12 bp, Unknown
  misc_feature (1)..( 12): Result.005 file - promoters50/4768319
attaaaaaaaaa

SEQ ID NO: 189683 - DNA, 11 bp, Unknown
  misc_feature (1)..( 11): Result.005 file - promoters50/4768319
actcattttta

SEQ ID NO: 189684 - DNA, 11 bp, Unknown
  misc_feature (1)..( 11): Result.005 file - promoters50/4768319
tttcacttttc

SEQ ID NO: 189685 - DNA, 11 bp, Unknown
  misc_feature (1)..( 11): Result.005 file - promoters50/4768319
gattattatta

SEQ ID NO: 189686 - DNA, 11 bp, Unknown
  misc_feature (1)..( 11): Result.005 file - promoters50/4768319
tcacatattta

SEQ ID NO: 189687 - DNA, 11 bp, Unknown
  misc_feature (1)..( 11): Result.005 file - promoters50/4768319
tttcaatttca

SEQ ID NO: 189688 - DNA, 11 bp, Unknown
  misc_feature (1)..( 11): Result.005 file - promoters50/4768319
ttacaaatttt

SEQ ID NO: 189689 - DNA, 11 bp, Unknown
  misc_feature (1)..( 11): Result.005 file - promoters50/4768319
tttcactaaac

SEQ ID NO: 189690 - DNA, 9 bp, Unknown
  misc_feature (1)..( 9): Result.005 file - promoters50/4768319
taaaaaaac

SEQ ID NO: 189691 - DNA, 9 bp, Unknown
  misc_feature (1)..( 9): Result.005 file - promoters50/4768319
taaacaaat

SEQ ID NO: 189692 - DNA, 9 bp, Unknown
  misc_feature (1)..( 9): Result.005 file - promoters50/4768319
taataaata

SEQ ID NO: 189693 - DNA, 9 bp, Unknown
  misc_feature (1)..( 9): Result.005 file - promoters50/4768319
aaaacaaat

SEQ ID NO: 189694 - DNA, 9 bp, Unknown
  misc_feature (1)..( 9): Result.005 file - promoters50/4768319
caaaaactc

SEQ ID NO: 189695 - DNA, 9 bp, Unknown
  misc_feature (1)..( 9): Result.005 file - promoters50/4768319
taaacattt

SEQ ID NO: 189696 - DNA, 9 bp, Unknown
  misc_feature (1)..( 9): Result.005 file - promoters50/4768319
gaaacgaat

SEQ ID NO: 189697 - DNA, 7 bp, Unknown
  misc_feature (1)..( 7): Result.005 file - promoters50/4768323
ctttttc

SEQ ID NO: 189698 - DNA, 7 bp, Unknown
  misc_feature (1)..( 7): Result.005 file - promoters50/4768323
ctttttt

SEQ ID NO: 189699 - DNA, 7 bp, Unknown
  misc_feature (1)..( 7): Result.005 file - promoters50/4768323
gtttttc

SEQ ID NO: 189700 - DNA, 8 bp, Unknown
  misc_feature (1)..( 8): Result.005 file - promoters50/4768323
tttgttat

SEQ ID NO: 189701 - DNA, 8 bp, Unknown
  misc_feature (1)..( 8): Result.005 file - promoters50/4768323
tttcttat

SEQ ID NO: 189702 - DNA, 8 bp, Unknown
  misc_feature (1)..( 8): Result.005 file - promoters50/4768323
ttttttaa

SEQ ID NO: 189703 - DNA, 7 bp, Unknown
  misc_feature (1)..( 7): Result.005 file - promoters50/4768323
ttgatca

SEQ ID NO: 189704 - DNA, 7 bp, Unknown
  misc_feature (1)..( 7): Result.005 file - promoters50/4768323
ttggtca

SEQ ID NO: 189705 - DNA, 7 bp, Unknown
  misc_feature (1)..( 7): Result.005 file - promoters50/4768323
ttggtct

SEQ ID NO: 189706 - DNA, 7 bp, Unknown
  misc_feature (1)..( 7): Result.005 file - promoters50/4768323
ttttctg

SEQ ID NO: 189707 - DNA, 7 bp, Unknown
  misc_feature (1)..( 7): Result.005 file - promoters50/4768323
tttactg

SEQ ID NO: 189708 - DNA, 7 bp, Unknown
  misc_feature (1)..( 7): Result.005 file - promoters50/4768323
ttttctg

SEQ ID NO: 189709 - DNA, 13 bp, Unknown
  misc_feature (1)..( 13): Result.005 file - promoters50/4768346
aaaatatctgaaa

SEQ ID NO: 189710 - DNA, 13 bp, Unknown
  misc_feature (1)..( 13): Result.005 file - promoters50/4768346
tatatatatgaaa

SEQ ID NO: 189711 - DNA, 13 bp, Unknown
  misc_feature (1)..( 13): Result.005 file - promoters50/4768346
aaaatttctgtat

SEQ ID NO: 189712 - DNA, 13 bp, Unknown
  misc_feature (1)..( 13): Result.005 file - promoters50/4768346
aagaataatgaaa

SEQ ID NO: 189713 - DNA, 13 bp, Unknown
  misc_feature (1)..( 13): Result.005 file - promoters50/4768346
gctttttctgttc

SEQ ID NO: 189714 - DNA, 9 bp, Unknown
  misc_feature (1)..( 9): Result.005 file - promoters50/4768350
gttttggat

SEQ ID NO: 189715 - DNA, 9 bp, Unknown
  misc_feature (1)..( 9): Result.005 file - promoters50/4768350
gtttttgat

SEQ ID NO: 189716 - DNA, 9 bp, Unknown
  misc_feature (1)..( 9): Result.005 file - promoters50/4768350
atttttgaa

SEQ ID NO: 189717 - DNA, 9 bp, Unknown
  misc_feature (1)..( 9): Result.005 file - promoters50/4768350
tatttttct

SEQ ID NO: 189718 - DNA, 9 bp, Unknown
  misc_feature (1)..( 9): Result.005 file - promoters50/4768350
agtttgtct

SEQ ID NO: 189719 - DNA, 9 bp, Unknown
  misc_feature (1)..( 9): Result.005 file - promoters50/4768350
agtgtgtat

SEQ ID NO: 189720 - DNA, 8 bp, Unknown
  misc_feature (1)..( 8): Result.005 file - promoters50/4768350
tgaatttt

SEQ ID NO: 189721 - DNA, 8 bp, Unknown
  misc_feature (1)..( 8): Result.005 file - promoters50/4768350
tgagtttt

SEQ ID NO: 189722 - DNA, 8 bp, Unknown
  misc_feature (1)..( 8): Result.005 file - promoters50/4768350
tgagtttg

SEQ ID NO: 189723 - DNA, 10 bp, Unknown
  misc_feature (1)..( 10): Result.005 file - promoters50/4768354
agaatttttt

SEQ ID NO: 189724 - DNA, 9 bp, Unknown
  misc_feature (1)..( 9): Result.005 file - promoters50/4768354
aaattttta

SEQ ID NO: 189725 - DNA, 10 bp, Unknown
  misc_feature (1)..( 10): Result.005 file - promoters50/4768354
aagatttttg

SEQ ID NO: 189726 - DNA, 10 bp, Unknown
  misc_feature (1)..( 10): Result.005 file - promoters50/4768354
ttcctttttt

SEQ ID NO: 189727 - DNA, 10 bp, Unknown
  misc_feature (1)..( 10): Result.005 file - promoters50/4768354
agactttggg

SEQ ID NO: 189728 - DNA, 11 bp, Unknown
  misc_feature (1)..( 11): Result.005 file - promoters50/4768354
agaattttttt

SEQ ID NO: 189729 - DNA, 11 bp, Unknown
  misc_feature (1)..( 11): Result.005 file - promoters50/4768354
taacatttttt

SEQ ID NO: 189730 - DNA, 11 bp, Unknown
  misc_feature (1)..( 11): Result.005 file - promoters50/4768354
attcctttttt

SEQ ID NO: 189731 - DNA, 11 bp, Unknown
  misc_feature (1)..( 11): Result.005 file - promoters50/4768354
taagatttttg

SEQ ID NO: 189732 - DNA, 9 bp, Unknown
  misc_feature (1)..( 9): Result.005 file - promoters50/4768354
gttattcga

SEQ ID NO: 189733 - DNA, 9 bp, Unknown
  misc_feature (1)..( 9): Result.005 file - promoters50/4768354
tttattcag

SEQ ID NO: 189734 - DNA, 9 bp, Unknown
  misc_feature (1)..( 9): Result.005 file - promoters50/4768354
tttaatcag

SEQ ID NO: 189735 - DNA, 9 bp, Unknown
  misc_feature (1)..( 9): Result.005 file - promoters50/4768354
tttaatgta

SEQ ID NO: 189736 - DNA, 8 bp, Unknown
  misc_feature (1)..( 8): Result.005 file - promoters50/4768354
taatcatc

SEQ ID NO: 189737 - DNA, 8 bp, Unknown
  misc_feature (1)..( 8): Result.005 file - promoters50/4768354
aaatcatg

SEQ ID NO: 189738 - DNA, 9 bp, Unknown
  misc_feature (1)..( 9): Result.005 file - promoters50/4768354
aaattcaaa

SEQ ID NO: 189739 - DNA, 9 bp, Unknown
  misc_feature (1)..( 9): Result.005 file - promoters50/4768354
agtatcatg

SEQ ID NO: 189740 - DNA, 7 bp, Unknown
  misc_feature (1)..( 7): Result.005 file - promoters50/4768444
gccttct

SEQ ID NO: 189741 - DNA, 7 bp, Unknown
  misc_feature (1)..( 7): Result.005 file - promoters50/4768444
accttct

SEQ ID NO: 189742 - DNA, 7 bp, Unknown
  misc_feature (1)..( 7): Result.005 file - promoters50/4768444
accctct

SEQ ID NO: 189743 - DNA, 7 bp, Unknown
  misc_feature (1)..( 7): Result.005 file - promoters50/4768444
tatctta

SEQ ID NO: 189744 - DNA, 7 bp, Unknown
  misc_feature (1)..( 7): Result.005 file - promoters50/4768444
tatttta

SEQ ID NO: 189745 - DNA, 7 bp, Unknown
  misc_feature (1)..( 7): Result.005 file - promoters50/4768444
tctcttt

SEQ ID NO: 189746 - DNA, 6 bp, Unknown
  misc_feature (1)..( 6): Result.005 file - promoters50/4768478
gagctt

SEQ ID NO: 189747 - DNA, 7 bp, Unknown
  misc_feature (1)..( 7): Result.005 file - promoters50/4768478
tgagctt

SEQ ID NO: 189748 - DNA, 7 bp, Unknown
  misc_feature (1)..( 7): Result.005 file - promoters50/4768478
tgagctt

SEQ ID NO: 189749 - DNA, 10 bp, Unknown
  misc_feature (1)..( 10): Result.005 file - promoters50/4768478
aaaactaatt

SEQ ID NO: 189750 - DNA, 10 bp, Unknown
  misc_feature (1)..( 10): Result.005 file - promoters50/4768478
gaaacaaatt

SEQ ID NO: 189751 - DNA, 10 bp, Unknown
  misc_feature (1)..( 10): Result.005 file - promoters50/4768478
gaaacactct

SEQ ID NO: 189752 - DNA, 7 bp, Unknown
  misc_feature (1)..( 7): Result.005 file - promoters50/4768499
atcgtct

SEQ ID NO: 189753 - DNA, 7 bp, Unknown
  misc_feature (1)..( 7): Result.005 file - promoters50/4768499
atcctct

SEQ ID NO: 189754 - DNA, 7 bp, Unknown
  misc_feature (1)..( 7): Result.005 file - promoters50/4768499
ttcctct

SEQ ID NO: 189755 - DNA, 11 bp, Unknown
  misc_feature (1)..( 11): Result.005 file - promoters50/4768499
aagcttgggtt

SEQ ID NO: 189756 - DNA, 11 bp, Unknown
  misc_feature (1)..( 11): Result.005 file - promoters50/4768499
aagtttgcgtt

SEQ ID NO: 189757 - DNA, 11 bp, Unknown
  misc_feature (1)..( 11): Result.005 file - promoters50/4768499
aagtttagaat

SEQ ID NO: 189758 - DNA, 9 bp, Unknown
  misc_feature (1)..( 9): Result.005 file - promoters50/4768514
gctttcgtg

SEQ ID NO: 189759 - DNA, 9 bp, Unknown
  misc_feature (1)..( 9): Result.005 file - promoters50/4768514
gttttagtg

SEQ ID NO: 189760 - DNA, 9 bp, Unknown
  misc_feature (1)..( 9): Result.005 file - promoters50/4768514
gctctcgga

SEQ ID NO: 189761 - DNA, 13 bp, Unknown
  misc_feature (1)..( 13): Result.005 file - promoters50/4768520
ggtttttattttc

SEQ ID NO: 189762 - DNA, 13 bp, Unknown
  misc_feature (1)..( 13): Result.005 file - promoters50/4768520
agttattaatcac

SEQ ID NO: 189763 - DNA, 13 bp, Unknown
  misc_feature (1)..( 13): Result.005 file - promoters50/4768520
ggtatttatattc

SEQ ID NO: 189764 - DNA, 13 bp, Unknown
  misc_feature (1)..( 13): Result.005 file - promoters50/4768520
ggtttttattttc

SEQ ID NO: 189765 - DNA, 13 bp, Unknown
  misc_feature (1)..( 13): Result.005 file - promoters50/4768520
aaactttattaaa

SEQ ID NO: 189766 - DNA, 13 bp, Unknown
  misc_feature (1)..( 13): Result.005 file - promoters50/4768520
ggtatttatattc

SEQ ID NO: 189767 - DNA, 9 bp, Unknown
  misc_feature (1)..( 9): Result.005 file - promoters50/4768528
aaaatttct

SEQ ID NO: 189768 - DNA, 9 bp, Unknown
  misc_feature (1)..( 9): Result.005 file - promoters50/4768528
aaactttaa

SEQ ID NO: 189769 - DNA, 9 bp, Unknown
  misc_feature (1)..( 9): Result.005 file - promoters50/4768528
aaaatctct

SEQ ID NO: 189770 - DNA, 8 bp, Unknown
  misc_feature (1)..( 8): Result.005 file - promoters50/4768528
tgtgaaac

SEQ ID NO: 189771 - DNA, 8 bp, Unknown
  misc_feature (1)..( 8): Result.005 file - promoters50/4768528
tttgaaac

SEQ ID NO: 189772 - DNA, 8 bp, Unknown
  misc_feature (1)..( 8): Result.005 file - promoters50/4768528
tgtgaaaa

SEQ ID NO: 189773 - DNA, 9 bp, Unknown
  misc_feature (1)..( 9): Result.005 file - promoters50/4768528
aaaatttct

SEQ ID NO: 189774 - DNA, 9 bp, Unknown
  misc_feature (1)..( 9): Result.005 file - promoters50/4768528
gatatttct

SEQ ID NO: 189775 - DNA, 9 bp, Unknown
  misc_feature (1)..( 9): Result.005 file - promoters50/4768528
aaaatctct

SEQ ID NO: 189776 - DNA, 9 bp, Unknown
  misc_feature (1)..( 9): Result.005 file - promoters50/4768528
tatcaaaat

SEQ ID NO: 189777 - DNA, 9 bp, Unknown
  misc_feature (1)..( 9): Result.005 file - promoters50/4768528
tttcaaaat

SEQ ID NO: 189778 - DNA, 9 bp, Unknown
  misc_feature (1)..( 9): Result.005 file - promoters50/4768528
ttttaaaat

SEQ ID NO: 189779 - DNA, 15 bp, Unknown
  misc_feature (1)..( 15): Result.005 file - promoters50/4768532
atccttcaagataat

SEQ ID NO: 189780 - DNA, 15 bp, Unknown
  misc_feature (1)..( 15): Result.005 file - promoters50/4768532
gctacacaatataca

SEQ ID NO: 189781 - DNA, 15 bp, Unknown
  misc_feature (1)..( 15): Result.005 file - promoters50/4768532
accaatttagataaa

SEQ ID NO: 189782 - DNA, 15 bp, Unknown
  misc_feature (1)..( 15): Result.005 file - promoters50/4768532
ttaggtaaatatctt

SEQ ID NO: 189783 - DNA, 15 bp, Unknown
  misc_feature (1)..( 15): Result.005 file - promoters50/4768532
aataataaatattac

SEQ ID NO: 189784 - DNA, 15 bp, Unknown
  misc_feature (1)..( 15): Result.005 file - promoters50/4768532
cctcagcgatagaca

SEQ ID NO: 189785 - DNA, 6 bp, Unknown
  misc_feature (1)..( 6): Result.005 file - promoters50/4768539
tgttat

SEQ ID NO: 189786 - DNA, 6 bp, Unknown
  misc_feature (1)..( 6): Result.005 file - promoters50/4768539
tgttat

SEQ ID NO: 189787 - DNA, 6 bp, Unknown
  misc_feature (1)..( 6): Result.005 file - promoters50/4768539
tgttat

SEQ ID NO: 189788 - DNA, 7 bp, Unknown
  misc_feature (1)..( 7): Result.005 file - promoters50/4768539
aaataac

SEQ ID NO: 189789 - DNA, 7 bp, Unknown
  misc_feature (1)..( 7): Result.005 file - promoters50/4768539
taataac

SEQ ID NO: 189790 - DNA, 7 bp, Unknown
  misc_feature (1)..( 7): Result.005 file - promoters50/4768539
aaataag

SEQ ID NO: 189791 - DNA, 9 bp, Unknown
  misc_feature (1)..( 9): Result.005 file - promoters50/4768539
ggacacata

SEQ ID NO: 189792 - DNA, 9 bp, Unknown
  misc_feature (1)..( 9): Result.005 file - promoters50/4768539
ggacacata

SEQ ID NO: 189793 - DNA, 9 bp, Unknown
  misc_feature (1)..( 9): Result.005 file - promoters50/4768539
aaacaaaat

SEQ ID NO: 189794 - DNA, 9 bp, Unknown
  misc_feature (1)..( 9): Result.005 file - promoters50/4768539
ttacaaaat

SEQ ID NO: 189795 - DNA, 6 bp, Unknown
  misc_feature (1)..( 6): Result.005 file - promoters50/4768539
aaaaca

SEQ ID NO: 189796 - DNA, 6 bp, Unknown
  misc_feature (1)..( 6): Result.005 file - promoters50/4768539
aaaaca

SEQ ID NO: 189797 - DNA, 6 bp, Unknown
  misc_feature (1)..( 6): Result.005 file - promoters50/4768539
aaaaca

SEQ ID NO: 189798 - DNA, 23 bp, Unknown
  misc_feature (1)..( 23): Result.005 file - promoters50/4768539
gataaaaatcaagcttcacctaa

SEQ ID NO: 189799 - DNA, 23 bp, Unknown
  misc_feature (1)..( 23): Result.005 file - promoters50/4768539
gataaaaaacgctagaaggaggg

SEQ ID NO: 189800 - DNA, 23 bp, Unknown
  misc_feature (1)..( 23): Result.005 file - promoters50/4768539
atgaaaaatcaaacttcatctaa

SEQ ID NO: 189801 - DNA, 8 bp, Unknown
  misc_feature (1)..( 8): Result.005 file - promoters50/4768539
tttctcac

SEQ ID NO: 189802 - DNA, 8 bp, Unknown
  misc_feature (1)..( 8): Result.005 file - promoters50/4768539
tttatcac

SEQ ID NO: 189803 - DNA, 8 bp, Unknown
  misc_feature (1)..( 8): Result.005 file - promoters50/4768539
tttatcca

SEQ ID NO: 189804 - DNA, 9 bp, Unknown
  misc_feature (1)..( 9): Result.005 file - promoters50/4768539
cattgcttt

SEQ ID NO: 189805 - DNA, 9 bp, Unknown
  misc_feature (1)..( 9): Result.005 file - promoters50/4768539
aattgtttt

SEQ ID NO: 189806 - DNA, 9 bp, Unknown
  misc_feature (1)..( 9): Result.005 file - promoters50/4768539
aattgtact

SEQ ID NO: 189807 - DNA, 14 bp, Unknown
  misc_feature (1)..( 14): Result.005 file - promoters50/4768547
tactttatatatta

SEQ ID NO: 189808 - DNA, 14 bp, Unknown
  misc_feature (1)..( 14): Result.005 file - promoters50/4768547
tttaagatatttta

SEQ ID NO: 189809 - DNA, 14 bp, Unknown
  misc_feature (1)..( 14): Result.005 file - promoters50/4768547
acttaaatatcgtc

SEQ ID NO: 189810 - DNA, 14 bp, Unknown
  misc_feature (1)..( 14): Result.005 file - promoters50/4768547
ctttctataatata

SEQ ID NO: 189811 - DNA, 14 bp, Unknown
  misc_feature (1)..( 14): Result.005 file - promoters50/4768547
acttaaaccaatga

SEQ ID NO: 189812 - DNA, 14 bp, Unknown
  misc_feature (1)..( 14): Result.005 file - promoters50/4768547
agataattattctc

SEQ ID NO: 189813 - DNA, 11 bp, Unknown
  misc_feature (1)..( 11): Result.005 file - promoters50/4768547
actttatatat

SEQ ID NO: 189814 - DNA, 11 bp, Unknown
  misc_feature (1)..( 11): Result.005 file - promoters50/4768547
attttatagaa

SEQ ID NO: 189815 - DNA, 11 bp, Unknown
  misc_feature (1)..( 11): Result.005 file - promoters50/4768547
gacttaaatat

SEQ ID NO: 189816 - DNA, 11 bp, Unknown
  misc_feature (1)..( 11): Result.005 file - promoters50/4768547
cctttctataa

SEQ ID NO: 189817 - DNA, 11 bp, Unknown
  misc_feature (1)..( 11): Result.005 file - promoters50/4768547
aacttaaacca

SEQ ID NO: 189818 - DNA, 11 bp, Unknown
  misc_feature (1)..( 11): Result.005 file - promoters50/4768547
taattattctc

SEQ ID NO: 189819 - DNA, 8 bp, Unknown
  misc_feature (1)..( 8): Result.005 file - promoters50/4768547
atttggtt

SEQ ID NO: 189820 - DNA, 8 bp, Unknown
  misc_feature (1)..( 8): Result.005 file - promoters50/4768547
atttggtg

SEQ ID NO: 189821 - DNA, 8 bp, Unknown
  misc_feature (1)..( 8): Result.005 file - promoters50/4768547
tttttgtt

SEQ ID NO: 189822 - DNA, 8 bp, Unknown
  misc_feature (1)..( 8): Result.005 file - promoters50/4768547
tttttgta

SEQ ID NO: 189823 - DNA, 8 bp, Unknown
  misc_feature (1)..( 8): Result.005 file - promoters50/4768547
tttttggg

SEQ ID NO: 189824 - DNA, 8 bp, Unknown
  misc_feature (1)..( 8): Result.005 file - promoters50/4768547
attcggtg

SEQ ID NO: 189825 - DNA, 7 bp, Unknown
  misc_feature (1)..( 7): Result.005 file - promoters50/4768558
ttaaaat

SEQ ID NO: 189826 - DNA, 7 bp, Unknown
  misc_feature (1)..( 7): Result.005 file - promoters50/4768558
ttaaaat

SEQ ID NO: 189827 - DNA, 7 bp, Unknown
  misc_feature (1)..( 7): Result.005 file - promoters50/4768558
ttaaaat

SEQ ID NO: 189828 - DNA, 7 bp, Unknown
  misc_feature (1)..( 7): Result.005 file - promoters50/4768558
aaaatta

SEQ ID NO: 189829 - DNA, 7 bp, Unknown
  misc_feature (1)..( 7): Result.005 file - promoters50/4768558
taaatta

SEQ ID NO: 189830 - DNA, 7 bp, Unknown
  misc_feature (1)..( 7): Result.005 file - promoters50/4768558
aaaattc

SEQ ID NO: 189831 - DNA, 10 bp, Unknown
  misc_feature (1)..( 10): Result.005 file - promoters50/4768558
ggttaattag

SEQ ID NO: 189832 - DNA, 10 bp, Unknown
  misc_feature (1)..( 10): Result.005 file - promoters50/4768558
aaataattaa

SEQ ID NO: 189833 - DNA, 10 bp, Unknown
  misc_feature (1)..( 10): Result.005 file - promoters50/4768558
aaaaaattaa

SEQ ID NO: 189834 - DNA, 8 bp, Unknown
  misc_feature (1)..( 8): Result.005 file - promoters50/4768558
taatttaa

SEQ ID NO: 189835 - DNA, 8 bp, Unknown
  misc_feature (1)..( 8): Result.005 file - promoters50/4768558
aaatataa

SEQ ID NO: 189836 - DNA, 8 bp, Unknown
  misc_feature (1)..( 8): Result.005 file - promoters50/4768558
ttatataa

SEQ ID NO: 189837 - DNA, 8 bp, Unknown
  misc_feature (1)..( 8): Result.005 file - promoters50/4768558
aaatattc

SEQ ID NO: 189838 - DNA, 11 bp, Unknown
  misc_feature (1)..( 11): Result.005 file - promoters50/4768558
aactaaaatta

SEQ ID NO: 189839 - DNA, 11 bp, Unknown
  misc_feature (1)..( 11): Result.005 file - promoters50/4768558
aaccaaaaatt

SEQ ID NO: 189840 - DNA, 11 bp, Unknown
  misc_feature (1)..( 11): Result.005 file - promoters50/4768558
tctcaaaaatt

SEQ ID NO: 189841 - DNA, 12 bp, Unknown
  misc_feature (1)..( 12): Result.005 file - promoters50/4768568
gaggattaaagg

SEQ ID NO: 189842 - DNA, 12 bp, Unknown
  misc_feature (1)..( 12): Result.005 file - promoters50/4768568
attaattaaatt

SEQ ID NO: 189843 - DNA, 12 bp, Unknown
  misc_feature (1)..( 12): Result.005 file - promoters50/4768568
gccgatgaaagt

SEQ ID NO: 189844 - DNA, 12 bp, Unknown
  misc_feature (1)..( 12): Result.005 file - promoters50/4768568
taggactaatta

SEQ ID NO: 189845 - DNA, 12 bp, Unknown
  misc_feature (1)..( 12): Result.005 file - promoters50/4768568
cgttatttaata

SEQ ID NO: 189846 - DNA, 12 bp, Unknown
  misc_feature (1)..( 12): Result.005 file - promoters50/4768568
actgatttttca

SEQ ID NO: 189847 - DNA, 12 bp, Unknown
  misc_feature (1)..( 12): Result.005 file - promoters50/4768568
aaagttttgata

SEQ ID NO: 189848 - DNA, 11 bp, Unknown
  misc_feature (1)..( 11): Result.005 file - promoters50/4768568
ctttgattagc

SEQ ID NO: 189849 - DNA, 11 bp, Unknown
  misc_feature (1)..( 11): Result.005 file - promoters50/4768568
tttttattttt

SEQ ID NO: 189850 - DNA, 12 bp, Unknown
  misc_feature (1)..( 12): Result.005 file - promoters50/4768568
ccattactttac

SEQ ID NO: 189851 - DNA, 12 bp, Unknown
  misc_feature (1)..( 12): Result.005 file - promoters50/4768568
tttttagtttgt

SEQ ID NO: 189852 - DNA, 12 bp, Unknown
  misc_feature (1)..( 12): Result.005 file - promoters50/4768568
acattgcttcgt

SEQ ID NO: 189853 - DNA, 12 bp, Unknown
  misc_feature (1)..( 12): Result.005 file - promoters50/4768568
caacaactatac

SEQ ID NO: 189854 - DNA, 12 bp, Unknown
  misc_feature (1)..( 12): Result.005 file - promoters50/4768568
catttagtcatt

SEQ ID NO: 189855 - DNA, 9 bp, Unknown
  misc_feature (1)..( 9): Result.005 file - promoters50/4768568
cctaaaagc

SEQ ID NO: 189856 - DNA, 9 bp, Unknown
  misc_feature (1)..( 9): Result.005 file - promoters50/4768568
actaaaaaa

SEQ ID NO: 189857 - DNA, 9 bp, Unknown
  misc_feature (1)..( 9): Result.005 file - promoters50/4768568
gataaaagc

SEQ ID NO: 189858 - DNA, 10 bp, Unknown
  misc_feature (1)..( 10): Result.005 file - promoters50/4768568
aataagaaat

SEQ ID NO: 189859 - DNA, 10 bp, Unknown
  misc_feature (1)..( 10): Result.005 file - promoters50/4768568
aataagacaa

SEQ ID NO: 189860 - DNA, 10 bp, Unknown
  misc_feature (1)..( 10): Result.005 file - promoters50/4768568
tttaaaaaag

SEQ ID NO: 189861 - DNA, 13 bp, Unknown
  misc_feature (1)..( 13): Result.005 file - promoters50/4768599
tattaataatttt

SEQ ID NO: 189862 - DNA, 13 bp, Unknown
  misc_feature (1)..( 13): Result.005 file - promoters50/4768599
atttaatacgttt

SEQ ID NO: 189863 - DNA, 13 bp, Unknown
  misc_feature (1)..( 13): Result.005 file - promoters50/4768599
tattaagaatttg

SEQ ID NO: 189864 - DNA, 13 bp, Unknown
  misc_feature (1)..( 13): Result.005 file - promoters50/4768599
acttactaactag

SEQ ID NO: 189865 - DNA, 13 bp, Unknown
  misc_feature (1)..( 13): Result.005 file - promoters50/4768599
aaaagcgaatttg

SEQ ID NO: 189866 - DNA, 15 bp, Unknown
  misc_feature (1)..( 15): Result.005 file - promoters50/4768599
aattttagttattaa

SEQ ID NO: 189867 - DNA, 15 bp, Unknown
  misc_feature (1)..( 15): Result.005 file - promoters50/4768599
atatttggttttacg

SEQ ID NO: 189868 - DNA, 15 bp, Unknown
  misc_feature (1)..( 15): Result.005 file - promoters50/4768599
gaatttgattttcat

SEQ ID NO: 189869 - DNA, 15 bp, Unknown
  misc_feature (1)..( 15): Result.005 file - promoters50/4768599
gaatttgtttgattg

SEQ ID NO: 189870 - DNA, 15 bp, Unknown
  misc_feature (1)..( 15): Result.005 file - promoters50/4768599
ttttttaatttccat

SEQ ID NO: 189871 - DNA, 11 bp, Unknown
  misc_feature (1)..( 11): Result.005 file - promoters50/4768599
tttaattttag

SEQ ID NO: 189872 - DNA, 11 bp, Unknown
  misc_feature (1)..( 11): Result.005 file - promoters50/4768599
tttgattttca

SEQ ID NO: 189873 - DNA, 11 bp, Unknown
  misc_feature (1)..( 11): Result.005 file - promoters50/4768599
tataatattaa

SEQ ID NO: 189874 - DNA, 12 bp, Unknown
  misc_feature (1)..( 12): Result.005 file - promoters50/4768599
tttaaatttttt

SEQ ID NO: 189875 - DNA, 12 bp, Unknown
  misc_feature (1)..( 12): Result.005 file - promoters50/4768599
atttggttttac

SEQ ID NO: 189876 - DNA, 13 bp, Unknown
  misc_feature (1)..( 13): Result.005 file - promoters50/4768599
aattttaataatt

SEQ ID NO: 189877 - DNA, 13 bp, Unknown
  misc_feature (1)..( 13): Result.005 file - promoters50/4768599
aatattacgttta

SEQ ID NO: 189878 - DNA, 13 bp, Unknown
  misc_feature (1)..( 13): Result.005 file - promoters50/4768599
ttgtttaaatttt

SEQ ID NO: 189879 - DNA, 13 bp, Unknown
  misc_feature (1)..( 13): Result.005 file - promoters50/4768599
tatagtacattta

SEQ ID NO: 189880 - DNA, 12 bp, Unknown
  misc_feature (1)..( 12): Result.005 file - promoters50/4768599
aataattttaat

SEQ ID NO: 189881 - DNA, 12 bp, Unknown
  misc_feature (1)..( 12): Result.005 file - promoters50/4768599
tttaatttccat

SEQ ID NO: 189882 - DNA, 12 bp, Unknown
  misc_feature (1)..( 12): Result.005 file - promoters50/4768599
tttgattttcat

SEQ ID NO: 189883 - DNA, 12 bp, Unknown
  misc_feature (1)..( 12): Result.005 file - promoters50/4768599
tttgattgtgtc

SEQ ID NO: 189884 - DNA, 12 bp, Unknown
  misc_feature (1)..( 12): Result.005 file - promoters50/4768599
tttgataccagt

SEQ ID NO: 189885 - DNA, 12 bp, Unknown
  misc_feature (1)..( 12): Result.005 file - promoters50/4768599
tttgattgtgtc

SEQ ID NO: 189886 - DNA, 12 bp, Unknown
  misc_feature (1)..( 12): Result.005 file - promoters50/4768599
tttgattttcat

SEQ ID NO: 189887 - DNA, 12 bp, Unknown
  misc_feature (1)..( 12): Result.005 file - promoters50/4768599
tttaatttccat

SEQ ID NO: 189888 - DNA, 11 bp, Unknown
  misc_feature (1)..( 11): Result.005 file - promoters50/4768615
ttaacaaaaaa

SEQ ID NO: 189889 - DNA, 11 bp, Unknown
  misc_feature (1)..( 11): Result.005 file - promoters50/4768615
tatacaaaaaa

SEQ ID NO: 189890 - DNA, 11 bp, Unknown
  misc_feature (1)..( 11): Result.005 file - promoters50/4768615
attacaaaact

SEQ ID NO: 189891 - DNA, 11 bp, Unknown
  misc_feature (1)..( 11): Result.005 file - promoters50/4768615
ctcccaaaaat

SEQ ID NO: 189892 - DNA, 11 bp, Unknown
  misc_feature (1)..( 11): Result.005 file - promoters50/4768615
ctaataaagta

SEQ ID NO: 189893 - DNA, 11 bp, Unknown
  misc_feature (1)..( 11): Result.005 file - promoters50/4768615
ttcctaaaatc

SEQ ID NO: 189894 - DNA, 11 bp, Unknown
  misc_feature (1)..( 11): Result.005 file - promoters50/4768615
atttcaaaatt

SEQ ID NO: 189895 - DNA, 12 bp, Unknown
  misc_feature (1)..( 12): Result.005 file - promoters50/4768615
caaaaaacttta

SEQ ID NO: 189896 - DNA, 12 bp, Unknown
  misc_feature (1)..( 12): Result.005 file - promoters50/4768615
caataaaattaa

SEQ ID NO: 189897 - DNA, 12 bp, Unknown
  misc_feature (1)..( 12): Result.005 file - promoters50/4768615
caaaaacagtaa

SEQ ID NO: 189898 - DNA, 12 bp, Unknown
  misc_feature (1)..( 12): Result.005 file - promoters50/4768615
caaaaattatta

SEQ ID NO: 189899 - DNA, 12 bp, Unknown
  misc_feature (1)..( 12): Result.005 file - promoters50/4768615
agataatatttc

SEQ ID NO: 189900 - DNA, 12 bp, Unknown
  misc_feature (1)..( 12): Result.005 file - promoters50/4768615
aaataaataaaa

SEQ ID NO: 189901 - DNA, 12 bp, Unknown
  misc_feature (1)..( 12): Result.005 file - promoters50/4768615
taattaaattaa

SEQ ID NO: 189902 - DNA, 12 bp, Unknown
  misc_feature (1)..( 12): Result.005 file - promoters50/4768615
taaaaatctcga

SEQ ID NO: 189903 - DNA, 14 bp, Unknown
  misc_feature (1)..( 14): Result.005 file - promoters50/4768615
aactttattataga

SEQ ID NO: 189904 - DNA, 14 bp, Unknown
  misc_feature (1)..( 14): Result.005 file - promoters50/4768615
aaaattaatattta

SEQ ID NO: 189905 - DNA, 14 bp, Unknown
  misc_feature (1)..( 14): Result.005 file - promoters50/4768615
tcttttattttatt

SEQ ID NO: 189906 - DNA, 14 bp, Unknown
  misc_feature (1)..( 14): Result.005 file - promoters50/4768615
ggagataatatttc

SEQ ID NO: 189907 - DNA, 14 bp, Unknown
  misc_feature (1)..( 14): Result.005 file - promoters50/4768615
aaaataaataaaag

SEQ ID NO: 189908 - DNA, 14 bp, Unknown
  misc_feature (1)..( 14): Result.005 file - promoters50/4768615
catattaataaagc

SEQ ID NO: 189909 - DNA, 14 bp, Unknown
  misc_feature (1)..( 14): Result.005 file - promoters50/4768615
aatattaataatta

SEQ ID NO: 189910 - DNA, 14 bp, Unknown
  misc_feature (1)..( 14): Result.005 file - promoters50/4768615
cgatgaaatataag

SEQ ID NO: 189911 - DNA, 13 bp, Unknown
  misc_feature (1)..( 13): Result.005 file - promoters50/4768615
aatttaactaatt

SEQ ID NO: 189912 - DNA, 13 bp, Unknown
  misc_feature (1)..( 13): Result.005 file - promoters50/4768615
tctataaataaat

SEQ ID NO: 189913 - DNA, 13 bp, Unknown
  misc_feature (1)..( 13): Result.005 file - promoters50/4768615
aatataactcttg

SEQ ID NO: 189914 - DNA, 13 bp, Unknown
  misc_feature (1)..( 13): Result.005 file - promoters50/4768615
agtcaaacaaatg

SEQ ID NO: 189915 - DNA, 13 bp, Unknown
  misc_feature (1)..( 13): Result.005 file - promoters50/4768615
tgaaaaacaaacg

SEQ ID NO: 189916 - DNA, 13 bp, Unknown
  misc_feature (1)..( 13): Result.005 file - promoters50/4768615
agtataatgaatt

SEQ ID NO: 189917 - DNA, 13 bp, Unknown
  misc_feature (1)..( 13): Result.005 file - promoters50/4768615
agtcaatcaaatt

SEQ ID NO: 189918 - DNA, 13 bp, Unknown
  misc_feature (1)..( 13): Result.005 file - promoters50/4768615
gggaaaaaaaaga

SEQ ID NO: 189919 - DNA, 12 bp, Unknown
  misc_feature (1)..( 12): Result.005 file - promoters50/4768615
ttacaaaatatc

SEQ ID NO: 189920 - DNA, 12 bp, Unknown
  misc_feature (1)..( 12): Result.005 file - promoters50/4768615
ctttaaactatg

SEQ ID NO: 189921 - DNA, 12 bp, Unknown
  misc_feature (1)..( 12): Result.005 file - promoters50/4768615
aaaaaaaataag

SEQ ID NO: 189922 - DNA, 12 bp, Unknown
  misc_feature (1)..( 12): Result.005 file - promoters50/4768615
acaaaaacaata

SEQ ID NO: 189923 - DNA, 12 bp, Unknown
  misc_feature (1)..( 12): Result.005 file - promoters50/4768615
ccaaagacaagt

SEQ ID NO: 189924 - DNA, 12 bp, Unknown
  misc_feature (1)..( 12): Result.005 file - promoters50/4768615
tttttaaataca

SEQ ID NO: 189925 - DNA, 12 bp, Unknown
  misc_feature (1)..( 12): Result.005 file - promoters50/4768615
agatagataaga

SEQ ID NO: 189926 - DNA, 11 bp, Unknown
  misc_feature (1)..( 11): Result.005 file - promoters50/4768615
gggttacaaaa

SEQ ID NO: 189927 - DNA, 11 bp, Unknown
  misc_feature (1)..( 11): Result.005 file - promoters50/4768615
aagagacaaaa

SEQ ID NO: 189928 - DNA, 11 bp, Unknown
  misc_feature (1)..( 11): Result.005 file - promoters50/4768615
gtttaacaaaa

SEQ ID NO: 189929 - DNA, 11 bp, Unknown
  misc_feature (1)..( 11): Result.005 file - promoters50/4768615
caaagacaagt

SEQ ID NO: 189930 - DNA, 11 bp, Unknown
  misc_feature (1)..( 11): Result.005 file - promoters50/4768615
gatagataaga

SEQ ID NO: 189931 - DNA, 11 bp, Unknown
  misc_feature (1)..( 11): Result.005 file - promoters50/4768615
gcctaataaaa

SEQ ID NO: 189932 - DNA, 11 bp, Unknown
  misc_feature (1)..( 11): Result.005 file - promoters50/4768615
catcaataaat

SEQ ID NO: 189933 - DNA, 14 bp, Unknown
  misc_feature (1)..( 14): Result.005 file - promoters50/4768615
aacaacaaaaaaag

SEQ ID NO: 189934 - DNA, 14 bp, Unknown
  misc_feature (1)..( 14): Result.005 file - promoters50/4768615
aagtacaaaacgaa

SEQ ID NO: 189935 - DNA, 14 bp, Unknown
  misc_feature (1)..( 14): Result.005 file - promoters50/4768615
aacgacaaaacaag

SEQ ID NO: 189936 - DNA, 14 bp, Unknown
  misc_feature (1)..( 14): Result.005 file - promoters50/4768615
atcaacaaaaattg

SEQ ID NO: 189937 - DNA, 14 bp, Unknown
  misc_feature (1)..( 14): Result.005 file - promoters50/4768615
ataaaccaatgttt

SEQ ID NO: 189938 - DNA, 14 bp, Unknown
  misc_feature (1)..( 14): Result.005 file - promoters50/4768615
accgttaaaaatct

SEQ ID NO: 189939 - DNA, 14 bp, Unknown
  misc_feature (1)..( 14): Result.005 file - promoters50/4768615
aaaatcaagaatac

SEQ ID NO: 189940 - DNA, 15 bp, Unknown
  misc_feature (1)..( 15): Result.005 file - promoters50/4768615
aaaaagaaatcgaag

SEQ ID NO: 189941 - DNA, 15 bp, Unknown
  misc_feature (1)..( 15): Result.005 file - promoters50/4768615
aaaacgaaaacaatc

SEQ ID NO: 189942 - DNA, 16 bp, Unknown
  misc_feature (1)..( 16): Result.005 file - promoters50/4768615
cgaacgacaaaacaag

SEQ ID NO: 189943 - DNA, 16 bp, Unknown
  misc_feature (1)..( 16): Result.005 file - promoters50/4768615
taaaccaatgtttatt

SEQ ID NO: 189944 - DNA, 16 bp, Unknown
  misc_feature (1)..( 16): Result.005 file - promoters50/4768615
tcaacaaaaattgaaa

SEQ ID NO: 189945 - DNA, 16 bp, Unknown
  misc_feature (1)..( 16): Result.005 file - promoters50/4768615
aaaaatctcgtgtgca

SEQ ID NO: 189946 - DNA, 16 bp, Unknown
  misc_feature (1)..( 16): Result.005 file - promoters50/4768615
atcaagaatacatttc

SEQ ID NO: 189947 - DNA, 8 bp, Unknown
  misc_feature (1)..( 8): Result.005 file - promoters50/4768615
tataaact

SEQ ID NO: 189948 - DNA, 8 bp, Unknown
  misc_feature (1)..( 8): Result.005 file - promoters50/4768615
tatatact

SEQ ID NO: 189949 - DNA, 8 bp, Unknown
  misc_feature (1)..( 8): Result.005 file - promoters50/4768615
tataaatt

SEQ ID NO: 189950 - DNA, 8 bp, Unknown
  misc_feature (1)..( 8): Result.005 file - promoters50/4768615
tataaacc

SEQ ID NO: 189951 - DNA, 8 bp, Unknown
  misc_feature (1)..( 8): Result.005 file - promoters50/4768615
tataaaca

SEQ ID NO: 189952 - DNA, 8 bp, Unknown
  misc_feature (1)..( 8): Result.005 file - promoters50/4768615
tatatata

SEQ ID NO: 189953 - DNA, 8 bp, Unknown
  misc_feature (1)..( 8): Result.005 file - promoters50/4768615
tatatata

SEQ ID NO: 189954 - DNA, 12 bp, Unknown
  misc_feature (1)..( 12): Result.005 file - promoters50/4768615
cagttatttaaa

SEQ ID NO: 189955 - DNA, 12 bp, Unknown
  misc_feature (1)..( 12): Result.005 file - promoters50/4768615
ttgttattatat

SEQ ID NO: 189956 - DNA, 12 bp, Unknown
  misc_feature (1)..( 12): Result.005 file - promoters50/4768615
atattattagcc

SEQ ID NO: 189957 - DNA, 12 bp, Unknown
  misc_feature (1)..( 12): Result.005 file - promoters50/4768615
atattattagta

SEQ ID NO: 189958 - DNA, 12 bp, Unknown
  misc_feature (1)..( 12): Result.005 file - promoters50/4768615
tagttaatatat

SEQ ID NO: 189959 - DNA, 12 bp, Unknown
  misc_feature (1)..( 12): Result.005 file - promoters50/4768615
aagtcaatcaaa

SEQ ID NO: 189960 - DNA, 10 bp, Unknown
  misc_feature (1)..( 10): Result.005 file - promoters50/4768615
cctttataaa

SEQ ID NO: 189961 - DNA, 10 bp, Unknown
  misc_feature (1)..( 10): Result.005 file - promoters50/4768615
cctatatata

SEQ ID NO: 189962 - DNA, 10 bp, Unknown
  misc_feature (1)..( 10): Result.005 file - promoters50/4768615
cctctatata

SEQ ID NO: 189963 - DNA, 10 bp, Unknown
  misc_feature (1)..( 10): Result.005 file - promoters50/4768615
cctatatata

SEQ ID NO: 189964 - DNA, 10 bp, Unknown
  misc_feature (1)..( 10): Result.005 file - promoters50/4768615
tatatatact

SEQ ID NO: 189965 - DNA, 10 bp, Unknown
  misc_feature (1)..( 10): Result.005 file - promoters50/4768615
attatatata

SEQ ID NO: 189966 - DNA, 10 bp, Unknown
  misc_feature (1)..( 10): Result.005 file - promoters50/4768615
cctataaatt

SEQ ID NO: 189967 - DNA, 14 bp, Unknown
  misc_feature (1)..( 14): Result.005 file - promoters50/4768615
aacaacaaaaaaag

SEQ ID NO: 189968 - DNA, 14 bp, Unknown
  misc_feature (1)..( 14): Result.005 file - promoters50/4768615
cacaacattgcttc

SEQ ID NO: 189969 - DNA, 14 bp, Unknown
  misc_feature (1)..( 14): Result.005 file - promoters50/4768615
aacgacaaaacaag

SEQ ID NO: 189970 - DNA, 14 bp, Unknown
  misc_feature (1)..( 14): Result.005 file - promoters50/4768615
atcaacaaaaattg

SEQ ID NO: 189971 - DNA, 14 bp, Unknown
  misc_feature (1)..( 14): Result.005 file - promoters50/4768615
taaaccaatgttta

SEQ ID NO: 189972 - DNA, 14 bp, Unknown
  misc_feature (1)..( 14): Result.005 file - promoters50/4768615
aacgaaaacaatca

SEQ ID NO: 189973 - DNA, 14 bp, Unknown
  misc_feature (1)..( 14): Result.005 file - promoters50/4768615
gttaaaaatctcgt

SEQ ID NO: 189974 - DNA, 14 bp, Unknown
  misc_feature (1)..( 14): Result.005 file - promoters50/4768615
tccaaaattaaaat

SEQ ID NO: 189975 - DNA, 10 bp, Unknown
  misc_feature (1)..( 10): Result.005 file - promoters50/4768615
taaaaattaa

SEQ ID NO: 189976 - DNA, 10 bp, Unknown
  misc_feature (1)..( 10): Result.005 file - promoters50/4768615
taaaaatctc

SEQ ID NO: 189977 - DNA, 10 bp, Unknown
  misc_feature (1)..( 10): Result.005 file - promoters50/4768615
gtaaaatttc

SEQ ID NO: 189978 - DNA, 10 bp, Unknown
  misc_feature (1)..( 10): Result.005 file - promoters50/4768615
aaaatattaa

SEQ ID NO: 189979 - DNA, 10 bp, Unknown
  misc_feature (1)..( 10): Result.005 file - promoters50/4768615
caaaaattat

SEQ ID NO: 189980 - DNA, 10 bp, Unknown
  misc_feature (1)..( 10): Result.005 file - promoters50/4768615
caaagattac

SEQ ID NO: 189981 - DNA, 10 bp, Unknown
  misc_feature (1)..( 10): Result.005 file - promoters50/4768615
ataagattag

SEQ ID NO: 189982 - DNA, 11 bp, Unknown
  misc_feature (1)..( 11): Result.005 file - promoters50/4768615
aatgctagaag

SEQ ID NO: 189983 - DNA, 11 bp, Unknown
  misc_feature (1)..( 11): Result.005 file - promoters50/4768615
aatactaaaaa

SEQ ID NO: 189984 - DNA, 11 bp, Unknown
  misc_feature (1)..( 11): Result.005 file - promoters50/4768615
aatattaacct

SEQ ID NO: 189985 - DNA, 11 bp, Unknown
  misc_feature (1)..( 11): Result.005 file - promoters50/4768615
aatactatcta

SEQ ID NO: 189986 - DNA, 11 bp, Unknown
  misc_feature (1)..( 11): Result.005 file - promoters50/4768615
aagattacata

SEQ ID NO: 189987 - DNA, 11 bp, Unknown
  misc_feature (1)..( 11): Result.005 file - promoters50/4768615
aaaatttcata

SEQ ID NO: 189988 - DNA, 13 bp, Unknown
  misc_feature (1)..( 13): Result.005 file - promoters50/4768615
tgagttaaaaaat

SEQ ID NO: 189989 - DNA, 13 bp, Unknown
  misc_feature (1)..( 13): Result.005 file - promoters50/4768615
ctagttaatatat

SEQ ID NO: 189990 - DNA, 13 bp, Unknown
  misc_feature (1)..( 13): Result.005 file - promoters50/4768615
tgaattaagacct

SEQ ID NO: 189991 - DNA, 13 bp, Unknown
  misc_feature (1)..( 13): Result.005 file - promoters50/4768615
tttgttattatat

SEQ ID NO: 189992 - DNA, 13 bp, Unknown
  misc_feature (1)..( 13): Result.005 file - promoters50/4768615
aaagtcaatcaaa

SEQ ID NO: 189993 - DNA, 13 bp, Unknown
  misc_feature (1)..( 13): Result.005 file - promoters50/4768615
cgtcatattatta

SEQ ID NO: 189994 - DNA, 7 bp, Unknown
  misc_feature (1)..( 7): Result.005 file - promoters50/4768623
cttaata

SEQ ID NO: 189995 - DNA, 7 bp, Unknown
  misc_feature (1)..( 7): Result.005 file - promoters50/4768623
gttaata

SEQ ID NO: 189996 - DNA, 7 bp, Unknown
  misc_feature (1)..( 7): Result.005 file - promoters50/4768623
cttaatc

SEQ ID NO: 189997 - DNA, 8 bp, Unknown
  misc_feature (1)..( 8): Result.005 file - promoters50/4768623
attactga

SEQ ID NO: 189998 - DNA, 8 bp, Unknown
  misc_feature (1)..( 8): Result.005 file - promoters50/4768623
attattga

SEQ ID NO: 189999 - DNA, 8 bp, Unknown
  misc_feature (1)..( 8): Result.005 file - promoters50/4768623
attattta

SEQ ID NO: 190000 - DNA, 11 bp, Unknown
  misc_feature (1)..( 11): Result.005 file - promoters50/4768631
tgataatttga

SEQ ID NO: 190001 - DNA, 11 bp, Unknown
  misc_feature (1)..( 11): Result.005 file - promoters50/4768631
tcataatttcg

SEQ ID NO: 190002 - DNA, 11 bp, Unknown
  misc_feature (1)..( 11): Result.005 file - promoters50/4768631
tgataatccat

SEQ ID NO: 190003 - DNA, 11 bp, Unknown
  misc_feature (1)..( 11): Result.005 file - promoters50/4768631
accaaatctcg

SEQ ID NO: 190004 - DNA, 11 bp, Unknown
  misc_feature (1)..( 11): Result.005 file - promoters50/4768631
tgtaaatctca

SEQ ID NO: 190005 - DNA, 11 bp, Unknown
  misc_feature (1)..( 11): Result.005 file - promoters50/4768635
ttccatgtttt

SEQ ID NO: 190006 - DNA, 11 bp, Unknown
  misc_feature (1)..( 11): Result.005 file - promoters50/4768635
cttaatgtttg

SEQ ID NO: 190007 - DNA, 11 bp, Unknown
  misc_feature (1)..( 11): Result.005 file - promoters50/4768635
tttgatgattg

SEQ ID NO: 190008 - DNA, 9 bp, Unknown
  misc_feature (1)..( 9): Result.005 file - promoters50/4768635
taaagttat

SEQ ID NO: 190009 - DNA, 11 bp, Unknown
  misc_feature (1)..( 11): Result.005 file - promoters50/4768635
tttgatgatta

SEQ ID NO: 190010 - DNA, 11 bp, Unknown
  misc_feature (1)..( 11): Result.005 file - promoters50/4768635
aatgattattc

SEQ ID NO: 190011 - DNA, 10 bp, Unknown
  misc_feature (1)..( 10): Result.005 file - promoters50/4768635
tttgctgatg

SEQ ID NO: 190012 - DNA, 10 bp, Unknown
  misc_feature (1)..( 10): Result.005 file - promoters50/4768635
tttgcttctt

SEQ ID NO: 190013 - DNA, 10 bp, Unknown
  misc_feature (1)..( 10): Result.005 file - promoters50/4768635
tttgatgatt

SEQ ID NO: 190014 - DNA, 10 bp, Unknown
  misc_feature (1)..( 10): Result.005 file - promoters50/4768635
ttttcttcac

SEQ ID NO: 190015 - DNA, 10 bp, Unknown
  misc_feature (1)..( 10): Result.005 file - promoters50/4768635
tttgatgatt

SEQ ID NO: 190016 - DNA, 10 bp, Unknown
  misc_feature (1)..( 10): Result.005 file - promoters50/4768635
aatgattatt

SEQ ID NO: 190017 - DNA, 16 bp, Unknown
  misc_feature (1)..( 16): Result.005 file - promoters50/4768635
atttttacttttaaca

SEQ ID NO: 190018 - DNA, 16 bp, Unknown
  misc_feature (1)..( 16): Result.005 file - promoters50/4768635
gttgttacttttatta

SEQ ID NO: 190019 - DNA, 16 bp, Unknown
  misc_feature (1)..( 16): Result.005 file - promoters50/4768635
ttgtttaattttaaaa

SEQ ID NO: 190020 - DNA, 16 bp, Unknown
  misc_feature (1)..( 16): Result.005 file - promoters50/4768635
taataggtttttattt

SEQ ID NO: 190021 - DNA, 16 bp, Unknown
  misc_feature (1)..( 16): Result.005 file - promoters50/4768635
ttggttaattctaact

SEQ ID NO: 190022 - DNA, 16 bp, Unknown
  misc_feature (1)..( 16): Result.005 file - promoters50/4768635
gctacttgttcaaact

SEQ ID NO: 190023 - DNA, 7 bp, Unknown
  misc_feature (1)..( 7): Result.005 file - promoters50/4768635
attctta

SEQ ID NO: 190024 - DNA, 7 bp, Unknown
  misc_feature (1)..( 7): Result.005 file - promoters50/4768635
attttta

SEQ ID NO: 190025 - DNA, 7 bp, Unknown
  misc_feature (1)..( 7): Result.005 file - promoters50/4768635
atttttg

SEQ ID NO: 190026 - DNA, 7 bp, Unknown
  misc_feature (1)..( 7): Result.005 file - promoters50/4768635
tttttta

SEQ ID NO: 190027 - DNA, 7 bp, Unknown
  misc_feature (1)..( 7): Result.005 file - promoters50/4768635
gtttttg

SEQ ID NO: 190028 - DNA, 7 bp, Unknown
  misc_feature (1)..( 7): Result.005 file - promoters50/4768635
cttttta

SEQ ID NO: 190029 - DNA, 10 bp, Unknown
  misc_feature (1)..( 10): Result.005 file - promoters50/4768635
acataaattt

SEQ ID NO: 190030 - DNA, 10 bp, Unknown
  misc_feature (1)..( 10): Result.005 file - promoters50/4768635
atatatattc

SEQ ID NO: 190031 - DNA, 11 bp, Unknown
  misc_feature (1)..( 11): Result.005 file - promoters50/4768635
gttcaaacttt

SEQ ID NO: 190032 - DNA, 11 bp, Unknown
  misc_feature (1)..( 11): Result.005 file - promoters50/4768635
gaataaatccg

SEQ ID NO: 190033 - DNA, 11 bp, Unknown
  misc_feature (1)..( 11): Result.005 file - promoters50/4768635
accaaaactta

SEQ ID NO: 190034 - DNA, 11 bp, Unknown
  misc_feature (1)..( 11): Result.005 file - promoters50/4768635
ttctaactcaa

SEQ ID NO: 190035 - DNA, 9 bp, Unknown
  misc_feature (1)..( 9): Result.005 file - promoters50/4768663
gaataacaa

SEQ ID NO: 190036 - DNA, 9 bp, Unknown
  misc_feature (1)..( 9): Result.005 file - promoters50/4768663
caataacca

SEQ ID NO: 190037 - DNA, 9 bp, Unknown
  misc_feature (1)..( 9): Result.005 file - promoters50/4768663
aaattacaa

SEQ ID NO: 190038 - DNA, 9 bp, Unknown
  misc_feature (1)..( 9): Result.005 file - promoters50/4768663
gaaaaaccc

SEQ ID NO: 190039 - DNA, 9 bp, Unknown
  misc_feature (1)..( 9): Result.005 file - promoters50/4768663
aaattatta

SEQ ID NO: 190040 - DNA, 9 bp, Unknown
  misc_feature (1)..( 9): Result.005 file - promoters50/4768663
aaattatat

SEQ ID NO: 190041 - DNA, 9 bp, Unknown
  misc_feature (1)..( 9): Result.005 file - promoters50/4768663
aaattactc

SEQ ID NO: 190042 - DNA, 17 bp, Unknown
  misc_feature (1)..( 17): Result.005 file - promoters50/4768663
gtcgctgatttacaaaa

SEQ ID NO: 190043 - DNA, 17 bp, Unknown
  misc_feature (1)..( 17): Result.005 file - promoters50/4768663
aacaaatatttaaaaaa

SEQ ID NO: 190044 - DNA, 17 bp, Unknown
  misc_feature (1)..( 17): Result.005 file - promoters50/4768663
attacagatttacatat

SEQ ID NO: 190045 - DNA, 17 bp, Unknown
  misc_feature (1)..( 17): Result.005 file - promoters50/4768663
tgttcaaattttcaagt

SEQ ID NO: 190046 - DNA, 17 bp, Unknown
  misc_feature (1)..( 17): Result.005 file - promoters50/4768663
ttttttggtttgaaata

SEQ ID NO: 190047 - DNA, 17 bp, Unknown
  misc_feature (1)..( 17): Result.005 file - promoters50/4768663
aaccaatacttaaattc

SEQ ID NO: 190048 - DNA, 7 bp, Unknown
  misc_feature (1)..( 7): Result.005 file - promoters50/4768678
caaattg

SEQ ID NO: 190049 - DNA, 7 bp, Unknown
  misc_feature (1)..( 7): Result.005 file - promoters50/4768678
caaattc

SEQ ID NO: 190050 - DNA, 7 bp, Unknown
  misc_feature (1)..( 7): Result.005 file - promoters50/4768678
caatttc

SEQ ID NO: 190051 - DNA, 15 bp, Unknown
  misc_feature (1)..( 15): Result.005 file - promoters50/4768698
ataactttatgttat

SEQ ID NO: 190052 - DNA, 15 bp, Unknown
  misc_feature (1)..( 15): Result.005 file - promoters50/4768698
gtaacttcaggctaa

SEQ ID NO: 190053 - DNA, 15 bp, Unknown
  misc_feature (1)..( 15): Result.005 file - promoters50/4768698
atatctttataagta

SEQ ID NO: 190054 - DNA, 15 bp, Unknown
  misc_feature (1)..( 15): Result.005 file - promoters50/4768698
ataactttatgttat

SEQ ID NO: 190055 - DNA, 15 bp, Unknown
  misc_feature (1)..( 15): Result.005 file - promoters50/4768698
tacgttttaaaagta

SEQ ID NO: 190056 - DNA, 15 bp, Unknown
  misc_feature (1)..( 15): Result.005 file - promoters50/4768698
ctcgcttcataacaa

SEQ ID NO: 190057 - DNA, 15 bp, Unknown
  misc_feature (1)..( 15): Result.005 file - promoters50/4768698
gattagaaaaaagtc

SEQ ID NO: 190058 - DNA, 16 bp, Unknown
  misc_feature (1)..( 16): Result.005 file - promoters50/4768698
attgtgaaataatttt

SEQ ID NO: 190059 - DNA, 16 bp, Unknown
  misc_feature (1)..( 16): Result.005 file - promoters50/4768698
attttgaaataatttc

SEQ ID NO: 190060 - DNA, 17 bp, Unknown
  misc_feature (1)..( 17): Result.005 file - promoters50/4768698
attctaaaatattgttc

SEQ ID NO: 190061 - DNA, 17 bp, Unknown
  misc_feature (1)..( 17): Result.005 file - promoters50/4768698
gattttcataaatttta

SEQ ID NO: 190062 - DNA, 17 bp, Unknown
  misc_feature (1)..( 17): Result.005 file - promoters50/4768698
tctgagaaatagatttg

SEQ ID NO: 190063 - DNA, 17 bp, Unknown
  misc_feature (1)..( 17): Result.005 file - promoters50/4768698
attgtgaaataattttg

SEQ ID NO: 190064 - DNA, 17 bp, Unknown
  misc_feature (1)..( 17): Result.005 file - promoters50/4768698
tttccataaaaatgtta

SEQ ID NO: 190065 - DNA, 11 bp, Unknown
  misc_feature (1)..( 11): Result.005 file - promoters50/4768698
tgttattagtt

SEQ ID NO: 190066 - DNA, 11 bp, Unknown
  misc_feature (1)..( 11): Result.005 file - promoters50/4768698
atgcattagtt

SEQ ID NO: 190067 - DNA, 11 bp, Unknown
  misc_feature (1)..( 11): Result.005 file - promoters50/4768698
ctttataagta

SEQ ID NO: 190068 - DNA, 11 bp, Unknown
  misc_feature (1)..( 11): Result.005 file - promoters50/4768698
ctaaatttgtt

SEQ ID NO: 190069 - DNA, 11 bp, Unknown
  misc_feature (1)..( 11): Result.005 file - promoters50/4768698
ataattttgtt

SEQ ID NO: 190070 - DNA, 11 bp, Unknown
  misc_feature (1)..( 11): Result.005 file - promoters50/4768698
ttttaaaagta

SEQ ID NO: 190071 - DNA, 11 bp, Unknown
  misc_feature (1)..( 11): Result.005 file - promoters50/4768698
cttcataacaa

SEQ ID NO: 190072 - DNA, 11 bp, Unknown
  misc_feature (1)..( 11): Result.005 file - promoters50/4768698
agaaaaaagtc

SEQ ID NO: 190073 - DNA, 13 bp, Unknown
  misc_feature (1)..( 13): Result.005 file - promoters50/4768698
atttgaaaatttc

SEQ ID NO: 190074 - DNA, 13 bp, Unknown
  misc_feature (1)..( 13): Result.005 file - promoters50/4768698
aacagaaaattcg

SEQ ID NO: 190075 - DNA, 13 bp, Unknown
  misc_feature (1)..( 13): Result.005 file - promoters50/4768698
tatttgaaatttt

SEQ ID NO: 190076 - DNA, 13 bp, Unknown
  misc_feature (1)..( 13): Result.005 file - promoters50/4768698
gcgctaaactttt

SEQ ID NO: 190077 - DNA, 13 bp, Unknown
  misc_feature (1)..( 13): Result.005 file - promoters50/4768698
ggccgaaaatata

SEQ ID NO: 190078 - DNA, 13 bp, Unknown
  misc_feature (1)..( 13): Result.005 file - promoters50/4768698
tggccggaatttt

SEQ ID NO: 190079 - DNA, 13 bp, Unknown
  misc_feature (1)..( 13): Result.005 file - promoters50/4768698
ggccgaaaaaaga

SEQ ID NO: 190080 - DNA, 10 bp, Unknown
  misc_feature (1)..( 10): Result.005 file - promoters50/4768698
gtatataaat

SEQ ID NO: 190081 - DNA, 10 bp, Unknown
  misc_feature (1)..( 10): Result.005 file - promoters50/4768698
ttatataaac

SEQ ID NO: 190082 - DNA, 10 bp, Unknown
  misc_feature (1)..( 10): Result.005 file - promoters50/4768698
acctataaat

SEQ ID NO: 190083 - DNA, 10 bp, Unknown
  misc_feature (1)..( 10): Result.005 file - promoters50/4768698
atatataata

SEQ ID NO: 190084 - DNA, 10 bp, Unknown
  misc_feature (1)..( 10): Result.005 file - promoters50/4768698
gtatataaac

SEQ ID NO: 190085 - DNA, 10 bp, Unknown
  misc_feature (1)..( 10): Result.005 file - promoters50/4768698
gtatataaat

SEQ ID NO: 190086 - DNA, 14 bp, Unknown
  misc_feature (1)..( 14): Result.005 file - promoters50/4768698
gatttgctgaataa

SEQ ID NO: 190087 - DNA, 14 bp, Unknown
  misc_feature (1)..( 14): Result.005 file - promoters50/4768698
attttgatgaatgt

SEQ ID NO: 190088 - DNA, 14 bp, Unknown
  misc_feature (1)..( 14): Result.005 file - promoters50/4768698
gtgatgaagaagga

SEQ ID NO: 190089 - DNA, 14 bp, Unknown
  misc_feature (1)..( 14): Result.005 file - promoters50/4768698
tttttgaagaattt

SEQ ID NO: 190090 - DNA, 14 bp, Unknown
  misc_feature (1)..( 14): Result.005 file - promoters50/4768698
tttttgggtcaatt

SEQ ID NO: 190091 - DNA, 14 bp, Unknown
  misc_feature (1)..( 14): Result.005 file - promoters50/4768698
ctttcgatgtataa

SEQ ID NO: 190092 - DNA, 14 bp, Unknown
  misc_feature (1)..( 14): Result.005 file - promoters50/4768698
tcccttgtgaatgt

SEQ ID NO: 190093 - DNA, 15 bp, Unknown
  misc_feature (1)..( 15): Result.005 file - promoters50/4768698
tgttagataggaaaa

SEQ ID NO: 190094 - DNA, 15 bp, Unknown
  misc_feature (1)..( 15): Result.005 file - promoters50/4768698
tgttaaatatgaata

SEQ ID NO: 190095 - DNA, 15 bp, Unknown
  misc_feature (1)..( 15): Result.005 file - promoters50/4768698
tcataaattttaaaa

SEQ ID NO: 190096 - DNA, 15 bp, Unknown
  misc_feature (1)..( 15): Result.005 file - promoters50/4768698
tctaaaatattgttc

SEQ ID NO: 190097 - DNA, 15 bp, Unknown
  misc_feature (1)..( 15): Result.005 file - promoters50/4768698
tgtttaatggagttt

SEQ ID NO: 190098 - DNA, 15 bp, Unknown
  misc_feature (1)..( 15): Result.005 file - promoters50/4768698
aaatagatttgaaaa

SEQ ID NO: 190099 - DNA, 10 bp, Unknown
  misc_feature (1)..( 10): Result.005 file - promoters50/4768708
ggtgtttttg

SEQ ID NO: 190100 - DNA, 10 bp, Unknown
  misc_feature (1)..( 10): Result.005 file - promoters50/4768708
taagttgttg

SEQ ID NO: 190101 - DNA, 10 bp, Unknown
  misc_feature (1)..( 10): Result.005 file - promoters50/4768708
taaattgtct

SEQ ID NO: 190102 - DNA, 8 bp, Unknown
  misc_feature (1)..( 8): Result.005 file - promoters50/4768708
tttgagac

SEQ ID NO: 190103 - DNA, 8 bp, Unknown
  misc_feature (1)..( 8): Result.005 file - promoters50/4768708
tttaagat

SEQ ID NO: 190104 - DNA, 8 bp, Unknown
  misc_feature (1)..( 8): Result.005 file - promoters50/4768708
tataagat

SEQ ID NO: 190105 - DNA, 10 bp, Unknown
  misc_feature (1)..( 10): Result.005 file - promoters50/4768708
gaagcaaaac

SEQ ID NO: 190106 - DNA, 10 bp, Unknown
  misc_feature (1)..( 10): Result.005 file - promoters50/4768708
aaagaaaaac

SEQ ID NO: 190107 - DNA, 10 bp, Unknown
  misc_feature (1)..( 10): Result.005 file - promoters50/4768708
gaagaaaaaa

SEQ ID NO: 190108 - DNA, 6 bp, Unknown
  misc_feature (1)..( 6): Result.005 file - promoters50/4768708
tttttt

SEQ ID NO: 190109 - DNA, 6 bp, Unknown
  misc_feature (1)..( 6): Result.005 file - promoters50/4768708
tttttt

SEQ ID NO: 190110 - DNA, 6 bp, Unknown
  misc_feature (1)..( 6): Result.005 file - promoters50/4768708
tttttt

SEQ ID NO: 190111 - DNA, 8 bp, Unknown
  misc_feature (1)..( 8): Result.005 file - promoters50/4768708
tcagtaaa

SEQ ID NO: 190112 - DNA, 8 bp, Unknown
  misc_feature (1)..( 8): Result.005 file - promoters50/4768708
aaagtaaa

SEQ ID NO: 190113 - DNA, 8 bp, Unknown
  misc_feature (1)..( 8): Result.005 file - promoters50/4768708
aaagaaaa

SEQ ID NO: 190114 - DNA, 8 bp, Unknown
  misc_feature (1)..( 8): Result.005 file - promoters50/4768754
aaaaaaat

SEQ ID NO: 190115 - DNA, 8 bp, Unknown
  misc_feature (1)..( 8): Result.005 file - promoters50/4768754
aaaacaat

SEQ ID NO: 190116 - DNA, 8 bp, Unknown
  misc_feature (1)..( 8): Result.005 file - promoters50/4768754
caaacatc

SEQ ID NO: 190117 - DNA, 10 bp, Unknown
  misc_feature (1)..( 10): Result.005 file - promoters50/4768754
tattttctat

SEQ ID NO: 190118 - DNA, 10 bp, Unknown
  misc_feature (1)..( 10): Result.005 file - promoters50/4768754
tatgttctgt

SEQ ID NO: 190119 - DNA, 10 bp, Unknown
  misc_feature (1)..( 10): Result.005 file - promoters50/4768754
catgttttgt

SEQ ID NO: 190120 - DNA, 10 bp, Unknown
  misc_feature (1)..( 10): Result.005 file - promoters50/4768762
tcattatcat

SEQ ID NO: 190121 - DNA, 10 bp, Unknown
  misc_feature (1)..( 10): Result.005 file - promoters50/4768762
tcattctcat

SEQ ID NO: 190122 - DNA, 10 bp, Unknown
  misc_feature (1)..( 10): Result.005 file - promoters50/4768762
atattctccc

SEQ ID NO: 190123 - DNA, 9 bp, Unknown
  misc_feature (1)..( 9): Result.005 file - promoters50/4768762
ttaaattga

SEQ ID NO: 190124 - DNA, 9 bp, Unknown
  misc_feature (1)..( 9): Result.005 file - promoters50/4768762
caaaaatga

SEQ ID NO: 190125 - DNA, 9 bp, Unknown
  misc_feature (1)..( 9): Result.005 file - promoters50/4768762
ttacatttg

SEQ ID NO: 190126 - DNA, 12 bp, Unknown
  misc_feature (1)..( 12): Result.005 file - promoters50/4768778
aaaaaatttatt

SEQ ID NO: 190127 - DNA, 12 bp, Unknown
  misc_feature (1)..( 12): Result.005 file - promoters50/4768778
atgagatttata

SEQ ID NO: 190128 - DNA, 12 bp, Unknown
  misc_feature (1)..( 12): Result.005 file - promoters50/4768778
agaaagtttaaa

SEQ ID NO: 190129 - DNA, 12 bp, Unknown
  misc_feature (1)..( 12): Result.005 file - promoters50/4768778
aaaaaatatata

SEQ ID NO: 190130 - DNA, 12 bp, Unknown
  misc_feature (1)..( 12): Result.005 file - promoters50/4768778
aaaacatttaaa

SEQ ID NO: 190131 - DNA, 12 bp, Unknown
  misc_feature (1)..( 12): Result.005 file - promoters50/4768778
agcgtatgtata

SEQ ID NO: 190132 - DNA, 12 bp, Unknown
  misc_feature (1)..( 12): Result.005 file - promoters50/4768782
attattctaagt

SEQ ID NO: 190133 - DNA, 12 bp, Unknown
  misc_feature (1)..( 12): Result.005 file - promoters50/4768782
cttattctttat

SEQ ID NO: 190134 - DNA, 12 bp, Unknown
  misc_feature (1)..( 12): Result.005 file - promoters50/4768782
atttttcacacg

SEQ ID NO: 190135 - DNA, 12 bp, Unknown
  misc_feature (1)..( 12): Result.005 file - promoters50/4768782
cttcttcttctt

SEQ ID NO: 190136 - DNA, 9 bp, Unknown
  misc_feature (1)..( 9): Result.005 file - promoters50/4768782
ctttgatta

SEQ ID NO: 190137 - DNA, 9 bp, Unknown
  misc_feature (1)..( 9): Result.005 file - promoters50/4768782
gtgtgatta

SEQ ID NO: 190138 - DNA, 9 bp, Unknown
  misc_feature (1)..( 9): Result.005 file - promoters50/4768782
tattgttta

SEQ ID NO: 190139 - DNA, 9 bp, Unknown
  misc_feature (1)..( 9): Result.005 file - promoters50/4768782
tattttttt

SEQ ID NO: 190140 - DNA, 12 bp, Unknown
  misc_feature (1)..( 12): Result.005 file - promoters50/4768782
atgatctattct

SEQ ID NO: 190141 - DNA, 12 bp, Unknown
  misc_feature (1)..( 12): Result.005 file - promoters50/4768782
cttgtctcttct

SEQ ID NO: 190142 - DNA, 12 bp, Unknown
  misc_feature (1)..( 12): Result.005 file - promoters50/4768782
cttctctctttt

SEQ ID NO: 190143 - DNA, 12 bp, Unknown
  misc_feature (1)..( 12): Result.005 file - promoters50/4768782
gagatcttttct

SEQ ID NO: 190144 - DNA, 14 bp, Unknown
  misc_feature (1)..( 14): Result.005 file - promoters50/4768782
tatgacaacagtca

SEQ ID NO: 190145 - DNA, 14 bp, Unknown
  misc_feature (1)..( 14): Result.005 file - promoters50/4768782
tataacagaattgc

SEQ ID NO: 190146 - DNA, 14 bp, Unknown
  misc_feature (1)..( 14): Result.005 file - promoters50/4768782
aatgactacactca

SEQ ID NO: 190147 - DNA, 14 bp, Unknown
  misc_feature (1)..( 14): Result.005 file - promoters50/4768782
tgatactacaccat

SEQ ID NO: 190148 - DNA, 9 bp, Unknown
  misc_feature (1)..( 9): Result.005 file - promoters50/4768782
ttttatata

SEQ ID NO: 190149 - DNA, 9 bp, Unknown
  misc_feature (1)..( 9): Result.005 file - promoters50/4768782
ctttttatt

SEQ ID NO: 190150 - DNA, 9 bp, Unknown
  misc_feature (1)..( 9): Result.005 file - promoters50/4768782
cttcttatt

SEQ ID NO: 190151 - DNA, 9 bp, Unknown
  misc_feature (1)..( 9): Result.005 file - promoters50/4768782
tttcttaaa

SEQ ID NO: 190152 - DNA, 7 bp, Unknown
  misc_feature (1)..( 7): Result.005 file - promoters50/4768804
ctaacaa

SEQ ID NO: 190153 - DNA, 7 bp, Unknown
  misc_feature (1)..( 7): Result.005 file - promoters50/4768804
ctaacac

SEQ ID NO: 190154 - DNA, 7 bp, Unknown
  misc_feature (1)..( 7): Result.005 file - promoters50/4768804
gtaacaa

SEQ ID NO: 190155 - DNA, 7 bp, Unknown
  misc_feature (1)..( 7): Result.005 file - promoters50/4768804
gtaacat

SEQ ID NO: 190156 - DNA, 7 bp, Unknown
  misc_feature (1)..( 7): Result.005 file - promoters50/4768804
tattata

SEQ ID NO: 190157 - DNA, 7 bp, Unknown
  misc_feature (1)..( 7): Result.005 file - promoters50/4768804
aattata

SEQ ID NO: 190158 - DNA, 7 bp, Unknown
  misc_feature (1)..( 7): Result.005 file - promoters50/4768804
aatgata

SEQ ID NO: 190159 - DNA, 9 bp, Unknown
  misc_feature (1)..( 9): Result.005 file - promoters50/4768811
ataaataag

SEQ ID NO: 190160 - DNA, 9 bp, Unknown
  misc_feature (1)..( 9): Result.005 file - promoters50/4768811
ttaattaat

SEQ ID NO: 190161 - DNA, 9 bp, Unknown
  misc_feature (1)..( 9): Result.005 file - promoters50/4768811
gtatatata

SEQ ID NO: 190162 - DNA, 9 bp, Unknown
  misc_feature (1)..( 9): Result.005 file - promoters50/4768811
gtatataac

SEQ ID NO: 190163 - DNA, 9 bp, Unknown
  misc_feature (1)..( 9): Result.005 file - promoters50/4768811
ctatatata

SEQ ID NO: 190164 - DNA, 9 bp, Unknown
  misc_feature (1)..( 9): Result.005 file - promoters50/4768811
ttatatatt

SEQ ID NO: 190165 - DNA, 10 bp, Unknown
  misc_feature (1)..( 10): Result.005 file - promoters50/4768829
taatgtctca

SEQ ID NO: 190166 - DNA, 10 bp, Unknown
  misc_feature (1)..( 10): Result.005 file - promoters50/4768829
atatgtctgc

SEQ ID NO: 190167 - DNA, 10 bp, Unknown
  misc_feature (1)..( 10): Result.005 file - promoters50/4768829
ttatttcttt

SEQ ID NO: 190168 - DNA, 10 bp, Unknown
  misc_feature (1)..( 10): Result.005 file - promoters50/4768829
ttattttgca

SEQ ID NO: 190169 - DNA, 10 bp, Unknown
  misc_feature (1)..( 10): Result.005 file - promoters50/4768829
ttaattcttt

SEQ ID NO: 190170 - DNA, 10 bp, Unknown
  misc_feature (1)..( 10): Result.005 file - promoters50/4768829
acattgattt

SEQ ID NO: 190171 - DNA, 11 bp, Unknown
  misc_feature (1)..( 11): Result.005 file - promoters50/4768829
tattttattac

SEQ ID NO: 190172 - DNA, 11 bp, Unknown
  misc_feature (1)..( 11): Result.005 file - promoters50/4768829
tatattattaa

SEQ ID NO: 190173 - DNA, 11 bp, Unknown
  misc_feature (1)..( 11): Result.005 file - promoters50/4768829
aattgtataac

SEQ ID NO: 190174 - DNA, 11 bp, Unknown
  misc_feature (1)..( 11): Result.005 file - promoters50/4768829
tcaagtattaa

SEQ ID NO: 190175 - DNA, 11 bp, Unknown
  misc_feature (1)..( 11): Result.005 file - promoters50/4768829
tatattgttta

SEQ ID NO: 190176 - DNA, 11 bp, Unknown
  misc_feature (1)..( 11): Result.005 file - promoters50/4768829
tgttgtatgtg

SEQ ID NO: 190177 - DNA, 13 bp, Unknown
  misc_feature (1)..( 13): Result.005 file - promoters50/4768829
aaacaaatgtttg

SEQ ID NO: 190178 - DNA, 13 bp, Unknown
  misc_feature (1)..( 13): Result.005 file - promoters50/4768829
aaataaatttttg

SEQ ID NO: 190179 - DNA, 13 bp, Unknown
  misc_feature (1)..( 13): Result.005 file - promoters50/4768829
aaataaatttttt

SEQ ID NO: 190180 - DNA, 13 bp, Unknown
  misc_feature (1)..( 13): Result.005 file - promoters50/4768829
aaaaaaagaagaa

SEQ ID NO: 190181 - DNA, 13 bp, Unknown
  misc_feature (1)..( 13): Result.005 file - promoters50/4768829
taactgatttttc

SEQ ID NO: 190182 - DNA, 13 bp, Unknown
  misc_feature (1)..( 13): Result.005 file - promoters50/4768829
atatgtattttta

SEQ ID NO: 190183 - DNA, 9 bp, Unknown
  misc_feature (1)..( 9): Result.005 file - promoters50/4768829
ttattatat

SEQ ID NO: 190184 - DNA, 9 bp, Unknown
  misc_feature (1)..( 9): Result.005 file - promoters50/4768829
atattatta

SEQ ID NO: 190185 - DNA, 9 bp, Unknown
  misc_feature (1)..( 9): Result.005 file - promoters50/4768829
ttattatgt

SEQ ID NO: 190186 - DNA, 9 bp, Unknown
  misc_feature (1)..( 9): Result.005 file - promoters50/4768829
gtattttta

SEQ ID NO: 190187 - DNA, 9 bp, Unknown
  misc_feature (1)..( 9): Result.005 file - promoters50/4768829
atataatta

SEQ ID NO: 190188 - DNA, 10 bp, Unknown
  misc_feature (1)..( 10): Result.005 file - promoters50/4768829
aaatgaattt

SEQ ID NO: 190189 - DNA, 12 bp, Unknown
  misc_feature (1)..( 12): Result.005 file - promoters50/4768829
tttgtctttgtt

SEQ ID NO: 190190 - DNA, 12 bp, Unknown
  misc_feature (1)..( 12): Result.005 file - promoters50/4768829
tatgtattttta

SEQ ID NO: 190191 - DNA, 12 bp, Unknown
  misc_feature (1)..( 12): Result.005 file - promoters50/4768829
aaaatattatta

SEQ ID NO: 190192 - DNA, 12 bp, Unknown
  misc_feature (1)..( 12): Result.005 file - promoters50/4768829
gatttattatgt

SEQ ID NO: 190193 - DNA, 12 bp, Unknown
  misc_feature (1)..( 12): Result.005 file - promoters50/4768829
atataattattt

SEQ ID NO: 190194 - DNA, 12 bp, Unknown
  misc_feature (1)..( 12): Result.005 file - promoters50/4768829
aatgaatttaga

SEQ ID NO: 190195 - DNA, 9 bp, Unknown
  misc_feature (1)..( 9): Result.005 file - promoters50/4768833
gcaaccaat

SEQ ID NO: 190196 - DNA, 9 bp, Unknown
  misc_feature (1)..( 9): Result.005 file - promoters50/4768833
gcaacaaat

SEQ ID NO: 190197 - DNA, 9 bp, Unknown
  misc_feature (1)..( 9): Result.005 file - promoters50/4768833
tttacaaat

SEQ ID NO: 190198 - DNA, 11 bp, Unknown
  misc_feature (1)..( 11): Result.005 file - promoters50/4768833
ccaaaacaaat

SEQ ID NO: 190199 - DNA, 11 bp, Unknown
  misc_feature (1)..( 11): Result.005 file - promoters50/4768833
aaaaaacaaaa

SEQ ID NO: 190200 - DNA, 12 bp, Unknown
  misc_feature (1)..( 12): Result.005 file - promoters50/4768833
ttacaacgaaaa

SEQ ID NO: 190201 - DNA, 12 bp, Unknown
  misc_feature (1)..( 12): Result.005 file - promoters50/4768833
aaaaaaccgtat

SEQ ID NO: 190202 - DNA, 7 bp, Unknown
  misc_feature (1)..( 7): Result.005 file - promoters50/4768833
aaaaaat

SEQ ID NO: 190203 - DNA, 7 bp, Unknown
  misc_feature (1)..( 7): Result.005 file - promoters50/4768833
aaacaat

SEQ ID NO: 190204 - DNA, 7 bp, Unknown
  misc_feature (1)..( 7): Result.005 file - promoters50/4768833
aaaaaaa

SEQ ID NO: 190205 - DNA, 8 bp, Unknown
  misc_feature (1)..( 8): Result.005 file - promoters50/4768848
aattaaat

SEQ ID NO: 190206 - DNA, 8 bp, Unknown
  misc_feature (1)..( 8): Result.005 file - promoters50/4768848
cattaaaa

SEQ ID NO: 190207 - DNA, 9 bp, Unknown
  misc_feature (1)..( 9): Result.005 file - promoters50/4768848
ctttataat

SEQ ID NO: 190208 - DNA, 9 bp, Unknown
  misc_feature (1)..( 9): Result.005 file - promoters50/4768848
acttcatag

SEQ ID NO: 190209 - DNA, 9 bp, Unknown
  misc_feature (1)..( 9): Result.005 file - promoters50/4768848
tggaaaata

SEQ ID NO: 190210 - DNA, 9 bp, Unknown
  misc_feature (1)..( 9): Result.005 file - promoters50/4768848
tggaaaatg

SEQ ID NO: 190211 - DNA, 9 bp, Unknown
  misc_feature (1)..( 9): Result.005 file - promoters50/4768848
cgtaaaata

SEQ ID NO: 190212 - DNA, 9 bp, Unknown
  misc_feature (1)..( 9): Result.005 file - promoters50/4768848
ttcaaaatg

SEQ ID NO: 190213 - DNA, 9 bp, Unknown
  misc_feature (1)..( 9): Result.005 file - promoters50/4768852
aaacaaaaa

SEQ ID NO: 190214 - DNA, 9 bp, Unknown
  misc_feature (1)..( 9): Result.005 file - promoters50/4768852
aaagaaaaa

SEQ ID NO: 190215 - DNA, 9 bp, Unknown
  misc_feature (1)..( 9): Result.005 file - promoters50/4768852
ccacaaaat

SEQ ID NO: 190216 - DNA, 9 bp, Unknown
  misc_feature (1)..( 9): Result.005 file - promoters50/4768852
agagagatt

SEQ ID NO: 190217 - DNA, 7 bp, Unknown
  misc_feature (1)..( 7): Result.005 file - promoters50/4768852
gtttaag

SEQ ID NO: 190218 - DNA, 7 bp, Unknown
  misc_feature (1)..( 7): Result.005 file - promoters50/4768852
gtttaaa

SEQ ID NO: 190219 - DNA, 7 bp, Unknown
  misc_feature (1)..( 7): Result.005 file - promoters50/4768852
ttttaaa

SEQ ID NO: 190220 - DNA, 12 bp, Unknown
  misc_feature (1)..( 12): Result.005 file - promoters50/4768852
aaattttagagt

SEQ ID NO: 190221 - DNA, 12 bp, Unknown
  misc_feature (1)..( 12): Result.005 file - promoters50/4768852
aaaatttatgca

SEQ ID NO: 190222 - DNA, 12 bp, Unknown
  misc_feature (1)..( 12): Result.005 file - promoters50/4768852
atcattaatgca

SEQ ID NO: 190223 - DNA, 14 bp, Unknown
  misc_feature (1)..( 14): Result.005 file - promoters50/4768852
ttaatttatgacca

SEQ ID NO: 190224 - DNA, 14 bp, Unknown
  misc_feature (1)..( 14): Result.005 file - promoters50/4768852
acaatttataacca

SEQ ID NO: 190225 - DNA, 14 bp, Unknown
  misc_feature (1)..( 14): Result.005 file - promoters50/4768852
acaagttagatata

SEQ ID NO: 190226 - DNA, 11 bp, Unknown
  misc_feature (1)..( 11): Result.005 file - promoters50/4768852
tctctataaaa

SEQ ID NO: 190227 - DNA, 11 bp, Unknown
  misc_feature (1)..( 11): Result.005 file - promoters50/4768852
agtcaataaaa

SEQ ID NO: 190228 - DNA, 11 bp, Unknown
  misc_feature (1)..( 11): Result.005 file - promoters50/4768852
tctatataaac

SEQ ID NO: 190229 - DNA, 14 bp, Unknown
  misc_feature (1)..( 14): Result.005 file - promoters50/4768856
tatacattatatag

SEQ ID NO: 190230 - DNA, 14 bp, Unknown
  misc_feature (1)..( 14): Result.005 file - promoters50/4768856
cataaattacaaat

SEQ ID NO: 190231 - DNA, 14 bp, Unknown
  misc_feature (1)..( 14): Result.005 file - promoters50/4768856
cataaatgtatcct

SEQ ID NO: 190232 - DNA, 14 bp, Unknown
  misc_feature (1)..( 14): Result.005 file - promoters50/4768856
catatatgtctgcg

SEQ ID NO: 190233 - DNA, 14 bp, Unknown
  misc_feature (1)..( 14): Result.005 file - promoters50/4768856
ggcaaattaaaaat

SEQ ID NO: 190234 - DNA, 14 bp, Unknown
  misc_feature (1)..( 14): Result.005 file - promoters50/4768856
attcaattaacttc

SEQ ID NO: 190235 - DNA, 11 bp, Unknown
  misc_feature (1)..( 11): Result.005 file - promoters50/4768856
cagtaaataat

SEQ ID NO: 190236 - DNA, 11 bp, Unknown
  misc_feature (1)..( 11): Result.005 file - promoters50/4768856
acgtaattaaa

SEQ ID NO: 190237 - DNA, 11 bp, Unknown
  misc_feature (1)..( 11): Result.005 file - promoters50/4768856
tagtaaaaacg

SEQ ID NO: 190238 - DNA, 11 bp, Unknown
  misc_feature (1)..( 11): Result.005 file - promoters50/4768856
taataaaaaaa

SEQ ID NO: 190239 - DNA, 11 bp, Unknown
  misc_feature (1)..( 11): Result.005 file - promoters50/4768856
acataaaatct

SEQ ID NO: 190240 - DNA, 11 bp, Unknown
  misc_feature (1)..( 11): Result.005 file - promoters50/4768856
gagtaacaacg

SEQ ID NO: 190241 - DNA, 8 bp, Unknown
  misc_feature (1)..( 8): Result.005 file - promoters50/4768860
acagtgaa

SEQ ID NO: 190242 - DNA, 8 bp, Unknown
  misc_feature (1)..( 8): Result.005 file - promoters50/4768860
acattgaa

SEQ ID NO: 190243 - DNA, 8 bp, Unknown
  misc_feature (1)..( 8): Result.005 file - promoters50/4768860
atattgaa

SEQ ID NO: 190244 - DNA, 8 bp, Unknown
  misc_feature (1)..( 8): Result.005 file - promoters50/4768864
aaggagct

SEQ ID NO: 190245 - DNA, 8 bp, Unknown
  misc_feature (1)..( 8): Result.005 file - promoters50/4768864
aaggagaa

SEQ ID NO: 190246 - DNA, 8 bp, Unknown
  misc_feature (1)..( 8): Result.005 file - promoters50/4768864
gaggagaa

SEQ ID NO: 190247 - DNA, 8 bp, Unknown
  misc_feature (1)..( 8): Result.005 file - promoters50/4768864
ttaatttg

SEQ ID NO: 190248 - DNA, 8 bp, Unknown
  misc_feature (1)..( 8): Result.005 file - promoters50/4768864
cgaatttg

SEQ ID NO: 190249 - DNA, 8 bp, Unknown
  misc_feature (1)..( 8): Result.005 file - promoters50/4768864
ttaatttc

SEQ ID NO: 190250 - DNA, 16 bp, Unknown
  misc_feature (1)..( 16): Result.005 file - promoters50/4768864
aagataaaataatttg

SEQ ID NO: 190251 - DNA, 16 bp, Unknown
  misc_feature (1)..( 16): Result.005 file - promoters50/4768864
taaataaaaatcccaa

SEQ ID NO: 190252 - DNA, 16 bp, Unknown
  misc_feature (1)..( 16): Result.005 file - promoters50/4768864
aaaagaaaaaaacaac

SEQ ID NO: 190253 - DNA, 16 bp, Unknown
  misc_feature (1)..( 16): Result.005 file - promoters50/4768864
aaaagaaaaattccaa

SEQ ID NO: 190254 - DNA, 15 bp, Unknown
  misc_feature (1)..( 15): Result.005 file - promoters50/4768864
aaataatttgcatag

SEQ ID NO: 190255 - DNA, 15 bp, Unknown
  misc_feature (1)..( 15): Result.005 file - promoters50/4768864
aaataaaaatcccaa

SEQ ID NO: 190256 - DNA, 15 bp, Unknown
  misc_feature (1)..( 15): Result.005 file - promoters50/4768864
gaataaaaaagaaaa

SEQ ID NO: 190257 - DNA, 15 bp, Unknown
  misc_feature (1)..( 15): Result.005 file - promoters50/4768864
aaagaaaaattccaa

SEQ ID NO: 190258 - DNA, 10 bp, Unknown
  misc_feature (1)..( 10): Result.005 file - promoters50/4768864
aaacgttgat

SEQ ID NO: 190259 - DNA, 10 bp, Unknown
  misc_feature (1)..( 10): Result.005 file - promoters50/4768864
tgacgatgat

SEQ ID NO: 190260 - DNA, 10 bp, Unknown
  misc_feature (1)..( 10): Result.005 file - promoters50/4768864
tgatgatgag

SEQ ID NO: 190261 - DNA, 7 bp, Unknown
  misc_feature (1)..( 7): Result.005 file - promoters50/4768864
ataaaaa

SEQ ID NO: 190262 - DNA, 7 bp, Unknown
  misc_feature (1)..( 7): Result.005 file - promoters50/4768864
ttaaaaa

SEQ ID NO: 190263 - DNA, 7 bp, Unknown
  misc_feature (1)..( 7): Result.005 file - promoters50/4768864
ttaaaat

SEQ ID NO: 190264 - DNA, 15 bp, Unknown
  misc_feature (1)..( 15): Result.005 file - promoters50/4768864
taggaaaagataaaa

SEQ ID NO: 190265 - DNA, 15 bp, Unknown
  misc_feature (1)..( 15): Result.005 file - promoters50/4768864
agaaaaaagaaaaat

SEQ ID NO: 190266 - DNA, 15 bp, Unknown
  misc_feature (1)..( 15): Result.005 file - promoters50/4768864
aaataaaaatcccaa

SEQ ID NO: 190267 - DNA, 9 bp, Unknown
  misc_feature (1)..( 9): Result.005 file - promoters50/4768864
tcgaattct

SEQ ID NO: 190268 - DNA, 9 bp, Unknown
  misc_feature (1)..( 9): Result.005 file - promoters50/4768864
ttgaattct

SEQ ID NO: 190269 - DNA, 9 bp, Unknown
  misc_feature (1)..( 9): Result.005 file - promoters50/4768864
ttgaattag

SEQ ID NO: 190270 - DNA, 14 bp, Unknown
  misc_feature (1)..( 14): Result.005 file - promoters50/4768864
tcccaaaaaaaaca

SEQ ID NO: 190271 - DNA, 14 bp, Unknown
  misc_feature (1)..( 14): Result.005 file - promoters50/4768864
agaaaaaaacaaca

SEQ ID NO: 190272 - DNA, 14 bp, Unknown
  misc_feature (1)..( 14): Result.005 file - promoters50/4768864
caagaaaaaaaaaa

SEQ ID NO: 190273 - DNA, 7 bp, Unknown
  misc_feature (1)..( 7): Result.005 file - promoters50/4768880
cttctct

SEQ ID NO: 190274 - DNA, 7 bp, Unknown
  misc_feature (1)..( 7): Result.005 file - promoters50/4768880
gttctct

SEQ ID NO: 190275 - DNA, 7 bp, Unknown
  misc_feature (1)..( 7): Result.005 file - promoters50/4768880
cttctca

SEQ ID NO: 190276 - DNA, 8 bp, Unknown
  misc_feature (1)..( 8): Result.005 file - promoters50/4768928
aaagaaaa

SEQ ID NO: 190277 - DNA, 8 bp, Unknown
  misc_feature (1)..( 8): Result.005 file - promoters50/4768928
aaacaaaa

SEQ ID NO: 190278 - DNA, 8 bp, Unknown
  misc_feature (1)..( 8): Result.005 file - promoters50/4768928
aaagaaag

SEQ ID NO: 190279 - DNA, 7 bp, Unknown
  misc_feature (1)..( 7): Result.005 file - promoters50/4769032
agagagg

SEQ ID NO: 190280 - DNA, 7 bp, Unknown
  misc_feature (1)..( 7): Result.005 file - promoters50/4769032
tgagagg

SEQ ID NO: 190281 - DNA, 7 bp, Unknown
  misc_feature (1)..( 7): Result.005 file - promoters50/4769032
tgagaga

SEQ ID NO: 190282 - DNA, 10 bp, Unknown
  misc_feature (1)..( 10): Result.005 file - promoters50/4769032
acacataatt

SEQ ID NO: 190283 - DNA, 10 bp, Unknown
  misc_feature (1)..( 10): Result.005 file - promoters50/4769032
acacctaatt

SEQ ID NO: 190284 - DNA, 10 bp, Unknown
  misc_feature (1)..( 10): Result.005 file - promoters50/4769032
ttaccaaatg

SEQ ID NO: 190285 - DNA, 14 bp, Unknown
  misc_feature (1)..( 14): Result.005 file - promoters50/4769032
agcgaaaaaaagaa

SEQ ID NO: 190286 - DNA, 14 bp, Unknown
  misc_feature (1)..( 14): Result.005 file - promoters50/4769032
aattaaaaaagggt

SEQ ID NO: 190287 - DNA, 14 bp, Unknown
  misc_feature (1)..( 14): Result.005 file - promoters50/4769032
aaagaaaaaaaaga

SEQ ID NO: 190288 - DNA, 9 bp, Unknown
  misc_feature (1)..( 9): Result.005 file - promoters50/4769032
agtcaaaaa

SEQ ID NO: 190289 - DNA, 9 bp, Unknown
  misc_feature (1)..( 9): Result.005 file - promoters50/4769032
ggtcaaatc

SEQ ID NO: 190290 - DNA, 9 bp, Unknown
  misc_feature (1)..( 9): Result.005 file - promoters50/4769032
agtcaaaaa

SEQ ID NO: 190291 - DNA, 9 bp, Unknown
  misc_feature (1)..( 9): Result.005 file - promoters50/4769032
tctcaaaaa

SEQ ID NO: 190292 - DNA, 7 bp, Unknown
  misc_feature (1)..( 7): Result.005 file - promoters50/4769032
cgagaga

SEQ ID NO: 190293 - DNA, 7 bp, Unknown
  misc_feature (1)..( 7): Result.005 file - promoters50/4769032
tgagaga

SEQ ID NO: 190294 - DNA, 7 bp, Unknown
  misc_feature (1)..( 7): Result.005 file - promoters50/4769032
tgagagg

SEQ ID NO: 190295 - DNA, 8 bp, Unknown
  misc_feature (1)..( 8): Result.005 file - promoters50/4769048
aaatttca

SEQ ID NO: 190296 - DNA, 8 bp, Unknown
  misc_feature (1)..( 8): Result.005 file - promoters50/4769048
aaatttgg

SEQ ID NO: 190297 - DNA, 8 bp, Unknown
  misc_feature (1)..( 8): Result.005 file - promoters50/4769048
gaatttgg

SEQ ID NO: 190298 - DNA, 7 bp, Unknown
  misc_feature (1)..( 7): Result.005 file - promoters50/4769048
aatttgg

SEQ ID NO: 190299 - DNA, 7 bp, Unknown
  misc_feature (1)..( 7): Result.005 file - promoters50/4769048
aatttgg

SEQ ID NO: 190300 - DNA, 7 bp, Unknown
  misc_feature (1)..( 7): Result.005 file - promoters50/4769048
aatttgg

SEQ ID NO: 190301 - DNA, 12 bp, Unknown
  misc_feature (1)..( 12): Result.005 file - promoters50/4769055
gaaagttaaatt

SEQ ID NO: 190302 - DNA, 12 bp, Unknown
  misc_feature (1)..( 12): Result.005 file - promoters50/4769055
gaaggttttatg

SEQ ID NO: 190303 - DNA, 12 bp, Unknown
  misc_feature (1)..( 12): Result.005 file - promoters50/4769055
caaaattaaggg

SEQ ID NO: 190304 - DNA, 12 bp, Unknown
  misc_feature (1)..( 12): Result.005 file - promoters50/4769055
aaaatttataat

SEQ ID NO: 190305 - DNA, 13 bp, Unknown
  misc_feature (1)..( 13): Result.005 file - promoters50/4769055
aaaatatttgtaa

SEQ ID NO: 190306 - DNA, 13 bp, Unknown
  misc_feature (1)..( 13): Result.005 file - promoters50/4769055
ataaaattaacta

SEQ ID NO: 190307 - DNA, 13 bp, Unknown
  misc_feature (1)..( 13): Result.005 file - promoters50/4769055
ttctcgtttataa

SEQ ID NO: 190308 - DNA, 13 bp, Unknown
  misc_feature (1)..( 13): Result.005 file - promoters50/4769055
tttaaattatacc

SEQ ID NO: 190309 - DNA, 13 bp, Unknown
  misc_feature (1)..( 13): Result.005 file - promoters50/4769055
tttcaattttctc

SEQ ID NO: 190310 - DNA, 13 bp, Unknown
  misc_feature (1)..( 13): Result.005 file - promoters50/4769055
ataaaatatttgt

SEQ ID NO: 190311 - DNA, 14 bp, Unknown
  misc_feature (1)..( 14): Result.005 file - promoters50/4769055
cataaaattaacta

SEQ ID NO: 190312 - DNA, 13 bp, Unknown
  misc_feature (1)..( 13): Result.005 file - promoters50/4769055
taaaaatttataa

SEQ ID NO: 190313 - DNA, 14 bp, Unknown
  misc_feature (1)..( 14): Result.005 file - promoters50/4769055
tttataatcatagg

SEQ ID NO: 190314 - DNA, 18 bp, Unknown
  misc_feature (1)..( 18): Result.005 file - promoters50/4769055
ccgaaaagcaaaaccaag

SEQ ID NO: 190315 - DNA, 18 bp, Unknown
  misc_feature (1)..( 18): Result.005 file - promoters50/4769055
tggaagagcaaaacataa

SEQ ID NO: 190316 - DNA, 18 bp, Unknown
  misc_feature (1)..( 18): Result.005 file - promoters50/4769055
accggaatcaaaacaaat

SEQ ID NO: 190317 - DNA, 18 bp, Unknown
  misc_feature (1)..( 18): Result.005 file - promoters50/4769055
ccgaaaacactgtcaatg

SEQ ID NO: 190318 - DNA, 18 bp, Unknown
  misc_feature (1)..( 18): Result.005 file - promoters50/4769055
ataacaaacaatacataa

SEQ ID NO: 190319 - DNA, 18 bp, Unknown
  misc_feature (1)..( 18): Result.005 file - promoters50/4769055
ttgatatacaaaaaaaaa

SEQ ID NO: 190320 - DNA, 12 bp, Unknown
  misc_feature (1)..( 12): Result.005 file - promoters50/4769059
ctatctctttat

SEQ ID NO: 190321 - DNA, 12 bp, Unknown
  misc_feature (1)..( 12): Result.005 file - promoters50/4769059
ttatatctgtat

SEQ ID NO: 190322 - DNA, 12 bp, Unknown
  misc_feature (1)..( 12): Result.005 file - promoters50/4769059
ctagctcgcgtc

SEQ ID NO: 190323 - DNA, 12 bp, Unknown
  misc_feature (1)..( 12): Result.005 file - promoters50/4769059
ttagatcgtacc

SEQ ID NO: 190324 - DNA, 9 bp, Unknown
  misc_feature (1)..( 9): Result.005 file - promoters50/4769075
ttttgattt

SEQ ID NO: 190325 - DNA, 9 bp, Unknown
  misc_feature (1)..( 9): Result.005 file - promoters50/4769075
aggtgattt

SEQ ID NO: 190326 - DNA, 9 bp, Unknown
  misc_feature (1)..( 9): Result.005 file - promoters50/4769075
tttggattt

SEQ ID NO: 190327 - DNA, 13 bp, Unknown
  misc_feature (1)..( 13): Result.005 file - promoters50/4769075
aaactttacattc

SEQ ID NO: 190328 - DNA, 13 bp, Unknown
  misc_feature (1)..( 13): Result.005 file - promoters50/4769075
acactatactgta

SEQ ID NO: 190329 - DNA, 13 bp, Unknown
  misc_feature (1)..( 13): Result.005 file - promoters50/4769075
caactctattctg

SEQ ID NO: 190330 - DNA, 9 bp, Unknown
  misc_feature (1)..( 9): Result.005 file - promoters50/4769083
ttaatttat

SEQ ID NO: 190331 - DNA, 9 bp, Unknown
  misc_feature (1)..( 9): Result.005 file - promoters50/4769083
ttatttttg

SEQ ID NO: 190332 - DNA, 9 bp, Unknown
  misc_feature (1)..( 9): Result.005 file - promoters50/4769083
taaatttat

SEQ ID NO: 190333 - DNA, 7 bp, Unknown
  misc_feature (1)..( 7): Result.005 file - promoters50/4769083
aatttat

SEQ ID NO: 190334 - DNA, 7 bp, Unknown
  misc_feature (1)..( 7): Result.005 file - promoters50/4769083
catttat

SEQ ID NO: 190335 - DNA, 7 bp, Unknown
  misc_feature (1)..( 7): Result.005 file - promoters50/4769083
aatttat

SEQ ID NO: 190336 - DNA, 7 bp, Unknown
  misc_feature (1)..( 7): Result.005 file - promoters50/4769083
taaaata

SEQ ID NO: 190337 - DNA, 7 bp, Unknown
  misc_feature (1)..( 7): Result.005 file - promoters50/4769083
aaaaata

SEQ ID NO: 190338 - DNA, 7 bp, Unknown
  misc_feature (1)..( 7): Result.005 file - promoters50/4769083
taaaatg

SEQ ID NO: 190339 - DNA, 9 bp, Unknown
  misc_feature (1)..( 9): Result.005 file - promoters50/4769083
taaagaaaa

SEQ ID NO: 190340 - DNA, 9 bp, Unknown
  misc_feature (1)..( 9): Result.005 file - promoters50/4769083
taaagaaaa

SEQ ID NO: 190341 - DNA, 9 bp, Unknown
  misc_feature (1)..( 9): Result.005 file - promoters50/4769083
aaaagtaaa

SEQ ID NO: 190342 - DNA, 8 bp, Unknown
  misc_feature (1)..( 8): Result.005 file - promoters50/4769083
aaaataaa

SEQ ID NO: 190343 - DNA, 8 bp, Unknown
  misc_feature (1)..( 8): Result.005 file - promoters50/4769083
aaattaaa

SEQ ID NO: 190344 - DNA, 8 bp, Unknown
  misc_feature (1)..( 8): Result.005 file - promoters50/4769083
aaagtaaa

SEQ ID NO: 190345 - DNA, 8 bp, Unknown
  misc_feature (1)..( 8): Result.005 file - promoters50/4769083
ctacaaat

SEQ ID NO: 190346 - DNA, 8 bp, Unknown
  misc_feature (1)..( 8): Result.005 file - promoters50/4769083
ctaaaaat

SEQ ID NO: 190347 - DNA, 8 bp, Unknown
  misc_feature (1)..( 8): Result.005 file - promoters50/4769083
ataaaaaa

SEQ ID NO: 190348 - DNA, 7 bp, Unknown
  misc_feature (1)..( 7): Result.005 file - promoters50/4769087
ggaaaat

SEQ ID NO: 190349 - DNA, 7 bp, Unknown
  misc_feature (1)..( 7): Result.005 file - promoters50/4769087
agaaaat

SEQ ID NO: 190350 - DNA, 7 bp, Unknown
  misc_feature (1)..( 7): Result.005 file - promoters50/4769087
agaaaac

SEQ ID NO: 190351 - DNA, 7 bp, Unknown
  misc_feature (1)..( 7): Result.005 file - promoters50/4769087
tccaaaa

SEQ ID NO: 190352 - DNA, 7 bp, Unknown
  misc_feature (1)..( 7): Result.005 file - promoters50/4769087
cccaaaa

SEQ ID NO: 190353 - DNA, 7 bp, Unknown
  misc_feature (1)..( 7): Result.005 file - promoters50/4769087
tccaaaa

SEQ ID NO: 190354 - DNA, 8 bp, Unknown
  misc_feature (1)..( 8): Result.005 file - promoters50/4769087
aaaatttc

SEQ ID NO: 190355 - DNA, 8 bp, Unknown
  misc_feature (1)..( 8): Result.005 file - promoters50/4769087
aaaatttc

SEQ ID NO: 190356 - DNA, 8 bp, Unknown
  misc_feature (1)..( 8): Result.005 file - promoters50/4769087
aaaattga

SEQ ID NO: 190357 - DNA, 8 bp, Unknown
  misc_feature (1)..( 8): Result.005 file - promoters50/4769087
ttttgaac

SEQ ID NO: 190358 - DNA, 8 bp, Unknown
  misc_feature (1)..( 8): Result.005 file - promoters50/4769087
ttttgact

SEQ ID NO: 190359 - DNA, 8 bp, Unknown
  misc_feature (1)..( 8): Result.005 file - promoters50/4769087
tttttaac

SEQ ID NO: 190360 - DNA, 9 bp, Unknown
  misc_feature (1)..( 9): Result.005 file - promoters50/4769096
tgttttagt

SEQ ID NO: 190361 - DNA, 9 bp, Unknown
  misc_feature (1)..( 9): Result.005 file - promoters50/4769096
tctttcagt

SEQ ID NO: 190362 - DNA, 9 bp, Unknown
  misc_feature (1)..( 9): Result.005 file - promoters50/4769096
tctctcacg

SEQ ID NO: 190363 - DNA, 9 bp, Unknown
  misc_feature (1)..( 9): Result.005 file - promoters50/4769107
aaaaacaat

SEQ ID NO: 190364 - DNA, 9 bp, Unknown
  misc_feature (1)..( 9): Result.005 file - promoters50/4769107
ataaacaaa

SEQ ID NO: 190365 - DNA, 9 bp, Unknown
  misc_feature (1)..( 9): Result.005 file - promoters50/4769107
aaaaacaaa

SEQ ID NO: 190366 - DNA, 9 bp, Unknown
  misc_feature (1)..( 9): Result.005 file - promoters50/4769107
tcatacaca

SEQ ID NO: 190367 - DNA, 8 bp, Unknown
  misc_feature (1)..( 8): Result.005 file - promoters50/4769107
caattaac

SEQ ID NO: 190368 - DNA, 8 bp, Unknown
  misc_feature (1)..( 8): Result.005 file - promoters50/4769107
gaataaac

SEQ ID NO: 190369 - DNA, 8 bp, Unknown
  misc_feature (1)..( 8): Result.005 file - promoters50/4769107
caattatg

SEQ ID NO: 190370 - DNA, 9 bp, Unknown
  misc_feature (1)..( 9): Result.005 file - promoters50/4769107
ttcttttat

SEQ ID NO: 190371 - DNA, 9 bp, Unknown
  misc_feature (1)..( 9): Result.005 file - promoters50/4769107
ttctttttt

SEQ ID NO: 190372 - DNA, 9 bp, Unknown
  misc_feature (1)..( 9): Result.005 file - promoters50/4769107
ttctttttt

SEQ ID NO: 190373 - DNA, 10 bp, Unknown
  misc_feature (1)..( 10): Result.005 file - promoters50/4769107
cttttatcat

SEQ ID NO: 190374 - DNA, 10 bp, Unknown
  misc_feature (1)..( 10): Result.005 file - promoters50/4769107
tttttatatt

SEQ ID NO: 190375 - DNA, 11 bp, Unknown
  misc_feature (1)..( 11): Result.005 file - promoters50/4769107
gtttctatatt

SEQ ID NO: 190376 - DNA, 11 bp, Unknown
  misc_feature (1)..( 11): Result.005 file - promoters50/4769107
ttttttatagc

SEQ ID NO: 190377 - DNA, 9 bp, Unknown
  misc_feature (1)..( 9): Result.005 file - promoters50/4769107
ttttaaaaa

SEQ ID NO: 190378 - DNA, 9 bp, Unknown
  misc_feature (1)..( 9): Result.005 file - promoters50/4769107
ctttacaaa

SEQ ID NO: 190379 - DNA, 9 bp, Unknown
  misc_feature (1)..( 9): Result.005 file - promoters50/4769107
ttttaaagc

SEQ ID NO: 190380 - DNA, 9 bp, Unknown
  misc_feature (1)..( 9): Result.005 file - promoters50/4769107
ttttttttc

SEQ ID NO: 190381 - DNA, 9 bp, Unknown
  misc_feature (1)..( 9): Result.005 file - promoters50/4769107
tttgttttc

SEQ ID NO: 190382 - DNA, 9 bp, Unknown
  misc_feature (1)..( 9): Result.005 file - promoters50/4769107
tttattttt

SEQ ID NO: 190383 - DNA, 8 bp, Unknown
  misc_feature (1)..( 8): Result.005 file - promoters50/4769107
aaaaatga

SEQ ID NO: 190384 - DNA, 8 bp, Unknown
  misc_feature (1)..( 8): Result.005 file - promoters50/4769107
gaaaatga

SEQ ID NO: 190385 - DNA, 8 bp, Unknown
  misc_feature (1)..( 8): Result.005 file - promoters50/4769107
gaaaataa

SEQ ID NO: 190386 - DNA, 8 bp, Unknown
  misc_feature (1)..( 8): Result.005 file - promoters50/4769107
aaataaat

SEQ ID NO: 190387 - DNA, 8 bp, Unknown
  misc_feature (1)..( 8): Result.005 file - promoters50/4769107
aaatcaat

SEQ ID NO: 190388 - DNA, 8 bp, Unknown
  misc_feature (1)..( 8): Result.005 file - promoters50/4769107
ggatcaat

SEQ ID NO: 190389 - DNA, 9 bp, Unknown
  misc_feature (1)..( 9): Result.005 file - promoters50/4769107
atttttaaa

SEQ ID NO: 190390 - DNA, 9 bp, Unknown
  misc_feature (1)..( 9): Result.005 file - promoters50/4769107
ttttttata

SEQ ID NO: 190391 - DNA, 9 bp, Unknown
  misc_feature (1)..( 9): Result.005 file - promoters50/4769107
ttttttata

SEQ ID NO: 190392 - DNA, 7 bp, Unknown
  misc_feature (1)..( 7): Result.005 file - promoters50/4769107
acaaaat

SEQ ID NO: 190393 - DNA, 7 bp, Unknown
  misc_feature (1)..( 7): Result.005 file - promoters50/4769107
acaaaat

SEQ ID NO: 190394 - DNA, 7 bp, Unknown
  misc_feature (1)..( 7): Result.005 file - promoters50/4769107
acaaaaa

SEQ ID NO: 190395 - DNA, 9 bp, Unknown
  misc_feature (1)..( 9): Result.005 file - promoters50/4769127
aaagttttc

SEQ ID NO: 190396 - DNA, 9 bp, Unknown
  misc_feature (1)..( 9): Result.005 file - promoters50/4769127
tgagtattc

SEQ ID NO: 190397 - DNA, 9 bp, Unknown
  misc_feature (1)..( 9): Result.005 file - promoters50/4769127
aaacttttt

SEQ ID NO: 190398 - DNA, 7 bp, Unknown
  misc_feature (1)..( 7): Result.005 file - promoters50/4769127
atggaaa

SEQ ID NO: 190399 - DNA, 7 bp, Unknown
  misc_feature (1)..( 7): Result.005 file - promoters50/4769127
atggaat

SEQ ID NO: 190400 - DNA, 7 bp, Unknown
  misc_feature (1)..( 7): Result.005 file - promoters50/4769127
atgtaat

SEQ ID NO: 190401 - DNA, 10 bp, Unknown
  misc_feature (1)..( 10): Result.005 file - promoters50/4769127
atcataaaaa

SEQ ID NO: 190402 - DNA, 10 bp, Unknown
  misc_feature (1)..( 10): Result.005 file - promoters50/4769127
gtcaaaaaaa

SEQ ID NO: 190403 - DNA, 10 bp, Unknown
  misc_feature (1)..( 10): Result.005 file - promoters50/4769127
gtcaaatcct

SEQ ID NO: 190404 - DNA, 9 bp, Unknown
  misc_feature (1)..( 9): Result.005 file - promoters50/4769127
attacaaaa

SEQ ID NO: 190405 - DNA, 9 bp, Unknown
  misc_feature (1)..( 9): Result.005 file - promoters50/4769127
attaaaaaa

SEQ ID NO: 190406 - DNA, 9 bp, Unknown
  misc_feature (1)..( 9): Result.005 file - promoters50/4769127
aagaaaaaa

SEQ ID NO: 190407 - DNA, 12 bp, Unknown
  misc_feature (1)..( 12): Result.005 file - promoters50/4769137
ttttctttttat

SEQ ID NO: 190408 - DNA, 12 bp, Unknown
  misc_feature (1)..( 12): Result.005 file - promoters50/4769137
ttttctttttat

SEQ ID NO: 190409 - DNA, 12 bp, Unknown
  misc_feature (1)..( 12): Result.005 file - promoters50/4769137
tttactttgttt

SEQ ID NO: 190410 - DNA, 13 bp, Unknown
  misc_feature (1)..( 13): Result.005 file - promoters50/4769137
tttgtctatcaaa

SEQ ID NO: 190411 - DNA, 13 bp, Unknown
  misc_feature (1)..( 13): Result.005 file - promoters50/4769137
ctctacattgtct

SEQ ID NO: 190412 - DNA, 13 bp, Unknown
  misc_feature (1)..( 13): Result.005 file - promoters50/4769137
aactaaattggga

SEQ ID NO: 190413 - DNA, 10 bp, Unknown
  misc_feature (1)..( 10): Result.005 file - promoters50/4769137
catcatatga

SEQ ID NO: 190414 - DNA, 10 bp, Unknown
  misc_feature (1)..( 10): Result.005 file - promoters50/4769137
cttcacatgt

SEQ ID NO: 190415 - DNA, 10 bp, Unknown
  misc_feature (1)..( 10): Result.005 file - promoters50/4769137
cttaacactc

SEQ ID NO: 190416 - DNA, 10 bp, Unknown
  misc_feature (1)..( 10): Result.005 file - promoters50/4769137
ggaaacatgt

SEQ ID NO: 190417 - DNA, 10 bp, Unknown
  misc_feature (1)..( 10): Result.005 file - promoters50/4769137
gttcacagag

SEQ ID NO: 190418 - DNA, 10 bp, Unknown
  misc_feature (1)..( 10): Result.005 file - promoters50/4769137
gtttacaccc

SEQ ID NO: 190419 - DNA, 10 bp, Unknown
  misc_feature (1)..( 10): Result.005 file - promoters50/4769141
tctatataaa

SEQ ID NO: 190420 - DNA, 10 bp, Unknown
  misc_feature (1)..( 10): Result.005 file - promoters50/4769141
catatatatc

SEQ ID NO: 190421 - DNA, 10 bp, Unknown
  misc_feature (1)..( 10): Result.005 file - promoters50/4769141
tctatataat

SEQ ID NO: 190422 - DNA, 10 bp, Unknown
  misc_feature (1)..( 10): Result.005 file - promoters50/4769141
ccaatataaa

SEQ ID NO: 190423 - DNA, 10 bp, Unknown
  misc_feature (1)..( 10): Result.005 file - promoters50/4769141
ccaatataat

SEQ ID NO: 190424 - DNA, 10 bp, Unknown
  misc_feature (1)..( 10): Result.005 file - promoters50/4769141
gttatatata

SEQ ID NO: 190425 - DNA, 10 bp, Unknown
  misc_feature (1)..( 10): Result.005 file - promoters50/4769141
attatttaaa

SEQ ID NO: 190426 - DNA, 9 bp, Unknown
  misc_feature (1)..( 9): Result.005 file - promoters50/4769141
aaaaaaatg

SEQ ID NO: 190427 - DNA, 9 bp, Unknown
  misc_feature (1)..( 9): Result.005 file - promoters50/4769141
gaaaacatg

SEQ ID NO: 190428 - DNA, 9 bp, Unknown
  misc_feature (1)..( 9): Result.005 file - promoters50/4769141
ccaaaaatt

SEQ ID NO: 190429 - DNA, 9 bp, Unknown
  misc_feature (1)..( 9): Result.005 file - promoters50/4769141
taaataatg

SEQ ID NO: 190430 - DNA, 9 bp, Unknown
  misc_feature (1)..( 9): Result.005 file - promoters50/4769141
caaaagtta

SEQ ID NO: 190431 - DNA, 9 bp, Unknown
  misc_feature (1)..( 9): Result.005 file - promoters50/4769141
ctaaaattg

SEQ ID NO: 190432 - DNA, 11 bp, Unknown
  misc_feature (1)..( 11): Result.005 file - promoters50/4769141
ttagtaaaacc

SEQ ID NO: 190433 - DNA, 11 bp, Unknown
  misc_feature (1)..( 11): Result.005 file - promoters50/4769141
ttaataaaacg

SEQ ID NO: 190434 - DNA, 11 bp, Unknown
  misc_feature (1)..( 11): Result.005 file - promoters50/4769141
tgtgtagaacc

SEQ ID NO: 190435 - DNA, 11 bp, Unknown
  misc_feature (1)..( 11): Result.005 file - promoters50/4769141
gtggtaaaata

SEQ ID NO: 190436 - DNA, 11 bp, Unknown
  misc_feature (1)..( 11): Result.005 file - promoters50/4769141
ctaataaatag

SEQ ID NO: 190437 - DNA, 11 bp, Unknown
  misc_feature (1)..( 11): Result.005 file - promoters50/4769141
tcaataaaata

SEQ ID NO: 190438 - DNA, 11 bp, Unknown
  misc_feature (1)..( 11): Result.005 file - promoters50/4769141
tgtcttttagc

SEQ ID NO: 190439 - DNA, 11 bp, Unknown
  misc_feature (1)..( 11): Result.005 file - promoters50/4769141
tctcttttccg

SEQ ID NO: 190440 - DNA, 11 bp, Unknown
  misc_feature (1)..( 11): Result.005 file - promoters50/4769141
ctacttttaag

SEQ ID NO: 190441 - DNA, 11 bp, Unknown
  misc_feature (1)..( 11): Result.005 file - promoters50/4769141
ttgattttaaa

SEQ ID NO: 190442 - DNA, 11 bp, Unknown
  misc_feature (1)..( 11): Result.005 file - promoters50/4769141
atttttttaat

SEQ ID NO: 190443 - DNA, 11 bp, Unknown
  misc_feature (1)..( 11): Result.005 file - promoters50/4769141
tttattttagt

SEQ ID NO: 190444 - DNA, 11 bp, Unknown
  misc_feature (1)..( 11): Result.005 file - promoters50/4769141
tttctttgtat

SEQ ID NO: 190445 - DNA, 7 bp, Unknown
  misc_feature (1)..( 7): Result.005 file - promoters50/4769145
ttttaat

SEQ ID NO: 190446 - DNA, 7 bp, Unknown
  misc_feature (1)..( 7): Result.005 file - promoters50/4769145
ttttaac

SEQ ID NO: 190447 - DNA, 7 bp, Unknown
  misc_feature (1)..( 7): Result.005 file - promoters50/4769145
atttaac

SEQ ID NO: 190448 - DNA, 12 bp, Unknown
  misc_feature (1)..( 12): Result.005 file - promoters50/4769149
aaacataaataa

SEQ ID NO: 190449 - DNA, 12 bp, Unknown
  misc_feature (1)..( 12): Result.005 file - promoters50/4769149
aaacataaataa

SEQ ID NO: 190450 - DNA, 12 bp, Unknown
  misc_feature (1)..( 12): Result.005 file - promoters50/4769149
aaatatagtttc

SEQ ID NO: 190451 - DNA, 8 bp, Unknown
  misc_feature (1)..( 8): Result.005 file - promoters50/4769149
tatgattg

SEQ ID NO: 190452 - DNA, 8 bp, Unknown
  misc_feature (1)..( 8): Result.005 file - promoters50/4769149
tattatta

SEQ ID NO: 190453 - DNA, 8 bp, Unknown
  misc_feature (1)..( 8): Result.005 file - promoters50/4769149
tatcattt

SEQ ID NO: 190454 - DNA, 8 bp, Unknown
  misc_feature (1)..( 8): Result.005 file - promoters50/4769149
aatcattt

SEQ ID NO: 190455 - DNA, 11 bp, Unknown
  misc_feature (1)..( 11): Result.005 file - promoters50/4769149
cttctttaatt

SEQ ID NO: 190456 - DNA, 11 bp, Unknown
  misc_feature (1)..( 11): Result.005 file - promoters50/4769149
tttcttttctt

SEQ ID NO: 190457 - DNA, 11 bp, Unknown
  misc_feature (1)..( 11): Result.005 file - promoters50/4769149
attttttttct

SEQ ID NO: 190458 - DNA, 8 bp, Unknown
  misc_feature (1)..( 8): Result.005 file - promoters50/4769149
tcttattt

SEQ ID NO: 190459 - DNA, 8 bp, Unknown
  misc_feature (1)..( 8): Result.005 file - promoters50/4769149
tcttattt

SEQ ID NO: 190460 - DNA, 8 bp, Unknown
  misc_feature (1)..( 8): Result.005 file - promoters50/4769149
cgttattt

SEQ ID NO: 190461 - DNA, 8 bp, Unknown
  misc_feature (1)..( 8): Result.005 file - promoters50/4769149
aaataaaa

SEQ ID NO: 190462 - DNA, 8 bp, Unknown
  misc_feature (1)..( 8): Result.005 file - promoters50/4769149
caatcaaa

SEQ ID NO: 190463 - DNA, 9 bp, Unknown
  misc_feature (1)..( 9): Result.005 file - promoters50/4769149
aaactaaag

SEQ ID NO: 190464 - DNA, 9 bp, Unknown
  misc_feature (1)..( 9): Result.005 file - promoters50/4769149
ttttgttaa

SEQ ID NO: 190465 - DNA, 9 bp, Unknown
  misc_feature (1)..( 9): Result.005 file - promoters50/4769149
ttttgttgt

SEQ ID NO: 190466 - DNA, 9 bp, Unknown
  misc_feature (1)..( 9): Result.005 file - promoters50/4769149
cgttgataa

SEQ ID NO: 190467 - DNA, 6 bp, Unknown
  misc_feature (1)..( 6): Result.005 file - promoters50/4769149
aaagaa

SEQ ID NO: 190468 - DNA, 6 bp, Unknown
  misc_feature (1)..( 6): Result.005 file - promoters50/4769149
aaagaa

SEQ ID NO: 190469 - DNA, 6 bp, Unknown
  misc_feature (1)..( 6): Result.005 file - promoters50/4769149
aaagaa

SEQ ID NO: 190470 - DNA, 9 bp, Unknown
  misc_feature (1)..( 9): Result.005 file - promoters50/4769149
atatttaat

SEQ ID NO: 190471 - DNA, 9 bp, Unknown
  misc_feature (1)..( 9): Result.005 file - promoters50/4769149
cattttaat

SEQ ID NO: 190472 - DNA, 9 bp, Unknown
  misc_feature (1)..( 9): Result.005 file - promoters50/4769149
ataattaaa

SEQ ID NO: 190473 - DNA, 8 bp, Unknown
  misc_feature (1)..( 8): Result.005 file - promoters50/4769149
caatgatt

SEQ ID NO: 190474 - DNA, 8 bp, Unknown
  misc_feature (1)..( 8): Result.005 file - promoters50/4769149
caatgatt

SEQ ID NO: 190475 - DNA, 8 bp, Unknown
  misc_feature (1)..( 8): Result.005 file - promoters50/4769149
gaatgatt

SEQ ID NO: 190476 - DNA, 12 bp, Unknown
  misc_feature (1)..( 12): Result.005 file - promoters50/4769153
atatataatatt

SEQ ID NO: 190477 - DNA, 12 bp, Unknown
  misc_feature (1)..( 12): Result.005 file - promoters50/4769153
ttataaaataca

SEQ ID NO: 190478 - DNA, 12 bp, Unknown
  misc_feature (1)..( 12): Result.005 file - promoters50/4769153
ataaataacatt

SEQ ID NO: 190479 - DNA, 12 bp, Unknown
  misc_feature (1)..( 12): Result.005 file - promoters50/4769153
ataaataaaagc

SEQ ID NO: 190480 - DNA, 12 bp, Unknown
  misc_feature (1)..( 12): Result.005 file - promoters50/4769153
acaaagaaaatt

SEQ ID NO: 190481 - DNA, 14 bp, Unknown
  misc_feature (1)..( 14): Result.005 file - promoters50/4769153
aaaacagtaaaacc

SEQ ID NO: 190482 - DNA, 14 bp, Unknown
  misc_feature (1)..( 14): Result.005 file - promoters50/4769153
tggaaaacaaaact

SEQ ID NO: 190483 - DNA, 10 bp, Unknown
  misc_feature (1)..( 10): Result.005 file - promoters50/4769153
atatttttta

SEQ ID NO: 190484 - DNA, 10 bp, Unknown
  misc_feature (1)..( 10): Result.005 file - promoters50/4769153
aaattgttta

SEQ ID NO: 190485 - DNA, 10 bp, Unknown
  misc_feature (1)..( 10): Result.005 file - promoters50/4769153
ttatttttgt

SEQ ID NO: 190486 - DNA, 10 bp, Unknown
  misc_feature (1)..( 10): Result.005 file - promoters50/4769153
aaaatgtagt

SEQ ID NO: 190487 - DNA, 10 bp, Unknown
  misc_feature (1)..( 10): Result.005 file - promoters50/4769153
aaaataaata

SEQ ID NO: 190488 - DNA, 10 bp, Unknown
  misc_feature (1)..( 10): Result.005 file - promoters50/4769153
caaacatata

SEQ ID NO: 190489 - DNA, 10 bp, Unknown
  misc_feature (1)..( 10): Result.005 file - promoters50/4769153
ttaataaagc

SEQ ID NO: 190490 - DNA, 9 bp, Unknown
  misc_feature (1)..( 9): Result.005 file - promoters50/4769153
ttatatata

SEQ ID NO: 190491 - DNA, 9 bp, Unknown
  misc_feature (1)..( 9): Result.005 file - promoters50/4769153
aaataaata

SEQ ID NO: 190492 - DNA, 9 bp, Unknown
  misc_feature (1)..( 9): Result.005 file - promoters50/4769153
aaataaata

SEQ ID NO: 190493 - DNA, 9 bp, Unknown
  misc_feature (1)..( 9): Result.005 file - promoters50/4769153
aaagaaaat

SEQ ID NO: 190494 - DNA, 9 bp, Unknown
  misc_feature (1)..( 9): Result.005 file - promoters50/4769153
taataaagc

SEQ ID NO: 190495 - DNA, 9 bp, Unknown
  misc_feature (1)..( 9): Result.005 file - promoters50/4769153
aaacaaaac

SEQ ID NO: 190496 - DNA, 10 bp, Unknown
  misc_feature (1)..( 10): Result.005 file - promoters50/4769153
taaacatatt

SEQ ID NO: 190497 - DNA, 10 bp, Unknown
  misc_feature (1)..( 10): Result.005 file - promoters50/4769153
actacatatt

SEQ ID NO: 190498 - DNA, 10 bp, Unknown
  misc_feature (1)..( 10): Result.005 file - promoters50/4769153
caaaaataag

SEQ ID NO: 190499 - DNA, 10 bp, Unknown
  misc_feature (1)..( 10): Result.005 file - promoters50/4769153
aaatcatatt

SEQ ID NO: 190500 - DNA, 10 bp, Unknown
  misc_feature (1)..( 10): Result.005 file - promoters50/4769153
caaaaaacga

SEQ ID NO: 190501 - DNA, 10 bp, Unknown
  misc_feature (1)..( 10): Result.005 file - promoters50/4769153
caaatatatg

SEQ ID NO: 190502 - DNA, 15 bp, Unknown
  misc_feature (1)..( 15): Result.005 file - promoters50/4769169
cggaatcaaaacaaa

SEQ ID NO: 190503 - DNA, 15 bp, Unknown
  misc_feature (1)..( 15): Result.005 file - promoters50/4769169
tctaataaaaaaaca

SEQ ID NO: 190504 - DNA, 16 bp, Unknown
  misc_feature (1)..( 16): Result.005 file - promoters50/4769169
cgaaaagcaaaaccaa

SEQ ID NO: 190505 - DNA, 16 bp, Unknown
  misc_feature (1)..( 16): Result.005 file - promoters50/4769169
taacaaacaatacata

SEQ ID NO: 190506 - DNA, 16 bp, Unknown
  misc_feature (1)..( 16): Result.005 file - promoters50/4769169
tgatatacaaaaaaaa

SEQ ID NO: 190507 - DNA, 16 bp, Unknown
  misc_feature (1)..( 16): Result.005 file - promoters50/4769169
tctaatagaaaacgaa

SEQ ID NO: 190508 - DNA, 16 bp, Unknown
  misc_feature (1)..( 16): Result.005 file - promoters50/4769169
gacagccgaaaacact

SEQ ID NO: 190509 - DNA, 9 bp, Unknown
  misc_feature (1)..( 9): Result.005 file - promoters50/4769169
caaaacaaa

SEQ ID NO: 190510 - DNA, 9 bp, Unknown
  misc_feature (1)..( 9): Result.005 file - promoters50/4769169
aaaaacaac

SEQ ID NO: 190511 - DNA, 10 bp, Unknown
  misc_feature (1)..( 10): Result.005 file - promoters50/4769169
gaaaacgaat

SEQ ID NO: 190512 - DNA, 10 bp, Unknown
  misc_feature (1)..( 10): Result.005 file - promoters50/4769169
gaaaagcaaa

SEQ ID NO: 190513 - DNA, 10 bp, Unknown
  misc_feature (1)..( 10): Result.005 file - promoters50/4769169
acaaacaata

SEQ ID NO: 190514 - DNA, 10 bp, Unknown
  misc_feature (1)..( 10): Result.005 file - promoters50/4769169
caaaaaaaaa

SEQ ID NO: 190515 - DNA, 10 bp, Unknown
  misc_feature (1)..( 10): Result.005 file - promoters50/4769169
cgaaaacact

SEQ ID NO: 190516 - DNA, 11 bp, Unknown
  misc_feature (1)..( 11): Result.005 file - promoters50/4769169
aaaatttataa

SEQ ID NO: 190517 - DNA, 11 bp, Unknown
  misc_feature (1)..( 11): Result.005 file - promoters50/4769169
gaaagttaaat

SEQ ID NO: 190518 - DNA, 11 bp, Unknown
  misc_feature (1)..( 11): Result.005 file - promoters50/4769169
aaaattaacta

SEQ ID NO: 190519 - DNA, 12 bp, Unknown
  misc_feature (1)..( 12): Result.005 file - promoters50/4769169
aaatatttgtaa

SEQ ID NO: 190520 - DNA, 12 bp, Unknown
  misc_feature (1)..( 12): Result.005 file - promoters50/4769169
gaaaatatcgaa

SEQ ID NO: 190521 - DNA, 12 bp, Unknown
  misc_feature (1)..( 12): Result.005 file - promoters50/4769169
tttaagttaacc

SEQ ID NO: 190522 - DNA, 12 bp, Unknown
  misc_feature (1)..( 12): Result.005 file - promoters50/4769169
tctcgtttataa

SEQ ID NO: 190523 - DNA, 9 bp, Unknown
  misc_feature (1)..( 9): Result.005 file - promoters50/4769177
ctatgttcg

SEQ ID NO: 190524 - DNA, 9 bp, Unknown
  misc_feature (1)..( 9): Result.005 file - promoters50/4769177
aaatgatcg

SEQ ID NO: 190525 - DNA, 9 bp, Unknown
  misc_feature (1)..( 9): Result.005 file - promoters50/4769177
atatgttat

SEQ ID NO: 190526 - DNA, 9 bp, Unknown
  misc_feature (1)..( 9): Result.005 file - promoters50/4769177
ttattttca

SEQ ID NO: 190527 - DNA, 9 bp, Unknown
  misc_feature (1)..( 9): Result.005 file - promoters50/4769177
atattttta

SEQ ID NO: 190528 - DNA, 9 bp, Unknown
  misc_feature (1)..( 9): Result.005 file - promoters50/4769177
aaaagataa

SEQ ID NO: 190529 - DNA, 11 bp, Unknown
  misc_feature (1)..( 11): Result.005 file - promoters50/4769177
caatattttta

SEQ ID NO: 190530 - DNA, 11 bp, Unknown
  misc_feature (1)..( 11): Result.005 file - promoters50/4769177
gaatcttttaa

SEQ ID NO: 190531 - DNA, 11 bp, Unknown
  misc_feature (1)..( 11): Result.005 file - promoters50/4769177
caaaattactg

SEQ ID NO: 190532 - DNA, 11 bp, Unknown
  misc_feature (1)..( 11): Result.005 file - promoters50/4769177
aattattttca

SEQ ID NO: 190533 - DNA, 11 bp, Unknown
  misc_feature (1)..( 11): Result.005 file - promoters50/4769177
ttttatttcat

SEQ ID NO: 190534 - DNA, 11 bp, Unknown
  misc_feature (1)..( 11): Result.005 file - promoters50/4769177
tgttatcttca

SEQ ID NO: 190535 - DNA, 13 bp, Unknown
  misc_feature (1)..( 13): Result.005 file - promoters50/4769180
ttaaaatatttcg

SEQ ID NO: 190536 - DNA, 13 bp, Unknown
  misc_feature (1)..( 13): Result.005 file - promoters50/4769180
aaaaaacattcca

SEQ ID NO: 190537 - DNA, 13 bp, Unknown
  misc_feature (1)..( 13): Result.005 file - promoters50/4769180
agttaatattaag

SEQ ID NO: 190538 - DNA, 13 bp, Unknown
  misc_feature (1)..( 13): Result.005 file - promoters50/4769180
ttaaaatagtaga

SEQ ID NO: 190539 - DNA, 13 bp, Unknown
  misc_feature (1)..( 13): Result.005 file - promoters50/4769180
aaatcatatttat

SEQ ID NO: 190540 - DNA, 13 bp, Unknown
  misc_feature (1)..( 13): Result.005 file - promoters50/4769180
tatcaaaattaaa

SEQ ID NO: 190541 - DNA, 10 bp, Unknown
  misc_feature (1)..( 10): Result.005 file - promoters50/4769180
gaaattaatc

SEQ ID NO: 190542 - DNA, 10 bp, Unknown
  misc_feature (1)..( 10): Result.005 file - promoters50/4769180
ttgatttatc

SEQ ID NO: 190543 - DNA, 10 bp, Unknown
  misc_feature (1)..( 10): Result.005 file - promoters50/4769180
aaaatcaatc

SEQ ID NO: 190544 - DNA, 10 bp, Unknown
  misc_feature (1)..( 10): Result.005 file - promoters50/4769180
tttattcatc

SEQ ID NO: 190545 - DNA, 10 bp, Unknown
  misc_feature (1)..( 10): Result.005 file - promoters50/4769180
gaaattaata

SEQ ID NO: 190546 - DNA, 10 bp, Unknown
  misc_feature (1)..( 10): Result.005 file - promoters50/4769180
tagatttacc

SEQ ID NO: 190547 - DNA, 12 bp, Unknown
  misc_feature (1)..( 12): Result.005 file - promoters50/4769180
tgaataaccaaa

SEQ ID NO: 190548 - DNA, 12 bp, Unknown
  misc_feature (1)..( 12): Result.005 file - promoters50/4769180
agaataatattt

SEQ ID NO: 190549 - DNA, 12 bp, Unknown
  misc_feature (1)..( 12): Result.005 file - promoters50/4769180
ttaattaccaaa

SEQ ID NO: 190550 - DNA, 12 bp, Unknown
  misc_feature (1)..( 12): Result.005 file - promoters50/4769180
aaaataaacaat

SEQ ID NO: 190551 - DNA, 12 bp, Unknown
  misc_feature (1)..( 12): Result.005 file - promoters50/4769180
ttaattaatact

SEQ ID NO: 190552 - DNA, 12 bp, Unknown
  misc_feature (1)..( 12): Result.005 file - promoters50/4769180
caaattacatac

SEQ ID NO: 190553 - DNA, 11 bp, Unknown
  misc_feature (1)..( 11): Result.005 file - promoters50/4769184
ttaaaattcaa

SEQ ID NO: 190554 - DNA, 11 bp, Unknown
  misc_feature (1)..( 11): Result.005 file - promoters50/4769184
ccaaaatccaa

SEQ ID NO: 190555 - DNA, 11 bp, Unknown
  misc_feature (1)..( 11): Result.005 file - promoters50/4769184
cacaaagtcaa

SEQ ID NO: 190556 - DNA, 11 bp, Unknown
  misc_feature (1)..( 11): Result.005 file - promoters50/4769184
ttataatattt

SEQ ID NO: 190557 - DNA, 11 bp, Unknown
  misc_feature (1)..( 11): Result.005 file - promoters50/4769184
ttaaaatctct

SEQ ID NO: 190558 - DNA, 9 bp, Unknown
  misc_feature (1)..( 9): Result.005 file - promoters50/4769186
cgaaagaat

SEQ ID NO: 190559 - DNA, 9 bp, Unknown
  misc_feature (1)..( 9): Result.005 file - promoters50/4769186
gaaaagaaa

SEQ ID NO: 190560 - DNA, 10 bp, Unknown
  misc_feature (1)..( 10): Result.005 file - promoters50/4769186
ggaaatgaaa

SEQ ID NO: 190561 - DNA, 7 bp, Unknown
  misc_feature (1)..( 7): Result.005 file - promoters50/4769186
aaaatat

SEQ ID NO: 190562 - DNA, 7 bp, Unknown
  misc_feature (1)..( 7): Result.005 file - promoters50/4769186
aaaataa

SEQ ID NO: 190563 - DNA, 7 bp, Unknown
  misc_feature (1)..( 7): Result.005 file - promoters50/4769186
gaaatat

SEQ ID NO: 190564 - DNA, 10 bp, Unknown
  misc_feature (1)..( 10): Result.005 file - promoters50/4769186
atgtagaaaa

SEQ ID NO: 190565 - DNA, 10 bp, Unknown
  misc_feature (1)..( 10): Result.005 file - promoters50/4769186
atgaagaatt

SEQ ID NO: 190566 - DNA, 10 bp, Unknown
  misc_feature (1)..( 10): Result.005 file - promoters50/4769186
tagtataaaa

SEQ ID NO: 190567 - DNA, 8 bp, Unknown
  misc_feature (1)..( 8): Result.005 file - promoters50/4769186
ggttgtgt

SEQ ID NO: 190568 - DNA, 8 bp, Unknown
  misc_feature (1)..( 8): Result.005 file - promoters50/4769186
ggttttgt

SEQ ID NO: 190569 - DNA, 8 bp, Unknown
  misc_feature (1)..( 8): Result.005 file - promoters50/4769186
ggttttta

SEQ ID NO: 190570 - DNA, 13 bp, Unknown
  misc_feature (1)..( 13): Result.005 file - promoters50/4769201
aacaaatggtgat

SEQ ID NO: 190571 - DNA, 13 bp, Unknown
  misc_feature (1)..( 13): Result.005 file - promoters50/4769201
aacaaattattaa

SEQ ID NO: 190572 - DNA, 13 bp, Unknown
  misc_feature (1)..( 13): Result.005 file - promoters50/4769201
gacacattagtaa

SEQ ID NO: 190573 - DNA, 17 bp, Unknown
  misc_feature (1)..( 17): Result.005 file - promoters50/4769209
agattctttcacaaata

SEQ ID NO: 190574 - DNA, 17 bp, Unknown
  misc_feature (1)..( 17): Result.005 file - promoters50/4769209
tatttccttctcaattt

SEQ ID NO: 190575 - DNA, 17 bp, Unknown
  misc_feature (1)..( 17): Result.005 file - promoters50/4769209
tattttcttctcagttt

SEQ ID NO: 190576 - DNA, 10 bp, Unknown
  misc_feature (1)..( 10): Result.005 file - promoters50/4769217
tttgtttttg

SEQ ID NO: 190577 - DNA, 10 bp, Unknown
  misc_feature (1)..( 10): Result.005 file - promoters50/4769217
tttcttttgt

SEQ ID NO: 190578 - DNA, 11 bp, Unknown
  misc_feature (1)..( 11): Result.005 file - promoters50/4769217
tgtgtatttga

SEQ ID NO: 190579 - DNA, 11 bp, Unknown
  misc_feature (1)..( 11): Result.005 file - promoters50/4769217
catccctttct

SEQ ID NO: 190580 - DNA, 11 bp, Unknown
  misc_feature (1)..( 11): Result.005 file - promoters50/4769217
attacttgcac

SEQ ID NO: 190581 - DNA, 7 bp, Unknown
  misc_feature (1)..( 7): Result.005 file - promoters50/4769217
tttttgt

SEQ ID NO: 190582 - DNA, 7 bp, Unknown
  misc_feature (1)..( 7): Result.005 file - promoters50/4769217
cttttgt

SEQ ID NO: 190583 - DNA, 8 bp, Unknown
  misc_feature (1)..( 8): Result.005 file - promoters50/4769217
atttatgt

SEQ ID NO: 190584 - DNA, 8 bp, Unknown
  misc_feature (1)..( 8): Result.005 file - promoters50/4769217
ctttctct

SEQ ID NO: 190585 - DNA, 8 bp, Unknown
  misc_feature (1)..( 8): Result.005 file - promoters50/4769217
atttatta

SEQ ID NO: 190586 - DNA, 7 bp, Unknown
  misc_feature (1)..( 7): Result.005 file - promoters50/4769217
gttaatg

SEQ ID NO: 190587 - DNA, 7 bp, Unknown
  misc_feature (1)..( 7): Result.005 file - promoters50/4769217
gttaata

SEQ ID NO: 190588 - DNA, 7 bp, Unknown
  misc_feature (1)..( 7): Result.005 file - promoters50/4769217
tttaata

SEQ ID NO: 190589 - DNA, 7 bp, Unknown
  misc_feature (1)..( 7): Result.005 file - promoters50/4769217
ttttata

SEQ ID NO: 190590 - DNA, 12 bp, Unknown
  misc_feature (1)..( 12): Result.005 file - promoters50/4769217
tcggtcagttta

SEQ ID NO: 190591 - DNA, 12 bp, Unknown
  misc_feature (1)..( 12): Result.005 file - promoters50/4769217
tttgtcattttc

SEQ ID NO: 190592 - DNA, 12 bp, Unknown
  misc_feature (1)..( 12): Result.005 file - promoters50/4769217
accctcatttta

SEQ ID NO: 190593 - DNA, 12 bp, Unknown
  misc_feature (1)..( 12): Result.005 file - promoters50/4769217
tttgacattatg

SEQ ID NO: 190594 - DNA, 9 bp, Unknown
  misc_feature (1)..( 9): Result.005 file - promoters50/4769217
atagttttt

SEQ ID NO: 190595 - DNA, 9 bp, Unknown
  misc_feature (1)..( 9): Result.005 file - promoters50/4769217
ataatttaa

SEQ ID NO: 190596 - DNA, 9 bp, Unknown
  misc_feature (1)..( 9): Result.005 file - promoters50/4769217
acaatttaa

SEQ ID NO: 190597 - DNA, 9 bp, Unknown
  misc_feature (1)..( 9): Result.005 file - promoters50/4769217
agaatttaa

SEQ ID NO: 190598 - DNA, 8 bp, Unknown
  misc_feature (1)..( 8): Result.005 file - promoters50/4769217
tttttaaa

SEQ ID NO: 190599 - DNA, 8 bp, Unknown
  misc_feature (1)..( 8): Result.005 file - promoters50/4769217
aatttaaa

SEQ ID NO: 190600 - DNA, 8 bp, Unknown
  misc_feature (1)..( 8): Result.005 file - promoters50/4769217
aatttaag

SEQ ID NO: 190601 - DNA, 8 bp, Unknown
  misc_feature (1)..( 8): Result.005 file - promoters50/4769217
tatttaac

SEQ ID NO: 190602 - DNA, 9 bp, Unknown
  misc_feature (1)..( 9): Result.005 file - promoters50/4769217
atattataa

SEQ ID NO: 190603 - DNA, 9 bp, Unknown
  misc_feature (1)..( 9): Result.005 file - promoters50/4769217
atattaaaa

SEQ ID NO: 190604 - DNA, 9 bp, Unknown
  misc_feature (1)..( 9): Result.005 file - promoters50/4769217
atactaaaa

SEQ ID NO: 190605 - DNA, 9 bp, Unknown
  misc_feature (1)..( 9): Result.005 file - promoters50/4769217
cagctaaaa

SEQ ID NO: 190606 - DNA, 9 bp, Unknown
  misc_feature (1)..( 9): Result.005 file - promoters50/4769221
taaaaatta

SEQ ID NO: 190607 - DNA, 9 bp, Unknown
  misc_feature (1)..( 9): Result.005 file - promoters50/4769221
ccaaattta

SEQ ID NO: 190608 - DNA, 9 bp, Unknown
  misc_feature (1)..( 9): Result.005 file - promoters50/4769221
taaaaatat

SEQ ID NO: 190609 - DNA, 9 bp, Unknown
  misc_feature (1)..( 9): Result.005 file - promoters50/4769257
tgaaacaaa

SEQ ID NO: 190610 - DNA, 9 bp, Unknown
  misc_feature (1)..( 9): Result.005 file - promoters50/4769257
tgaatcaat

SEQ ID NO: 190611 - DNA, 9 bp, Unknown
  misc_feature (1)..( 9): Result.005 file - promoters50/4769257
ataaacaaa

SEQ ID NO: 190612 - DNA, 9 bp, Unknown
  misc_feature (1)..( 9): Result.005 file - promoters50/4769257
ctaatcaag

SEQ ID NO: 190613 - DNA, 9 bp, Unknown
  misc_feature (1)..( 9): Result.005 file - promoters50/4769257
aatatcaat

SEQ ID NO: 190614 - DNA, 9 bp, Unknown
  misc_feature (1)..( 9): Result.005 file - promoters50/4769257
cttataaat

SEQ ID NO: 190615 - DNA, 10 bp, Unknown
  misc_feature (1)..( 10): Result.005 file - promoters50/4769257
ttttgttaaa

SEQ ID NO: 190616 - DNA, 10 bp, Unknown
  misc_feature (1)..( 10): Result.005 file - promoters50/4769257
ttttattaat

SEQ ID NO: 190617 - DNA, 10 bp, Unknown
  misc_feature (1)..( 10): Result.005 file - promoters50/4769257
tttagtttct

SEQ ID NO: 190618 - DNA, 10 bp, Unknown
  misc_feature (1)..( 10): Result.005 file - promoters50/4769257
ctttcttgga

SEQ ID NO: 190619 - DNA, 10 bp, Unknown
  misc_feature (1)..( 10): Result.005 file - promoters50/4769257
ctatataaat

SEQ ID NO: 190620 - DNA, 10 bp, Unknown
  misc_feature (1)..( 10): Result.005 file - promoters50/4769257
taatcttaac

SEQ ID NO: 190621 - DNA, 10 bp, Unknown
  misc_feature (1)..( 10): Result.005 file - promoters50/4769257
aaatataaat

SEQ ID NO: 190622 - DNA, 13 bp, Unknown
  misc_feature (1)..( 13): Result.005 file - promoters50/4769257
gaaaagaaagaaa

SEQ ID NO: 190623 - DNA, 13 bp, Unknown
  misc_feature (1)..( 13): Result.005 file - promoters50/4769257
tcaaaaaaacgag

SEQ ID NO: 190624 - DNA, 13 bp, Unknown
  misc_feature (1)..( 13): Result.005 file - promoters50/4769257
aaaaacaaaacaa

SEQ ID NO: 190625 - DNA, 13 bp, Unknown
  misc_feature (1)..( 13): Result.005 file - promoters50/4769257
gacaacaaacgaa

SEQ ID NO: 190626 - DNA, 13 bp, Unknown
  misc_feature (1)..( 13): Result.005 file - promoters50/4769257
tcataaatacgta

SEQ ID NO: 190627 - DNA, 13 bp, Unknown
  misc_feature (1)..( 13): Result.005 file - promoters50/4769257
aattaaatagtta

SEQ ID NO: 190628 - DNA, 13 bp, Unknown
  misc_feature (1)..( 13): Result.005 file - promoters50/4769257
actctcaaacgcg

SEQ ID NO: 190629 - DNA, 9 bp, Unknown
  misc_feature (1)..( 9): Result.005 file - promoters50/4769257
acaaaattg

SEQ ID NO: 190630 - DNA, 9 bp, Unknown
  misc_feature (1)..( 9): Result.005 file - promoters50/4769257
tcaagattt

SEQ ID NO: 190631 - DNA, 9 bp, Unknown
  misc_feature (1)..( 9): Result.005 file - promoters50/4769257
tataaattg

SEQ ID NO: 190632 - DNA, 9 bp, Unknown
  misc_feature (1)..( 9): Result.005 file - promoters50/4769257
ttaaaattt

SEQ ID NO: 190633 - DNA, 9 bp, Unknown
  misc_feature (1)..( 9): Result.005 file - promoters50/4769257
aaaaaattc

SEQ ID NO: 190634 - DNA, 9 bp, Unknown
  misc_feature (1)..( 9): Result.005 file - promoters50/4769257
ttaaaataa

SEQ ID NO: 190635 - DNA, 9 bp, Unknown
  misc_feature (1)..( 9): Result.005 file - promoters50/4769257
ctaaaatct

SEQ ID NO: 190636 - DNA, 8 bp, Unknown
  misc_feature (1)..( 8): Result.005 file - promoters50/4769257
tttacaaa

SEQ ID NO: 190637 - DNA, 8 bp, Unknown
  misc_feature (1)..( 8): Result.005 file - promoters50/4769257
aatacaaa

SEQ ID NO: 190638 - DNA, 8 bp, Unknown
  misc_feature (1)..( 8): Result.005 file - promoters50/4769257
aatataaa

SEQ ID NO: 190639 - DNA, 8 bp, Unknown
  misc_feature (1)..( 8): Result.005 file - promoters50/4769257
tatataaa

SEQ ID NO: 190640 - DNA, 8 bp, Unknown
  misc_feature (1)..( 8): Result.005 file - promoters50/4769257
aattcaat

SEQ ID NO: 190641 - DNA, 8 bp, Unknown
  misc_feature (1)..( 8): Result.005 file - promoters50/4769257
aatataat

SEQ ID NO: 190642 - DNA, 11 bp, Unknown
  misc_feature (1)..( 11): Result.005 file - promoters50/4769260
atgatttgttt

SEQ ID NO: 190643 - DNA, 11 bp, Unknown
  misc_feature (1)..( 11): Result.005 file - promoters50/4769260
gtgattttttt

SEQ ID NO: 190644 - DNA, 11 bp, Unknown
  misc_feature (1)..( 11): Result.005 file - promoters50/4769260
aagatttgagt

SEQ ID NO: 190645 - DNA, 11 bp, Unknown
  misc_feature (1)..( 11): Result.005 file - promoters50/4769260
aatttttgttg

SEQ ID NO: 190646 - DNA, 11 bp, Unknown
  misc_feature (1)..( 11): Result.005 file - promoters50/4769260
attatttttat

SEQ ID NO: 190647 - DNA, 11 bp, Unknown
  misc_feature (1)..( 11): Result.005 file - promoters50/4769260
attatttacta

SEQ ID NO: 190648 - DNA, 9 bp, Unknown
  misc_feature (1)..( 9): Result.005 file - promoters50/4769260
ataaaaaga

SEQ ID NO: 190649 - DNA, 9 bp, Unknown
  misc_feature (1)..( 9): Result.005 file - promoters50/4769260
ttaaaaact

SEQ ID NO: 190650 - DNA, 9 bp, Unknown
  misc_feature (1)..( 9): Result.005 file - promoters50/4769260
cgaaaaagc

SEQ ID NO: 190651 - DNA, 9 bp, Unknown
  misc_feature (1)..( 9): Result.005 file - promoters50/4769260
ataaaaaca

SEQ ID NO: 190652 - DNA, 9 bp, Unknown
  misc_feature (1)..( 9): Result.005 file - promoters50/4769260
ataataacc

SEQ ID NO: 190653 - DNA, 9 bp, Unknown
  misc_feature (1)..( 9): Result.005 file - promoters50/4769260
gaaaaaact

SEQ ID NO: 190654 - DNA, 7 bp, Unknown
  misc_feature (1)..( 7): Result.005 file - promoters50/4769276
gaacatt

SEQ ID NO: 190655 - DNA, 7 bp, Unknown
  misc_feature (1)..( 7): Result.005 file - promoters50/4769276
gaacatg

SEQ ID NO: 190656 - DNA, 7 bp, Unknown
  misc_feature (1)..( 7): Result.005 file - promoters50/4769276
gaacata

SEQ ID NO: 190657 - DNA, 7 bp, Unknown
  misc_feature (1)..( 7): Result.005 file - promoters50/4769276
gaaaatt

SEQ ID NO: 190658 - DNA, 11 bp, Unknown
  misc_feature (1)..( 11): Result.005 file - promoters50/4769296
acttcttcacc

SEQ ID NO: 190659 - DNA, 11 bp, Unknown
  misc_feature (1)..( 11): Result.005 file - promoters50/4769296
acttcctcaat

SEQ ID NO: 190660 - DNA, 11 bp, Unknown
  misc_feature (1)..( 11): Result.005 file - promoters50/4769296
tactcttcacc

SEQ ID NO: 190661 - DNA, 10 bp, Unknown
  misc_feature (1)..( 10): Result.005 file - promoters50/4769296
aaaagaataa

SEQ ID NO: 190662 - DNA, 10 bp, Unknown
  misc_feature (1)..( 10): Result.005 file - promoters50/4769296
aaaagaaaca

SEQ ID NO: 190663 - DNA, 10 bp, Unknown
  misc_feature (1)..( 10): Result.005 file - promoters50/4769296
aaaaaaaaca

SEQ ID NO: 190664 - DNA, 10 bp, Unknown
  misc_feature (1)..( 10): Result.005 file - promoters50/4769296
taacatataa

SEQ ID NO: 190665 - DNA, 10 bp, Unknown
  misc_feature (1)..( 10): Result.005 file - promoters50/4769296
ctctatataa

SEQ ID NO: 190666 - DNA, 10 bp, Unknown
  misc_feature (1)..( 10): Result.005 file - promoters50/4769296
ctctctatat

SEQ ID NO: 190667 - DNA, 16 bp, Unknown
  misc_feature (1)..( 16): Result.005 file - promoters50/4769301
ggtcttacaatttttt

SEQ ID NO: 190668 - DNA, 16 bp, Unknown
  misc_feature (1)..( 16): Result.005 file - promoters50/4769301
agaaatacaattttgt

SEQ ID NO: 190669 - DNA, 16 bp, Unknown
  misc_feature (1)..( 16): Result.005 file - promoters50/4769301
ctcacatttatttttg

SEQ ID NO: 190670 - DNA, 16 bp, Unknown
  misc_feature (1)..( 16): Result.005 file - promoters50/4769301
agaactactattcgtg

SEQ ID NO: 190671 - DNA, 16 bp, Unknown
  misc_feature (1)..( 16): Result.005 file - promoters50/4769301
aagtcagctatttgtg

SEQ ID NO: 190672 - DNA, 8 bp, Unknown
  misc_feature (1)..( 8): Result.005 file - promoters50/4769301
acttttgg

SEQ ID NO: 190673 - DNA, 8 bp, Unknown
  misc_feature (1)..( 8): Result.005 file - promoters50/4769301
atttttgg

SEQ ID NO: 190674 - DNA, 8 bp, Unknown
  misc_feature (1)..( 8): Result.005 file - promoters50/4769301
gtttttgt

SEQ ID NO: 190675 - DNA, 8 bp, Unknown
  misc_feature (1)..( 8): Result.005 file - promoters50/4769301
attgttgt

SEQ ID NO: 190676 - DNA, 10 bp, Unknown
  misc_feature (1)..( 10): Result.005 file - promoters50/4769301
ttttaaaaga

SEQ ID NO: 190677 - DNA, 10 bp, Unknown
  misc_feature (1)..( 10): Result.005 file - promoters50/4769301
tttcaaaaaa

SEQ ID NO: 190678 - DNA, 10 bp, Unknown
  misc_feature (1)..( 10): Result.005 file - promoters50/4769301
ttgcaaaaaa

SEQ ID NO: 190679 - DNA, 10 bp, Unknown
  misc_feature (1)..( 10): Result.005 file - promoters50/4769301
cttcacaaac

SEQ ID NO: 190680 - DNA, 9 bp, Unknown
  misc_feature (1)..( 9): Result.005 file - promoters50/4769308
tgttttggt

SEQ ID NO: 190681 - DNA, 9 bp, Unknown
  misc_feature (1)..( 9): Result.005 file - promoters50/4769308
atgtttggt

SEQ ID NO: 190682 - DNA, 9 bp, Unknown
  misc_feature (1)..( 9): Result.005 file - promoters50/4769308
atgtttgga

SEQ ID NO: 190683 - DNA, 11 bp, Unknown
  misc_feature (1)..( 11): Result.005 file - promoters50/4769312
tctatataaac

SEQ ID NO: 190684 - DNA, 11 bp, Unknown
  misc_feature (1)..( 11): Result.005 file - promoters50/4769312
tctatataata

SEQ ID NO: 190685 - DNA, 11 bp, Unknown
  misc_feature (1)..( 11): Result.005 file - promoters50/4769312
attatttaaac

SEQ ID NO: 190686 - DNA, 11 bp, Unknown
  misc_feature (1)..( 11): Result.005 file - promoters50/4769312
tatatataccc

SEQ ID NO: 190687 - DNA, 11 bp, Unknown
  misc_feature (1)..( 11): Result.005 file - promoters50/4769312
tatatataaag

SEQ ID NO: 190688 - DNA, 11 bp, Unknown
  misc_feature (1)..( 11): Result.005 file - promoters50/4769312
ccaatataatc

SEQ ID NO: 190689 - DNA, 11 bp, Unknown
  misc_feature (1)..( 11): Result.005 file - promoters50/4769312
cctaaataaat

SEQ ID NO: 190690 - DNA, 12 bp, Unknown
  misc_feature (1)..( 12): Result.005 file - promoters50/4769312
acaataaagtag

SEQ ID NO: 190691 - DNA, 12 bp, Unknown
  misc_feature (1)..( 12): Result.005 file - promoters50/4769312
tcaacaaaatag

SEQ ID NO: 190692 - DNA, 12 bp, Unknown
  misc_feature (1)..( 12): Result.005 file - promoters50/4769312
acaaaaaataga

SEQ ID NO: 190693 - DNA, 13 bp, Unknown
  misc_feature (1)..( 13): Result.005 file - promoters50/4769312
aaccataaagaga

SEQ ID NO: 190694 - DNA, 12 bp, Unknown
  misc_feature (1)..( 12): Result.005 file - promoters50/4769312
gaaaaaaagaaa

SEQ ID NO: 190695 - DNA, 13 bp, Unknown
  misc_feature (1)..( 13): Result.005 file - promoters50/4769312
ccaagtaaaaacc

SEQ ID NO: 190696 - DNA, 13 bp, Unknown
  misc_feature (1)..( 13): Result.005 file - promoters50/4769312
aaaaagaaaaaaa

SEQ ID NO: 190697 - DNA, 13 bp, Unknown
  misc_feature (1)..( 13): Result.005 file - promoters50/4769312
aaatagataaatt

SEQ ID NO: 190698 - DNA, 13 bp, Unknown
  misc_feature (1)..( 13): Result.005 file - promoters50/4769312
aattagaaaatgc

SEQ ID NO: 190699 - DNA, 14 bp, Unknown
  misc_feature (1)..( 14): Result.005 file - promoters50/4769312
tccaagtaaaaacc

SEQ ID NO: 190700 - DNA, 14 bp, Unknown
  misc_feature (1)..( 14): Result.005 file - promoters50/4769312
aaaccataaagaga

SEQ ID NO: 190701 - DNA, 14 bp, Unknown
  misc_feature (1)..( 14): Result.005 file - promoters50/4769312
caacaaaatagatt

SEQ ID NO: 190702 - DNA, 14 bp, Unknown
  misc_feature (1)..( 14): Result.005 file - promoters50/4769320
tactaatactcaaa

SEQ ID NO: 190703 - DNA, 14 bp, Unknown
  misc_feature (1)..( 14): Result.005 file - promoters50/4769320
atttaatagtcatt

SEQ ID NO: 190704 - DNA, 14 bp, Unknown
  misc_feature (1)..( 14): Result.005 file - promoters50/4769320
atttgatagtgatt

SEQ ID NO: 190705 - DNA, 8 bp, Unknown
  misc_feature (1)..( 8): Result.005 file - promoters50/4769320
aattttgg

SEQ ID NO: 190706 - DNA, 8 bp, Unknown
  misc_feature (1)..( 8): Result.005 file - promoters50/4769320
aatattga

SEQ ID NO: 190707 - DNA, 8 bp, Unknown
  misc_feature (1)..( 8): Result.005 file - promoters50/4769320
tgttttgg

SEQ ID NO: 190708 - DNA, 9 bp, Unknown
  misc_feature (1)..( 9): Result.005 file - promoters50/4769320
tatttttgt

SEQ ID NO: 190709 - DNA, 9 bp, Unknown
  misc_feature (1)..( 9): Result.005 file - promoters50/4769320
tatatttga

SEQ ID NO: 190710 - DNA, 9 bp, Unknown
  misc_feature (1)..( 9): Result.005 file - promoters50/4769320
tatatgatt

SEQ ID NO: 190711 - DNA, 8 bp, Unknown
  misc_feature (1)..( 8): Result.005 file - promoters50/4769320
attacaat

SEQ ID NO: 190712 - DNA, 8 bp, Unknown
  misc_feature (1)..( 8): Result.005 file - promoters50/4769320
attacaca

SEQ ID NO: 190713 - DNA, 8 bp, Unknown
  misc_feature (1)..( 8): Result.005 file - promoters50/4769320
cttaaaca

SEQ ID NO: 190714 - DNA, 8 bp, Unknown
  misc_feature (1)..( 8): Result.005 file - promoters50/4769320
tattgttt

SEQ ID NO: 190715 - DNA, 8 bp, Unknown
  misc_feature (1)..( 8): Result.005 file - promoters50/4769320
tatttttt

SEQ ID NO: 190716 - DNA, 8 bp, Unknown
  misc_feature (1)..( 8): Result.005 file - promoters50/4769320
aatttttg

SEQ ID NO: 190717 - DNA, 12 bp, Unknown
  misc_feature (1)..( 12): Result.005 file - promoters50/4769328
aagaaatttgct

SEQ ID NO: 190718 - DNA, 12 bp, Unknown
  misc_feature (1)..( 12): Result.005 file - promoters50/4769328
tatgaatctgct

SEQ ID NO: 190719 - DNA, 12 bp, Unknown
  misc_feature (1)..( 12): Result.005 file - promoters50/4769328
gtcaaatttgtc

SEQ ID NO: 190720 - DNA, 12 bp, Unknown
  misc_feature (1)..( 12): Result.005 file - promoters50/4769328
aagaaaattgac

SEQ ID NO: 190721 - DNA, 12 bp, Unknown
  misc_feature (1)..( 12): Result.005 file - promoters50/4769328
taacaatttttt

SEQ ID NO: 190722 - DNA, 12 bp, Unknown
  misc_feature (1)..( 12): Result.005 file - promoters50/4769328
tcccaattttgc

SEQ ID NO: 190723 - DNA, 13 bp, Unknown
  misc_feature (1)..( 13): Result.005 file - promoters50/4769328
gaccaattttcat

SEQ ID NO: 190724 - DNA, 13 bp, Unknown
  misc_feature (1)..( 13): Result.005 file - promoters50/4769328
tttgaattttgcc

SEQ ID NO: 190725 - DNA, 13 bp, Unknown
  misc_feature (1)..( 13): Result.005 file - promoters50/4769328
tacatattatcat

SEQ ID NO: 190726 - DNA, 13 bp, Unknown
  misc_feature (1)..( 13): Result.005 file - promoters50/4769328
aatattttatcac

SEQ ID NO: 190727 - DNA, 13 bp, Unknown
  misc_feature (1)..( 13): Result.005 file - promoters50/4769328
attggatttaaca

SEQ ID NO: 190728 - DNA, 13 bp, Unknown
  misc_feature (1)..( 13): Result.005 file - promoters50/4769328
catgaatttaaat

SEQ ID NO: 190729 - DNA, 13 bp, Unknown
  misc_feature (1)..( 13): Result.005 file - promoters50/4769328
agaaaatttgatg

SEQ ID NO: 190730 - DNA, 12 bp, Unknown
  misc_feature (1)..( 12): Result.005 file - promoters50/4769366
tataaacatttt

SEQ ID NO: 190731 - DNA, 12 bp, Unknown
  misc_feature (1)..( 12): Result.005 file - promoters50/4769366
actaaaaatttt

SEQ ID NO: 190732 - DNA, 12 bp, Unknown
  misc_feature (1)..( 12): Result.005 file - promoters50/4769366
actacaaattcc

SEQ ID NO: 190733 - DNA, 9 bp, Unknown
  misc_feature (1)..( 9): Result.005 file - promoters50/4769366
acaactact

SEQ ID NO: 190734 - DNA, 9 bp, Unknown
  misc_feature (1)..( 9): Result.005 file - promoters50/4769366
acaactaag

SEQ ID NO: 190735 - DNA, 9 bp, Unknown
  misc_feature (1)..( 9): Result.005 file - promoters50/4769366
aaaactaag

SEQ ID NO: 190736 - DNA, 14 bp, Unknown
  misc_feature (1)..( 14): Result.005 file - promoters50/4769366
ttcttatttaaacg

SEQ ID NO: 190737 - DNA, 14 bp, Unknown
  misc_feature (1)..( 14): Result.005 file - promoters50/4769366
ttcctattaaaacc

SEQ ID NO: 190738 - DNA, 14 bp, Unknown
  misc_feature (1)..( 14): Result.005 file - promoters50/4769366
tctgttataaaacc

SEQ ID NO: 190739 - DNA, 9 bp, Unknown
  misc_feature (1)..( 9): Result.005 file - promoters50/4769384
ttatttatt

SEQ ID NO: 190740 - DNA, 9 bp, Unknown
  misc_feature (1)..( 9): Result.005 file - promoters50/4769384
gtatatata

SEQ ID NO: 190741 - DNA, 9 bp, Unknown
  misc_feature (1)..( 9): Result.005 file - promoters50/4769384
gtatataac

SEQ ID NO: 190742 - DNA, 9 bp, Unknown
  misc_feature (1)..( 9): Result.005 file - promoters50/4769384
gtataaata

SEQ ID NO: 190743 - DNA, 9 bp, Unknown
  misc_feature (1)..( 9): Result.005 file - promoters50/4769407
atattttca

SEQ ID NO: 190744 - DNA, 9 bp, Unknown
  misc_feature (1)..( 9): Result.005 file - promoters50/4769407
acattttca

SEQ ID NO: 190745 - DNA, 9 bp, Unknown
  misc_feature (1)..( 9): Result.005 file - promoters50/4769407
atattttta

SEQ ID NO: 190746 - DNA, 12 bp, Unknown
  misc_feature (1)..( 12): Result.005 file - promoters50/4769411
aagaaagtgttt

SEQ ID NO: 190747 - DNA, 12 bp, Unknown
  misc_feature (1)..( 12): Result.005 file - promoters50/4769411
attaaattgtga

SEQ ID NO: 190748 - DNA, 12 bp, Unknown
  misc_feature (1)..( 12): Result.005 file - promoters50/4769411
atagaagtcttt

SEQ ID NO: 190749 - DNA, 12 bp, Unknown
  misc_feature (1)..( 12): Result.005 file - promoters50/4769411
attaaattaatt

SEQ ID NO: 190750 - DNA, 12 bp, Unknown
  misc_feature (1)..( 12): Result.005 file - promoters50/4769411
gagaaattgagg

SEQ ID NO: 190751 - DNA, 12 bp, Unknown
  misc_feature (1)..( 12): Result.005 file - promoters50/4769411
gaaaaattaaca

SEQ ID NO: 190752 - DNA, 12 bp, Unknown
  misc_feature (1)..( 12): Result.005 file - promoters50/4769411
ttttaaaataaa

SEQ ID NO: 190753 - DNA, 12 bp, Unknown
  misc_feature (1)..( 12): Result.005 file - promoters50/4769411
cattaaattaat

SEQ ID NO: 190754 - DNA, 12 bp, Unknown
  misc_feature (1)..( 12): Result.005 file - promoters50/4769411
ttttaaagaacc

SEQ ID NO: 190755 - DNA, 12 bp, Unknown
  misc_feature (1)..( 12): Result.005 file - promoters50/4769411
tgtaaaaagaaa

SEQ ID NO: 190756 - DNA, 12 bp, Unknown
  misc_feature (1)..( 12): Result.005 file - promoters50/4769411
tgtattattaat

SEQ ID NO: 190757 - DNA, 12 bp, Unknown
  misc_feature (1)..( 12): Result.005 file - promoters50/4769411
tatgcaatcaat

SEQ ID NO: 190758 - DNA, 7 bp, Unknown
  misc_feature (1)..( 7): Result.005 file - promoters50/4769413
tttattt

SEQ ID NO: 190759 - DNA, 7 bp, Unknown
  misc_feature (1)..( 7): Result.005 file - promoters50/4769413
tttgttt

SEQ ID NO: 190760 - DNA, 7 bp, Unknown
  misc_feature (1)..( 7): Result.005 file - promoters50/4769413
tttgtta

SEQ ID NO: 190761 - DNA, 12 bp, Unknown
  misc_feature (1)..( 12): Result.005 file - promoters50/4769420
ccaaattatttt

SEQ ID NO: 190762 - DNA, 12 bp, Unknown
  misc_feature (1)..( 12): Result.005 file - promoters50/4769420
aaaaagtatttt

SEQ ID NO: 190763 - DNA, 12 bp, Unknown
  misc_feature (1)..( 12): Result.005 file - promoters50/4769420
aaaaagtaaaca

SEQ ID NO: 190764 - DNA, 9 bp, Unknown
  misc_feature (1)..( 9): Result.005 file - promoters50/4769741
aaaaatgaa

SEQ ID NO: 190765 - DNA, 9 bp, Unknown
  misc_feature (1)..( 9): Result.005 file - promoters50/4769741
aaaaatcac

SEQ ID NO: 190766 - DNA, 9 bp, Unknown
  misc_feature (1)..( 9): Result.005 file - promoters50/4769741
aaaaaaaaa

SEQ ID NO: 190767 - DNA, 9 bp, Unknown
  misc_feature (1)..( 9): Result.005 file - promoters50/4769741
cataccaaa

SEQ ID NO: 190768 - DNA, 9 bp, Unknown
  misc_feature (1)..( 9): Result.005 file - promoters50/4769741
atcaccaaa

SEQ ID NO: 190769 - DNA, 9 bp, Unknown
  misc_feature (1)..( 9): Result.005 file - promoters50/4769741
atcatcaat

SEQ ID NO: 190770 - DNA, 13 bp, Unknown
  misc_feature (1)..( 13): Result.005 file - promoters50/4770260
gttccctttatca

SEQ ID NO: 190771 - DNA, 13 bp, Unknown
  misc_feature (1)..( 13): Result.005 file - promoters50/4770260
attccatttctac

SEQ ID NO: 190772 - DNA, 13 bp, Unknown
  misc_feature (1)..( 13): Result.005 file - promoters50/4770260
gttcgcttgagga

SEQ ID NO: 190773 - DNA, 10 bp, Unknown
  misc_feature (1)..( 10): Result.005 file - promoters50/4770260
ccatttaaat

SEQ ID NO: 190774 - DNA, 13 bp, Unknown
  misc_feature (1)..( 13): Result.005 file - promoters50/4770260
ttagcattaaaat

SEQ ID NO: 190775 - DNA, 13 bp, Unknown
  misc_feature (1)..( 13): Result.005 file - promoters50/4770260
cgttttgtaaaat

SEQ ID NO: 190776 - DNA, 13 bp, Unknown
  misc_feature (1)..( 13): Result.005 file - promoters50/4770260
acttcaaagaaaa

SEQ ID NO: 190777 - DNA, 13 bp, Unknown
  misc_feature (1)..( 13): Result.005 file - promoters50/4770260
gtttcaaatgaac

SEQ ID NO: 190778 - DNA, 13 bp, Unknown
  misc_feature (1)..( 13): Result.005 file - promoters50/4770260
aattcaaaccttc

SEQ ID NO: 190779 - DNA, 13 bp, Unknown
  misc_feature (1)..( 13): Result.005 file - promoters50/4770260
tcatcaaacaaaa

SEQ ID NO: 190780 - DNA, 13 bp, Unknown
  misc_feature (1)..( 13): Result.005 file - promoters50/4770260
atttgaaatagta

SEQ ID NO: 190781 - DNA, 13 bp, Unknown
  misc_feature (1)..( 13): Result.005 file - promoters50/4770260
atttgaattgtga

SEQ ID NO: 190782 - DNA, 13 bp, Unknown
  misc_feature (1)..( 13): Result.005 file - promoters50/4770260
tgaggaaacaaat

SEQ ID NO: 190783 - DNA, 17 bp, Unknown
  misc_feature (1)..( 17): Result.005 file - promoters50/4770260
aattcttaaatttaaaa

SEQ ID NO: 190784 - DNA, 17 bp, Unknown
  misc_feature (1)..( 17): Result.005 file - promoters50/4770260
aattctaaaatcttcca

SEQ ID NO: 190785 - DNA, 17 bp, Unknown
  misc_feature (1)..( 17): Result.005 file - promoters50/4770260
caaactaaaatatcaac

SEQ ID NO: 190786 - DNA, 17 bp, Unknown
  misc_feature (1)..( 17): Result.005 file - promoters50/4770260
tgtggtaaaatttaccg

SEQ ID NO: 190787 - DNA, 17 bp, Unknown
  misc_feature (1)..( 17): Result.005 file - promoters50/4770260
ccaccatgaatgatttc

SEQ ID NO: 190788 - DNA, 17 bp, Unknown
  misc_feature (1)..( 17): Result.005 file - promoters50/4770260
ccttctaaggtcagtga

SEQ ID NO: 190789 - DNA, 13 bp, Unknown
  misc_feature (1)..( 13): Result.005 file - promoters50/4770264
tttcttaaaaaaa

SEQ ID NO: 190790 - DNA, 13 bp, Unknown
  misc_feature (1)..( 13): Result.005 file - promoters50/4770264
tttattaaaaaaa

SEQ ID NO: 190791 - DNA, 13 bp, Unknown
  misc_feature (1)..( 13): Result.005 file - promoters50/4770264
tttatttttagaa

SEQ ID NO: 190792 - DNA, 7 bp, Unknown
  misc_feature (1)..( 7): Result.005 file - promoters50/4770264
aaaatat

SEQ ID NO: 190793 - DNA, 7 bp, Unknown
  misc_feature (1)..( 7): Result.005 file - promoters50/4770264
aaaataa

SEQ ID NO: 190794 - DNA, 7 bp, Unknown
  misc_feature (1)..( 7): Result.005 file - promoters50/4770264
taaataa

SEQ ID NO: 190795 - DNA, 11 bp, Unknown
  misc_feature (1)..( 11): Result.005 file - promoters50/4770264
ttaaatatttc

SEQ ID NO: 190796 - DNA, 11 bp, Unknown
  misc_feature (1)..( 11): Result.005 file - promoters50/4770264
ttaattatttt

SEQ ID NO: 190797 - DNA, 11 bp, Unknown
  misc_feature (1)..( 11): Result.005 file - promoters50/4770264
ccaaatttttc

SEQ ID NO: 190798 - DNA, 11 bp, Unknown
  misc_feature (1)..( 11): Result.005 file - promoters50/4770264
gcaaatttagc

SEQ ID NO: 190799 - DNA, 9 bp, Unknown
  misc_feature (1)..( 9): Result.005 file - promoters50/4770264
gaatattat

SEQ ID NO: 190800 - DNA, 9 bp, Unknown
  misc_feature (1)..( 9): Result.005 file - promoters50/4770264
gaatatctt

SEQ ID NO: 190801 - DNA, 9 bp, Unknown
  misc_feature (1)..( 9): Result.005 file - promoters50/4770264
gaaaaaata

SEQ ID NO: 190802 - DNA, 9 bp, Unknown
  misc_feature (1)..( 9): Result.005 file - promoters50/4770264
gaaaaaatt

SEQ ID NO: 190803 - DNA, 7 bp, Unknown
  misc_feature (1)..( 7): Result.005 file - promoters50/4770264
attattt

SEQ ID NO: 190804 - DNA, 7 bp, Unknown
  misc_feature (1)..( 7): Result.005 file - promoters50/4770264
tttattt

SEQ ID NO: 190805 - DNA, 7 bp, Unknown
  misc_feature (1)..( 7): Result.005 file - promoters50/4770264
tttatta

SEQ ID NO: 190806 - DNA, 10 bp, Unknown
  misc_feature (1)..( 10): Result.005 file - promoters50/4770264
attgttataa

SEQ ID NO: 190807 - DNA, 10 bp, Unknown
  misc_feature (1)..( 10): Result.005 file - promoters50/4770264
atttttaaat

SEQ ID NO: 190808 - DNA, 10 bp, Unknown
  misc_feature (1)..( 10): Result.005 file - promoters50/4770264
agtttcaaat

SEQ ID NO: 190809 - DNA, 9 bp, Unknown
  misc_feature (1)..( 9): Result.005 file - promoters50/4770264
tcaaaaaat

SEQ ID NO: 190810 - DNA, 9 bp, Unknown
  misc_feature (1)..( 9): Result.005 file - promoters50/4770264
tgaaaaaat

SEQ ID NO: 190811 - DNA, 9 bp, Unknown
  misc_feature (1)..( 9): Result.005 file - promoters50/4770264
agaaaaaat

SEQ ID NO: 190812 - DNA, 9 bp, Unknown
  misc_feature (1)..( 9): Result.005 file - promoters50/4770264
tgaaagaat

SEQ ID NO: 190813 - DNA, 9 bp, Unknown
  misc_feature (1)..( 9): Result.005 file - promoters50/4770264
ccaaagaaa

SEQ ID NO: 190814 - DNA, 9 bp, Unknown
  misc_feature (1)..( 9): Result.005 file - promoters50/4770264
tgaaagaat

SEQ ID NO: 190815 - DNA, 9 bp, Unknown
  misc_feature (1)..( 9): Result.005 file - promoters50/4770264
tgaaaaaat

SEQ ID NO: 190816 - DNA, 8 bp, Unknown
  misc_feature (1)..( 8): Result.005 file - promoters50/4770264
gatatata

SEQ ID NO: 190817 - DNA, 8 bp, Unknown
  misc_feature (1)..( 8): Result.005 file - promoters50/4770264
gatgtatt

SEQ ID NO: 190818 - DNA, 8 bp, Unknown
  misc_feature (1)..( 8): Result.005 file - promoters50/4770264
tatggatt

SEQ ID NO: 190819 - DNA, 13 bp, Unknown
  misc_feature (1)..( 13): Result.005 file - promoters50/4770268
gattgttttgtat

SEQ ID NO: 190820 - DNA, 13 bp, Unknown
  misc_feature (1)..( 13): Result.005 file - promoters50/4770268
acaccttttgttg

SEQ ID NO: 190821 - DNA, 13 bp, Unknown
  misc_feature (1)..( 13): Result.005 file - promoters50/4770268
tatgtctttgtat

SEQ ID NO: 190822 - DNA, 13 bp, Unknown
  misc_feature (1)..( 13): Result.005 file - promoters50/4770268
aattattttgcta

SEQ ID NO: 190823 - DNA, 13 bp, Unknown
  misc_feature (1)..( 13): Result.005 file - promoters50/4770268
gtacgatttgtta

SEQ ID NO: 190824 - DNA, 13 bp, Unknown
  misc_feature (1)..( 13): Result.005 file - promoters50/4770268
aattattctcaag

SEQ ID NO: 190825 - DNA, 15 bp, Unknown
  misc_feature (1)..( 15): Result.005 file - promoters50/4770268
gggttttattttttg

SEQ ID NO: 190826 - DNA, 15 bp, Unknown
  misc_feature (1)..( 15): Result.005 file - promoters50/4770268
gaaatttattctgaa

SEQ ID NO: 190827 - DNA, 15 bp, Unknown
  misc_feature (1)..( 15): Result.005 file - promoters50/4770268
ctagtttattgttac

SEQ ID NO: 190828 - DNA, 15 bp, Unknown
  misc_feature (1)..( 15): Result.005 file - promoters50/4770268
gaattttgtttttga

SEQ ID NO: 190829 - DNA, 15 bp, Unknown
  misc_feature (1)..( 15): Result.005 file - promoters50/4770268
gttttttgtgcccca

SEQ ID NO: 190830 - DNA, 15 bp, Unknown
  misc_feature (1)..( 15): Result.005 file - promoters50/4770268
caaattgattttgat

SEQ ID NO: 190831 - DNA, 13 bp, Unknown
  misc_feature (1)..( 13): Result.005 file - promoters50/4770268
ttaattattaaag

SEQ ID NO: 190832 - DNA, 13 bp, Unknown
  misc_feature (1)..( 13): Result.005 file - promoters50/4770268
taaattatgttat

SEQ ID NO: 190833 - DNA, 13 bp, Unknown
  misc_feature (1)..( 13): Result.005 file - promoters50/4770268
tagtttattgtta

SEQ ID NO: 190834 - DNA, 13 bp, Unknown
  misc_feature (1)..( 13): Result.005 file - promoters50/4770268
aaaattatcagtc

SEQ ID NO: 190835 - DNA, 13 bp, Unknown
  misc_feature (1)..( 13): Result.005 file - promoters50/4770268
tgaattttgtttt

SEQ ID NO: 190836 - DNA, 13 bp, Unknown
  misc_feature (1)..( 13): Result.005 file - promoters50/4770268
tcgttttttgtgc

SEQ ID NO: 190837 - DNA, 13 bp, Unknown
  misc_feature (1)..( 13): Result.005 file - promoters50/4770268
ttgattttgataa

SEQ ID NO: 190838 - DNA, 13 bp, Unknown
  misc_feature (1)..( 13): Result.005 file - promoters50/4770274
gataatatacaat

SEQ ID NO: 190839 - DNA, 13 bp, Unknown
  misc_feature (1)..( 13): Result.005 file - promoters50/4770274
gattttatataat

SEQ ID NO: 190840 - DNA, 13 bp, Unknown
  misc_feature (1)..( 13): Result.005 file - promoters50/4770274
ttacatatacatt

SEQ ID NO: 190841 - DNA, 13 bp, Unknown
  misc_feature (1)..( 13): Result.005 file - promoters50/4770274
atagatatacttt

SEQ ID NO: 190842 - DNA, 13 bp, Unknown
  misc_feature (1)..( 13): Result.006 file - promoters50/4770274
tttaatataacgg

SEQ ID NO: 190843 - DNA, 13 bp, Unknown
  misc_feature (1)..( 13): Result.006 file - promoters50/4770274
gggatgatacatt

SEQ ID NO: 190844 - DNA, 11 bp, Unknown
  misc_feature (1)..( 11): Result.006 file - promoters50/4770274
gataatataca

SEQ ID NO: 190845 - DNA, 11 bp, Unknown
  misc_feature (1)..( 11): Result.006 file - promoters50/4770274
aatactatatg

SEQ ID NO: 190846 - DNA, 11 bp, Unknown
  misc_feature (1)..( 11): Result.006 file - promoters50/4770274
ttacatataca

SEQ ID NO: 190847 - DNA, 11 bp, Unknown
  misc_feature (1)..( 11): Result.006 file - promoters50/4770274
gatgatacatt

SEQ ID NO: 190848 - DNA, 11 bp, Unknown
  misc_feature (1)..( 11): Result.006 file - promoters50/4770274
tttaatataac

SEQ ID NO: 190849 - DNA, 11 bp, Unknown
  misc_feature (1)..( 11): Result.006 file - promoters50/4770274
atagatatact

SEQ ID NO: 190850 - DNA, 10 bp, Unknown
  misc_feature (1)..( 10): Result.006 file - promoters50/4770274
gataataaaa

SEQ ID NO: 190851 - DNA, 10 bp, Unknown
  misc_feature (1)..( 10): Result.006 file - promoters50/4770274
aagaataaac

SEQ ID NO: 190852 - DNA, 10 bp, Unknown
  misc_feature (1)..( 10): Result.006 file - promoters50/4770274
taaaataaaa

SEQ ID NO: 190853 - DNA, 10 bp, Unknown
  misc_feature (1)..( 10): Result.006 file - promoters50/4770274
aagtataaat

SEQ ID NO: 190854 - DNA, 10 bp, Unknown
  misc_feature (1)..( 10): Result.006 file - promoters50/4770274
acaaataaaa

SEQ ID NO: 190855 - DNA, 10 bp, Unknown
  misc_feature (1)..( 10): Result.006 file - promoters50/4770278
atatataata

SEQ ID NO: 190856 - DNA, 11 bp, Unknown
  misc_feature (1)..( 11): Result.006 file - promoters50/4770278
aaagatatttg

SEQ ID NO: 190857 - DNA, 11 bp, Unknown
  misc_feature (1)..( 11): Result.006 file - promoters50/4770278
aaatataatcg

SEQ ID NO: 190858 - DNA, 11 bp, Unknown
  misc_feature (1)..( 11): Result.006 file - promoters50/4770278
aaaggtattta

SEQ ID NO: 190859 - DNA, 11 bp, Unknown
  misc_feature (1)..( 11): Result.006 file - promoters50/4770278
caatgtagtta

SEQ ID NO: 190860 - DNA, 11 bp, Unknown
  misc_feature (1)..( 11): Result.006 file - promoters50/4770278
taatgtatttg

SEQ ID NO: 190861 - DNA, 11 bp, Unknown
  misc_feature (1)..( 11): Result.006 file - promoters50/4770278
ctttgtttttc

SEQ ID NO: 190862 - DNA, 11 bp, Unknown
  misc_feature (1)..( 11): Result.006 file - promoters50/4770278
ctatctttttc

SEQ ID NO: 190863 - DNA, 13 bp, Unknown
  misc_feature (1)..( 13): Result.006 file - promoters50/4770278
aaagatatttgta

SEQ ID NO: 190864 - DNA, 13 bp, Unknown
  misc_feature (1)..( 13): Result.006 file - promoters50/4770278
taatgtatttgtt

SEQ ID NO: 190865 - DNA, 13 bp, Unknown
  misc_feature (1)..( 13): Result.006 file - promoters50/4770278
aaaggtatttaag

SEQ ID NO: 190866 - DNA, 13 bp, Unknown
  misc_feature (1)..( 13): Result.006 file - promoters50/4770278
caatgtagttaga

SEQ ID NO: 190867 - DNA, 13 bp, Unknown
  misc_feature (1)..( 13): Result.006 file - promoters50/4770278
tgctttgtttttc

SEQ ID NO: 190868 - DNA, 13 bp, Unknown
  misc_feature (1)..( 13): Result.006 file - promoters50/4770288
ttctatctttttc

SEQ ID NO: 190869 - DNA, 12 bp, Unknown
  misc_feature (1)..( 12): Result.006 file - promoters50/4770288
ttcctaaacact

SEQ ID NO: 190870 - DNA, 12 bp, Unknown
  misc_feature (1)..( 12): Result.006 file - promoters50/4770288
taaataaacaaa

SEQ ID NO: 190871 - DNA, 12 bp, Unknown
  misc_feature (1)..( 12): Result.006 file - promoters50/4770288
aaattaaacaga

SEQ ID NO: 190872 - DNA, 11 bp, Unknown
  misc_feature (1)..( 11): Result.006 file - promoters50/4770288
tactaaactta

SEQ ID NO: 190873 - DNA, 11 bp, Unknown
  misc_feature (1)..( 11): Result.006 file - promoters50/4770288
cgataatcaaa

SEQ ID NO: 190874 - DNA, 11 bp, Unknown
  misc_feature (1)..( 11): Result.006 file - promoters50/4770288
taataaaaaac

SEQ ID NO: 190875 - DNA, 12 bp, Unknown
  misc_feature (1)..( 12): Result.006 file - promoters50/4770288
caatgaaagtag

SEQ ID NO: 190876 - DNA, 11 bp, Unknown
  misc_feature (1)..( 11): Result.006 file - promoters50/4770288
ttcaaacacaa

SEQ ID NO: 190877 - DNA, 11 bp, Unknown
  misc_feature (1)..( 11): Result.006 file - promoters50/4770288
aacaaacaaac

SEQ ID NO: 190878 - DNA, 11 bp, Unknown
  misc_feature (1)..( 11): Result.006 file - promoters50/4770288
aaaaaactcaa

SEQ ID NO: 190879 - DNA, 11 bp, Unknown
  misc_feature (1)..( 11): Result.006 file - promoters50/4770288
taaaaacaatg

SEQ ID NO: 190880 - DNA, 11 bp, Unknown
  misc_feature (1)..( 11): Result.006 file - promoters50/4770288
ttctaaccatt

SEQ ID NO: 190881 - DNA, 11 bp, Unknown
  misc_feature (1)..( 11): Result.006 file - promoters50/4770288
caaaaaccaca

SEQ ID NO: 190882 - DNA, 11 bp, Unknown
  misc_feature (1)..( 11): Result.006 file - promoters50/4770288
gaaaaaaaata

SEQ ID NO: 190883 - DNA, 11 bp, Unknown
  misc_feature (1)..( 11): Result.006 file - promoters50/4770288
aaaaaaaaatg

SEQ ID NO: 190884 - DNA, 16 bp, Unknown
  misc_feature (1)..( 16): Result.006 file - promoters50/4770288
tgcggatgaatatatg

SEQ ID NO: 190885 - DNA, 16 bp, Unknown
  misc_feature (1)..( 16): Result.006 file - promoters50/4770288
tatttcttaatataaa

SEQ ID NO: 190886 - DNA, 16 bp, Unknown
  misc_feature (1)..( 16): Result.006 file - promoters50/4770288
taaaatcaaataaatg

SEQ ID NO: 190887 - DNA, 16 bp, Unknown
  misc_feature (1)..( 16): Result.006 file - promoters50/4770288
aaccaatgaaaataac

SEQ ID NO: 190888 - DNA, 16 bp, Unknown
  misc_feature (1)..( 16): Result.006 file - promoters50/4770288
taaaagcaaataaata

SEQ ID NO: 190889 - DNA, 16 bp, Unknown
  misc_feature (1)..( 16): Result.006 file - promoters50/4770288
ttcaaccaattaaatt

SEQ ID NO: 190890 - DNA, 10 bp, Unknown
  misc_feature (1)..( 10): Result.006 file - promoters50/4770288
tcaaaaacca

SEQ ID NO: 190891 - DNA, 10 bp, Unknown
  misc_feature (1)..( 10): Result.006 file - promoters50/4770288
taaaaaactc

SEQ ID NO: 190892 - DNA, 10 bp, Unknown
  misc_feature (1)..( 10): Result.006 file - promoters50/4770288
ttaaaaacaa

SEQ ID NO: 190893 - DNA, 11 bp, Unknown
  misc_feature (1)..( 11): Result.006 file - promoters50/4770288
acaaacaactc

SEQ ID NO: 190894 - DNA, 11 bp, Unknown
  misc_feature (1)..( 11): Result.006 file - promoters50/4770288
caaacaaacag

SEQ ID NO: 190895 - DNA, 11 bp, Unknown
  misc_feature (1)..( 11): Result.006 file - promoters50/4770288
ggaaaaaaaat

SEQ ID NO: 190896 - DNA, 11 bp, Unknown
  misc_feature (1)..( 11): Result.006 file - promoters50/4770288
aaaaaaaaatg

SEQ ID NO: 190897 - DNA, 9 bp, Unknown
  misc_feature (1)..( 9): Result.006 file - promoters50/4770288
acaatgagg

SEQ ID NO: 190898 - DNA, 9 bp, Unknown
  misc_feature (1)..( 9): Result.006 file - promoters50/4770288
acaatgata

SEQ ID NO: 190899 - DNA, 9 bp, Unknown
  misc_feature (1)..( 9): Result.006 file - promoters50/4770288
acaatgaaa

SEQ ID NO: 190900 - DNA, 9 bp, Unknown
  misc_feature (1)..( 9): Result.006 file - promoters50/4770288
aaaatcaaa

SEQ ID NO: 190901 - DNA, 9 bp, Unknown
  misc_feature (1)..( 9): Result.006 file - promoters50/4770288
aaaataaaa

SEQ ID NO: 190902 - DNA, 9 bp, Unknown
  misc_feature (1)..( 9): Result.006 file - promoters50/4770288
ataatcaaa

SEQ ID NO: 190903 - DNA, 10 bp, Unknown
  misc_feature (1)..( 10): Result.006 file - promoters50/4770288
taaataaaca

SEQ ID NO: 190904 - DNA, 10 bp, Unknown
  misc_feature (1)..( 10): Result.006 file - promoters50/4770288
gtaataaaaa

SEQ ID NO: 190905 - DNA, 11 bp, Unknown
  misc_feature (1)..( 11): Result.006 file - promoters50/4770288
ttaattaaaaa

SEQ ID NO: 190906 - DNA, 11 bp, Unknown
  misc_feature (1)..( 11): Result.006 file - promoters50/4770288
ataatcaaaca

SEQ ID NO: 190907 - DNA, 11 bp, Unknown
  misc_feature (1)..( 11): Result.006 file - promoters50/4770288
caaaaaaaaat

SEQ ID NO: 190908 - DNA, 11 bp, Unknown
  misc_feature (1)..( 11): Result.006 file - promoters50/4770288
aatgttaaaaa

SEQ ID NO: 190909 - DNA, 12 bp, Unknown
  misc_feature (1)..( 12): Result.006 file - promoters50/4770288
ggaacaaacaaa

SEQ ID NO: 190910 - DNA, 12 bp, Unknown
  misc_feature (1)..( 12): Result.006 file - promoters50/4770288
ggaaaaaaaata

SEQ ID NO: 190911 - DNA, 12 bp, Unknown
  misc_feature (1)..( 12): Result.006 file - promoters50/4770288
caaacaaacagt

SEQ ID NO: 190912 - DNA, 12 bp, Unknown
  misc_feature (1)..( 12): Result.006 file - promoters50/4770288
ataaaaaactca

SEQ ID NO: 190913 - DNA, 12 bp, Unknown
  misc_feature (1)..( 12): Result.006 file - promoters50/4770288
ttaaaaacaatg

SEQ ID NO: 190914 - DNA, 12 bp, Unknown
  misc_feature (1)..( 12): Result.006 file - promoters50/4770305
caaaaaaaaatg

SEQ ID NO: 190915 - DNA, 11 bp, Unknown
  misc_feature (1)..( 11): Result.006 file - promoters50/4770305
aaagcactaca

SEQ ID NO: 190916 - DNA, 11 bp, Unknown
  misc_feature (1)..( 11): Result.006 file - promoters50/4770305
aaagaactata

SEQ ID NO: 190917 - DNA, 11 bp, Unknown
  misc_feature (1)..( 11): Result.006 file - promoters50/4770305
aaacaatatct

SEQ ID NO: 190918 - DNA, 11 bp, Unknown
  misc_feature (1)..( 11): Result.006 file - promoters50/4770305
catcaactatc

SEQ ID NO: 190919 - DNA, 11 bp, Unknown
  misc_feature (1)..( 11): Result.006 file - promoters50/4770305
tcagaattata

SEQ ID NO: 190920 - DNA, 11 bp, Unknown
  misc_feature (1)..( 11): Result.006 file - promoters50/4770333
aaagaaagatc

SEQ ID NO: 190921 - DNA, 17 bp, Unknown
  misc_feature (1)..( 17): Result.006 file - promoters50/4770333
gaaaaaaaaaaacagaa

SEQ ID NO: 190922 - DNA, 17 bp, Unknown
  misc_feature (1)..( 17): Result.006 file - promoters50/4770333
atatatttaaaacaatt

SEQ ID NO: 190923 - DNA, 17 bp, Unknown
  misc_feature (1)..( 17): Result.006 file - promoters50/4770333
gaaacaaagaaacatac

SEQ ID NO: 190924 - DNA, 17 bp, Unknown
  misc_feature (1)..( 17): Result.006 file - promoters50/4770333
tcatctctgaaacatat

SEQ ID NO: 190925 - DNA, 17 bp, Unknown
  misc_feature (1)..( 17): Result.006 file - promoters50/4770333
gactatagcaaagaatt

SEQ ID NO: 190926 - DNA, 17 bp, Unknown
  misc_feature (1)..( 17): Result.006 file - promoters50/4770367
aactcaaggaaaggagg

SEQ ID NO: 190927 - DNA, 11 bp, Unknown
  misc_feature (1)..( 11): Result.006 file - promoters50/4770367
ctttgattaaa

SEQ ID NO: 190928 - DNA, 11 bp, Unknown
  misc_feature (1)..( 11): Result.006 file - promoters50/4770367
cttttattaat

SEQ ID NO: 190929 - DNA, 11 bp, Unknown
  misc_feature (1)..( 11): Result.006 file - promoters50/4770367
gaaagatgaaa

SEQ ID NO: 190930 - DNA, 9 bp, Unknown
  misc_feature (1)..( 9): Result.006 file - promoters50/4770367
gcaaatagt

SEQ ID NO: 190931 - DNA, 9 bp, Unknown
  misc_feature (1)..( 9): Result.006 file - promoters50/4770367
gtaaacagt

SEQ ID NO: 190932 - DNA, 9 bp, Unknown
  misc_feature (1)..( 9): Result.006 file - promoters50/4770371
gtaaacaga

SEQ ID NO: 190933 - DNA, 9 bp, Unknown
  misc_feature (1)..( 9): Result.006 file - promoters50/4770371
gaaatagtt

SEQ ID NO: 190934 - DNA, 9 bp, Unknown
  misc_feature (1)..( 9): Result.006 file - promoters50/4770371
aaaattgtt

SEQ ID NO: 190935 - DNA, 9 bp, Unknown
  misc_feature (1)..( 9): Result.006 file - promoters50/4770371
taaaaagtt

SEQ ID NO: 190936 - DNA, 9 bp, Unknown
  misc_feature (1)..( 9): Result.006 file - promoters50/4770371
taaaaaaga

SEQ ID NO: 190937 - DNA, 10 bp, Unknown
  misc_feature (1)..( 10): Result.006 file - promoters50/4770371
taaaaagtaa

SEQ ID NO: 190938 - DNA, 10 bp, Unknown
  misc_feature (1)..( 10): Result.006 file - promoters50/4770371
gagaaaataa

SEQ ID NO: 190939 - DNA, 10 bp, Unknown
  misc_feature (1)..( 10): Result.006 file - promoters50/4770371
taaaaagtga

SEQ ID NO: 190940 - DNA, 8 bp, Unknown
  misc_feature (1)..( 8): Result.006 file - promoters50/4770371
taaaaagt

SEQ ID NO: 190941 - DNA, 8 bp, Unknown
  misc_feature (1)..( 8): Result.006 file - promoters50/4770371
taaaaaag

SEQ ID NO: 190942 - DNA, 8 bp, Unknown
  misc_feature (1)..( 8): Result.006 file - promoters50/4770371
taaaaagt

SEQ ID NO: 190943 - DNA, 13 bp, Unknown
  misc_feature (1)..( 13): Result.006 file - promoters50/4770371
aacgtaataaaaa

SEQ ID NO: 190944 - DNA, 13 bp, Unknown
  misc_feature (1)..( 13): Result.006 file - promoters50/4770371
aacataaaaaaaa

SEQ ID NO: 190945 - DNA, 13 bp, Unknown
  misc_feature (1)..( 13): Result.006 file - promoters50/4770371
ctctaaataaaaa

SEQ ID NO: 190946 - DNA, 10 bp, Unknown
  misc_feature (1)..( 10): Result.006 file - promoters50/4770371
taaaagcaaa

SEQ ID NO: 190947 - DNA, 10 bp, Unknown
  misc_feature (1)..( 10): Result.006 file - promoters50/4770371
taaaagaaaa

SEQ ID NO: 190948 - DNA, 10 bp, Unknown
  misc_feature (1)..( 10): Result.006 file - promoters50/4770371
aaaaagacca

SEQ ID NO: 190949 - DNA, 8 bp, Unknown
  misc_feature (1)..( 8): Result.006 file - promoters50/4770371
aaaaaaga

SEQ ID NO: 190950 - DNA, 8 bp, Unknown
  misc_feature (1)..( 8): Result.006 file - promoters50/4770371
aaaaaagt

SEQ ID NO: 190951 - DNA, 8 bp, Unknown
  misc_feature (1)..( 8): Result.006 file - promoters50/4770371
gaaaaaga

SEQ ID NO: 190952 - DNA, 7 bp, Unknown
  misc_feature (1)..( 7): Result.006 file - promoters50/4770371
ccaaaac

SEQ ID NO: 190953 - DNA, 7 bp, Unknown
  misc_feature (1)..( 7): Result.006 file - promoters50/4770371
ccaaaaa

SEQ ID NO: 190954 - DNA, 7 bp, Unknown
  misc_feature (1)..( 7): Result.006 file - promoters50/4770371
acaaaaa

SEQ ID NO: 190955 - DNA, 8 bp, Unknown
  misc_feature (1)..( 8): Result.006 file - promoters50/4770371
caaaacaa

SEQ ID NO: 190956 - DNA, 8 bp, Unknown
  misc_feature (1)..( 8): Result.006 file - promoters50/4770371
caaaccaa

SEQ ID NO: 190957 - DNA, 8 bp, Unknown
  misc_feature (1)..( 8): Result.006 file - promoters50/4770371
gaaaacaa

SEQ ID NO: 190958 - DNA, 8 bp, Unknown
  misc_feature (1)..( 8): Result.006 file - promoters50/4770371
atataata

SEQ ID NO: 190959 - DNA, 8 bp, Unknown
  misc_feature (1)..( 8): Result.006 file - promoters50/4770371
agataata

SEQ ID NO: 190960 - DNA, 8 bp, Unknown
  misc_feature (1)..( 8): Result.006 file - promoters50/4770371
agaaaatg

SEQ ID NO: 190961 - DNA, 9 bp, Unknown
  misc_feature (1)..( 9): Result.006 file - promoters50/4770371
atgtttgat

SEQ ID NO: 190962 - DNA, 9 bp, Unknown
  misc_feature (1)..( 9): Result.006 file - promoters50/4770371
atgtatgat

SEQ ID NO: 190963 - DNA, 9 bp, Unknown
  misc_feature (1)..( 9): Result.006 file - promoters50/4770371
atgtattat

SEQ ID NO: 190964 - DNA, 7 bp, Unknown
  misc_feature (1)..( 7): Result.006 file - promoters50/4770371
taataag

SEQ ID NO: 190965 - DNA, 7 bp, Unknown
  misc_feature (1)..( 7): Result.006 file - promoters50/4770371
taataat

SEQ ID NO: 190966 - DNA, 7 bp, Unknown
  misc_feature (1)..( 7): Result.006 file - promoters50/4770371
taagaat

SEQ ID NO: 190967 - DNA, 12 bp, Unknown
  misc_feature (1)..( 12): Result.006 file - promoters50/4770371
atggaaaatgat

SEQ ID NO: 190968 - DNA, 12 bp, Unknown
  misc_feature (1)..( 12): Result.006 file - promoters50/4770371
aaaaaaaaagat

SEQ ID NO: 190969 - DNA, 12 bp, Unknown
  misc_feature (1)..( 12): Result.006 file - promoters50/4770379
aaagaaaaaaaa

SEQ ID NO: 190970 - DNA, 10 bp, Unknown
  misc_feature (1)..( 10): Result.006 file - promoters50/4770379
tatataaaga

SEQ ID NO: 190971 - DNA, 10 bp, Unknown
  misc_feature (1)..( 10): Result.006 file - promoters50/4770379
aatataaaca

SEQ ID NO: 190972 - DNA, 10 bp, Unknown
  misc_feature (1)..( 10): Result.006 file - promoters50/4770379
tatatataca

SEQ ID NO: 190973 - DNA, 10 bp, Unknown
  misc_feature (1)..( 10): Result.006 file - promoters50/4770379
tatttaacgg

SEQ ID NO: 190974 - DNA, 10 bp, Unknown
  misc_feature (1)..( 10): Result.006 file - promoters50/4770379
catatatatc

SEQ ID NO: 190975 - DNA, 10 bp, Unknown
  misc_feature (1)..( 10): Result.006 file - promoters50/4770379
catattaaca

SEQ ID NO: 190976 - DNA, 8 bp, Unknown
  misc_feature (1)..( 8): Result.006 file - promoters50/4770379
aattttta

SEQ ID NO: 190977 - DNA, 8 bp, Unknown
  misc_feature (1)..( 8): Result.006 file - promoters50/4770379
ttttttta

SEQ ID NO: 190978 - DNA, 8 bp, Unknown
  misc_feature (1)..( 8): Result.006 file - promoters50/4770379
aatttttt

SEQ ID NO: 190979 - DNA, 9 bp, Unknown
  misc_feature (1)..( 9): Result.006 file - promoters50/4770379
cttttcttt

SEQ ID NO: 190980 - DNA, 9 bp, Unknown
  misc_feature (1)..( 9): Result.006 file - promoters50/4770379
tttttctta

SEQ ID NO: 190981 - DNA, 9 bp, Unknown
  misc_feature (1)..( 9): Result.006 file - promoters50/4770379
aatttatta

SEQ ID NO: 190982 - DNA, 14 bp, Unknown
  misc_feature (1)..( 14): Result.006 file - promoters50/4770379
tcagatatacattg

SEQ ID NO: 190983 - DNA, 14 bp, Unknown
  misc_feature (1)..( 14): Result.006 file - promoters50/4770379
ttttctataaatta

SEQ ID NO: 190984 - DNA, 14 bp, Unknown
  misc_feature (1)..( 14): Result.006 file - promoters50/4770379
acggatttacttga

SEQ ID NO: 190985 - DNA, 14 bp, Unknown
  misc_feature (1)..( 14): Result.006 file - promoters50/4770379
agagctaaaaacgg

SEQ ID NO: 190986 - DNA, 14 bp, Unknown
  misc_feature (1)..( 14): Result.006 file - promoters50/4770379
ttttttatagatta

SEQ ID NO: 190987 - DNA, 14 bp, Unknown
  misc_feature (1)..( 14): Result.006 file - promoters50/4770379
ccggttttgataat

SEQ ID NO: 190988 - DNA, 14 bp, Unknown
  misc_feature (1)..( 14): Result.006 file - promoters50/4770398
ctttatatagagac

SEQ ID NO: 190989 - DNA, 9 bp, Unknown
  misc_feature (1)..( 9): Result.006 file - promoters50/4770398
cttaatcat

SEQ ID NO: 190990 - DNA, 9 bp, Unknown
  misc_feature (1)..( 9): Result.006 file - promoters50/4770398
tctaagcat

SEQ ID NO: 190991 - DNA, 9 bp, Unknown
  misc_feature (1)..( 9): Result.006 file - promoters50/4770398
cttaatctt

SEQ ID NO: 190992 - DNA, 9 bp, Unknown
  misc_feature (1)..( 9): Result.006 file - promoters50/4770398
cccaatcat

SEQ ID NO: 190993 - DNA, 9 bp, Unknown
  misc_feature (1)..( 9): Result.006 file - promoters50/4770398
aacaatcac

SEQ ID NO: 190994 - DNA, 9 bp, Unknown
  misc_feature (1)..( 9): Result.006 file - promoters50/4770398
taaaatcat

SEQ ID NO: 190995 - DNA, 9 bp, Unknown
  misc_feature (1)..( 9): Result.006 file - promoters50/4770406
cacaatcaa

SEQ ID NO: 190996 - DNA, 9 bp, Unknown
  misc_feature (1)..( 9): Result.006 file - promoters50/4770406
taacaaaca

SEQ ID NO: 190997 - DNA, 9 bp, Unknown
  misc_feature (1)..( 9): Result.006 file - promoters50/4770406
taataaaca

SEQ ID NO: 190998 - DNA, 9 bp, Unknown
  misc_feature (1)..( 9): Result.006 file - promoters50/4770406
taataagta

SEQ ID NO: 190999 - DNA, 8 bp, Unknown
  misc_feature (1)..( 8): Result.006 file - promoters50/4770406
aacataaa

SEQ ID NO: 191000 - DNA, 8 bp, Unknown
  misc_feature (1)..( 8): Result.006 file - promoters50/4770406
aacacaaa

SEQ ID NO: 191001 - DNA, 8 bp, Unknown
  misc_feature (1)..( 8): Result.006 file - promoters50/4770406
aacataga

SEQ ID NO: 191002 - DNA, 6 bp, Unknown
  misc_feature (1)..( 6): Result.006 file - promoters50/4770406
tgtttt

SEQ ID NO: 191003 - DNA, 6 bp, Unknown
  misc_feature (1)..( 6): Result.006 file - promoters50/4770406
tgtttt

SEQ ID NO: 191004 - DNA, 6 bp, Unknown
  misc_feature (1)..( 6): Result.006 file - promoters50/4770414
tgtttt

SEQ ID NO: 191005 - DNA, 11 bp, Unknown
  misc_feature (1)..( 11): Result.006 file - promoters50/4770414
tcaaaacaaaa

SEQ ID NO: 191006 - DNA, 11 bp, Unknown
  misc_feature (1)..( 11): Result.006 file - promoters50/4770414
tcaacacaaaa

SEQ ID NO: 191007 - DNA, 11 bp, Unknown
  misc_feature (1)..( 11): Result.006 file - promoters50/4770414
gcaacaaattt

SEQ ID NO: 191008 - DNA, 8 bp, Unknown
  misc_feature (1)..( 8): Result.006 file - promoters50/4770414
atataaac

SEQ ID NO: 191009 - DNA, 8 bp, Unknown
  misc_feature (1)..( 8): Result.006 file - promoters50/4770414
ataaaaac

SEQ ID NO: 191010 - DNA, 8 bp, Unknown
  misc_feature (1)..( 8): Result.006 file - promoters50/4770428
ctataaaa

SEQ ID NO: 191011 - DNA, 11 bp, Unknown
  misc_feature (1)..( 11): Result.006 file - promoters50/4770428
agtttgtttga

SEQ ID NO: 191012 - DNA, 11 bp, Unknown
  misc_feature (1)..( 11): Result.006 file - promoters50/4770428
gttttggttga

SEQ ID NO: 191013 - DNA, 11 bp, Unknown
  misc_feature (1)..( 11): Result.006 file - promoters50/4770428
ggtttgtataa

SEQ ID NO: 191014 - DNA, 11 bp, Unknown
  misc_feature (1)..( 11): Result.006 file - promoters50/4770428
ggtgtgtattg

SEQ ID NO: 191015 - DNA, 11 bp, Unknown
  misc_feature (1)..( 11): Result.006 file - promoters50/4770428
gacgtgtattc

SEQ ID NO: 191016 - DNA, 11 bp, Unknown
  misc_feature (1)..( 11): Result.006 file - promoters50/4770439
actttgggtga

SEQ ID NO: 191017 - DNA, 10 bp, Unknown
  misc_feature (1)..( 10): Result.006 file - promoters50/4770439
atacaataat

SEQ ID NO: 191018 - DNA, 10 bp, Unknown
  misc_feature (1)..( 10): Result.006 file - promoters50/4770439
ttactataat

SEQ ID NO: 191019 - DNA, 10 bp, Unknown
  misc_feature (1)..( 10): Result.006 file - promoters50/4770439
atagaatgat

SEQ ID NO: 191020 - DNA, 7 bp, Unknown
  misc_feature (1)..( 7): Result.006 file - promoters50/4770439
cacaaac

SEQ ID NO: 191021 - DNA, 7 bp, Unknown
  misc_feature (1)..( 7): Result.006 file - promoters50/4770439
aacaaac

SEQ ID NO: 191022 - DNA, 7 bp, Unknown
  misc_feature (1)..( 7): Result.006 file - promoters50/4770443
aaccaac

SEQ ID NO: 191023 - DNA, 17 bp, Unknown
  misc_feature (1)..( 17): Result.006 file - promoters50/4770443
atttgtttatttccaat

SEQ ID NO: 191024 - DNA, 17 bp, Unknown
  misc_feature (1)..( 17): Result.006 file - promoters50/4770443
aaaaatttttttttaaa

SEQ ID NO: 191025 - DNA, 17 bp, Unknown
  misc_feature (1)..( 17): Result.006 file - promoters50/4770443
tatcgttgatttaataa

SEQ ID NO: 191026 - DNA, 17 bp, Unknown
  misc_feature (1)..( 17): Result.006 file - promoters50/4770443
aaatatttttttgtact

SEQ ID NO: 191027 - DNA, 17 bp, Unknown
  misc_feature (1)..( 17): Result.006 file - promoters50/4770443
gtcaactgatataataa

SEQ ID NO: 191028 - DNA, 17 bp, Unknown
  misc_feature (1)..( 17): Result.006 file - promoters50/4770447
aaaaattacggtagttt

SEQ ID NO: 191029 - DNA, 7 bp, Unknown
  misc_feature (1)..( 7): Result.006 file - promoters50/4770447
ttgttta

SEQ ID NO: 191030 - DNA, 7 bp, Unknown
  misc_feature (1)..( 7): Result.006 file - promoters50/4770447
ttgttta

SEQ ID NO: 191031 - DNA, 7 bp, Unknown
  misc_feature (1)..( 7): Result.006 file - promoters50/4770447
ttggtta

SEQ ID NO: 191032 - DNA, 13 bp, Unknown
  misc_feature (1)..( 13): Result.006 file - promoters50/4770447
tttacttgttggg

SEQ ID NO: 191033 - DNA, 13 bp, Unknown
  misc_feature (1)..( 13): Result.006 file - promoters50/4770447
ttttcttactaag

SEQ ID NO: 191034 - DNA, 13 bp, Unknown
  misc_feature (1)..( 13): Result.006 file - promoters50/4770466
ccttcttaccaag

SEQ ID NO: 191035 - DNA, 17 bp, Unknown
  misc_feature (1)..( 17): Result.006 file - promoters50/4770466
ttaacttatctcgattt

SEQ ID NO: 191036 - DNA, 17 bp, Unknown
  misc_feature (1)..( 17): Result.006 file - promoters50/4770466
gtcttatatttcgaaaa

SEQ ID NO: 191037 - DNA, 17 bp, Unknown
  misc_feature (1)..( 17): Result.006 file - promoters50/4770466
tagttttatgttttttt

SEQ ID NO: 191038 - DNA, 17 bp, Unknown
  misc_feature (1)..( 17): Result.006 file - promoters50/4770466
tgtctcaatgtttgttt

SEQ ID NO: 191039 - DNA, 9 bp, Unknown
  misc_feature (1)..( 9): Result.006 file - promoters50/4770466
ataataaat

SEQ ID NO: 191040 - DNA, 9 bp, Unknown
  misc_feature (1)..( 9): Result.006 file - promoters50/4770466
ttaacaaac

SEQ ID NO: 191041 - DNA, 9 bp, Unknown
  misc_feature (1)..( 9): Result.006 file - promoters50/4770466
ccaattaat

SEQ ID NO: 191042 - DNA, 9 bp, Unknown
  misc_feature (1)..( 9): Result.006 file - promoters50/4770466
ttaacaaaa

SEQ ID NO: 191043 - DNA, 13 bp, Unknown
  misc_feature (1)..( 13): Result.006 file - promoters50/4770466
aaacatttaatat

SEQ ID NO: 191044 - DNA, 13 bp, Unknown
  misc_feature (1)..( 13): Result.006 file - promoters50/4770466
aaagattaaaaat

SEQ ID NO: 191045 - DNA, 13 bp, Unknown
  misc_feature (1)..( 13): Result.006 file - promoters50/4770466
ccacattttatat

SEQ ID NO: 191046 - DNA, 13 bp, Unknown
  misc_feature (1)..( 13): Result.006 file - promoters50/4770481
taagatgaaatga

SEQ ID NO: 191047 - DNA, 14 bp, Unknown
  misc_feature (1)..( 14): Result.006 file - promoters50/4770481
agaataagcaaatc

SEQ ID NO: 191048 - DNA, 14 bp, Unknown
  misc_feature (1)..( 14): Result.006 file - promoters50/4770481
gtcatatgcaataa

SEQ ID NO: 191049 - DNA, 14 bp, Unknown
  misc_feature (1)..( 14): Result.006 file - promoters50/4770481
aaaatcagccagaa

SEQ ID NO: 191050 - DNA, 14 bp, Unknown
  misc_feature (1)..( 14): Result.006 file - promoters50/4770481
ttaaaaagtaaata

SEQ ID NO: 191051 - DNA, 14 bp, Unknown
  misc_feature (1)..( 14): Result.006 file - promoters50/4770481
tcgttatccaataa

SEQ ID NO: 191052 - DNA, 14 bp, Unknown
  misc_feature (1)..( 14): Result.006 file - promoters50/4770481
aatataaataatta

SEQ ID NO: 191053 - DNA, 11 bp, Unknown
  misc_feature (1)..( 11): Result.006 file - promoters50/4770481
gagaaacatgt

SEQ ID NO: 191054 - DNA, 11 bp, Unknown
  misc_feature (1)..( 11): Result.006 file - promoters50/4770481
atgaaacagag

SEQ ID NO: 191055 - DNA, 11 bp, Unknown
  misc_feature (1)..( 11): Result.006 file - promoters50/4770481
gagaaacgacg

SEQ ID NO: 191056 - DNA, 11 bp, Unknown
  misc_feature (1)..( 11): Result.006 file - promoters50/4770481
ataaaacattt

SEQ ID NO: 191057 - DNA, 11 bp, Unknown
  misc_feature (1)..( 11): Result.006 file - promoters50/4770481
ccaaaaaatgt

SEQ ID NO: 191058 - DNA, 11 bp, Unknown
  misc_feature (1)..( 11): Result.006 file - promoters50/4770481
acaaaacaaaa

SEQ ID NO: 191059 - DNA, 9 bp, Unknown
  misc_feature (1)..( 9): Result.006 file - promoters50/4770481
acagataac

SEQ ID NO: 191060 - DNA, 9 bp, Unknown
  misc_feature (1)..( 9): Result.006 file - promoters50/4770481
gcagatatt

SEQ ID NO: 191061 - DNA, 9 bp, Unknown
  misc_feature (1)..( 9): Result.006 file - promoters50/4770481
gcaaataca

SEQ ID NO: 191062 - DNA, 9 bp, Unknown
  misc_feature (1)..( 9): Result.006 file - promoters50/4770481
ccaaataaa

SEQ ID NO: 191063 - DNA, 9 bp, Unknown
  misc_feature (1)..( 9): Result.006 file - promoters50/4770481
tcaaataag

SEQ ID NO: 191064 - DNA, 9 bp, Unknown
  misc_feature (1)..( 9): Result.006 file - promoters50/4770499
tgtaataag

SEQ ID NO: 191065 - DNA, 8 bp, Unknown
  misc_feature (1)..( 8): Result.006 file - promoters50/4770499
tttttaat

SEQ ID NO: 191066 - DNA, 8 bp, Unknown
  misc_feature (1)..( 8): Result.006 file - promoters50/4770499
gttttaat

SEQ ID NO: 191067 - DNA, 9 bp, Unknown
  misc_feature (1)..( 9): Result.006 file - promoters50/4770499
ctttgtaac

SEQ ID NO: 191068 - DNA, 10 bp, Unknown
  misc_feature (1)..( 10): Result.006 file - promoters50/4770499
gattaaaatt

SEQ ID NO: 191069 - DNA, 10 bp, Unknown
  misc_feature (1)..( 10): Result.006 file - promoters50/4770499
aaataaaata

SEQ ID NO: 191070 - DNA, 10 bp, Unknown
  misc_feature (1)..( 10): Result.006 file - promoters50/4770562
aaatgaaata

SEQ ID NO: 191071 - DNA, 7 bp, Unknown
  misc_feature (1)..( 7): Result.006 file - promoters50/4770562
caacttg

SEQ ID NO: 191072 - DNA, 7 bp, Unknown
  misc_feature (1)..( 7): Result.006 file - promoters50/4770562
caaattg

SEQ ID NO: 191073 - DNA, 7 bp, Unknown
  misc_feature (1)..( 7): Result.006 file - promoters50/4770562
caacttc

SEQ ID NO: 191074 - DNA, 7 bp, Unknown
  misc_feature (1)..( 7): Result.006 file - promoters50/4770562
aaaatat

SEQ ID NO: 191075 - DNA, 7 bp, Unknown
  misc_feature (1)..( 7): Result.006 file - promoters50/4770562
aaaatag

SEQ ID NO: 191076 - DNA, 7 bp, Unknown
  misc_feature (1)..( 7): Result.006 file - promoters50/4770562
taaatat

SEQ ID NO: 191077 - DNA, 14 bp, Unknown
  misc_feature (1)..( 14): Result.006 file - promoters50/4770562
catactaaattgtt

SEQ ID NO: 191078 - DNA, 14 bp, Unknown
  misc_feature (1)..( 14): Result.006 file - promoters50/4770562
tctcttaatttggg

SEQ ID NO: 191079 - DNA, 14 bp, Unknown
  misc_feature (1)..( 14): Result.006 file - promoters50/4770562
acctgatattaggg

SEQ ID NO: 191080 - DNA, 14 bp, Unknown
  misc_feature (1)..( 14): Result.006 file - promoters50/4770562
aaaactgattttag

SEQ ID NO: 191081 - DNA, 12 bp, Unknown
  misc_feature (1)..( 12): Result.006 file - promoters50/4770562
gatctatcaaac

SEQ ID NO: 191082 - DNA, 12 bp, Unknown
  misc_feature (1)..( 12): Result.006 file - promoters50/4770562
aaaatatgaaaa

SEQ ID NO: 191083 - DNA, 12 bp, Unknown
  misc_feature (1)..( 12): Result.006 file - promoters50/4770562
aaaaaatgaaaa

SEQ ID NO: 191084 - DNA, 10 bp, Unknown
  misc_feature (1)..( 10): Result.006 file - promoters50/4770562
gatatataaa

SEQ ID NO: 191085 - DNA, 10 bp, Unknown
  misc_feature (1)..( 10): Result.006 file - promoters50/4770562
tatatttaaa

SEQ ID NO: 191086 - DNA, 10 bp, Unknown
  misc_feature (1)..( 10): Result.006 file - promoters50/4770562
tatgtttatt

SEQ ID NO: 191087 - DNA, 8 bp, Unknown
  misc_feature (1)..( 8): Result.006 file - promoters50/4770562
tatataaa

SEQ ID NO: 191088 - DNA, 8 bp, Unknown
  misc_feature (1)..( 8): Result.006 file - promoters50/4770562
tttataaa

SEQ ID NO: 191089 - DNA, 8 bp, Unknown
  misc_feature (1)..( 8): Result.006 file - promoters50/4770562
tatataat

SEQ ID NO: 191090 - DNA, 8 bp, Unknown
  misc_feature (1)..( 8): Result.006 file - promoters50/4770562
ccatgtaa

SEQ ID NO: 191091 - DNA, 8 bp, Unknown
  misc_feature (1)..( 8): Result.006 file - promoters50/4770562
gaatgtaa

SEQ ID NO: 191092 - DNA, 8 bp, Unknown
  misc_feature (1)..( 8): Result.006 file - promoters50/4770594
gaatgtac

SEQ ID NO: 191093 - DNA, 14 bp, Unknown
  misc_feature (1)..( 14): Result.006 file - promoters50/4770594
aaaatcattacaat

SEQ ID NO: 191094 - DNA, 14 bp, Unknown
  misc_feature (1)..( 14): Result.006 file - promoters50/4770594
ataatgattctttt

SEQ ID NO: 191095 - DNA, 14 bp, Unknown
  misc_feature (1)..( 14): Result.006 file - promoters50/4770594
caaaacattaaaat

SEQ ID NO: 191096 - DNA, 14 bp, Unknown
  misc_feature (1)..( 14): Result.006 file - promoters50/4770594
caaaacgaatacca

SEQ ID NO: 191097 - DNA, 14 bp, Unknown
  misc_feature (1)..( 14): Result.006 file - promoters50/4770594
aaaatctgtttacc

SEQ ID NO: 191098 - DNA, 14 bp, Unknown
  misc_feature (1)..( 14): Result.006 file - promoters50/4770594
caatacattcatgt

SEQ ID NO: 191099 - DNA, 14 bp, Unknown
  misc_feature (1)..( 14): Result.006 file - promoters50/4770594
caaaataataataa

SEQ ID NO: 191100 - DNA, 14 bp, Unknown
  misc_feature (1)..( 14): Result.006 file - promoters50/4770594
cgaaaccgaaagaa

SEQ ID NO: 191101 - DNA, 14 bp, Unknown
  misc_feature (1)..( 14): Result.006 file - promoters50/4770594
aaatcattacaata

SEQ ID NO: 191102 - DNA, 14 bp, Unknown
  misc_feature (1)..( 14): Result.006 file - promoters50/4770594
cttactttataatg

SEQ ID NO: 191103 - DNA, 14 bp, Unknown
  misc_feature (1)..( 14): Result.006 file - promoters50/4770594
aaaacattaaaatc

SEQ ID NO: 191104 - DNA, 14 bp, Unknown
  misc_feature (1)..( 14): Result.006 file - promoters50/4770594
aaacgaataccata

SEQ ID NO: 191105 - DNA, 14 bp, Unknown
  misc_feature (1)..( 14): Result.006 file - promoters50/4770594
aacgttttacaata

SEQ ID NO: 191106 - DNA, 14 bp, Unknown
  misc_feature (1)..( 14): Result.006 file - promoters50/4770594
gtgacttcatagag

SEQ ID NO: 191107 - DNA, 14 bp, Unknown
  misc_feature (1)..( 14): Result.006 file - promoters50/4770594
taaacttcaaaacc

SEQ ID NO: 191108 - DNA, 11 bp, Unknown
  misc_feature (1)..( 11): Result.006 file - promoters50/4770594
atatatgaaac

SEQ ID NO: 191109 - DNA, 11 bp, Unknown
  misc_feature (1)..( 11): Result.006 file - promoters50/4770594
atttattaaat

SEQ ID NO: 191110 - DNA, 11 bp, Unknown
  misc_feature (1)..( 11): Result.006 file - promoters50/4770594
atatctgaaat

SEQ ID NO: 191111 - DNA, 11 bp, Unknown
  misc_feature (1)..( 11): Result.006 file - promoters50/4770594
gttttttacta

SEQ ID NO: 191112 - DNA, 11 bp, Unknown
  misc_feature (1)..( 11): Result.006 file - promoters50/4770594
tttgcttttaa

SEQ ID NO: 191113 - DNA, 11 bp, Unknown
  misc_feature (1)..( 11): Result.006 file - promoters50/4770594
aaaccttaaat

SEQ ID NO: 191114 - DNA, 11 bp, Unknown
  misc_feature (1)..( 11): Result.006 file - promoters50/4770604
atatatgatgc

SEQ ID NO: 191115 - DNA, 8 bp, Unknown
  misc_feature (1)..( 8): Result.006 file - promoters50/4770604
tatattaa

SEQ ID NO: 191116 - DNA, 8 bp, Unknown
  misc_feature (1)..( 8): Result.006 file - promoters50/4770604
tatattct

SEQ ID NO: 191117 - DNA, 8 bp, Unknown
  misc_feature (1)..( 8): Result.006 file - promoters50/4770604
tatactaa

SEQ ID NO: 191118 - DNA, 8 bp, Unknown
  misc_feature (1)..( 8): Result.006 file - promoters50/4770604
gatattac

SEQ ID NO: 191119 - DNA, 13 bp, Unknown
  misc_feature (1)..( 13): Result.006 file - promoters50/4770604
tgaaattcacatt

SEQ ID NO: 191120 - DNA, 13 bp, Unknown
  misc_feature (1)..( 13): Result.006 file - promoters50/4770604
aatcattaacaaa

SEQ ID NO: 191121 - DNA, 13 bp, Unknown
  misc_feature (1)..( 13): Result.006 file - promoters50/4770604
cctcaataagttc

SEQ ID NO: 191122 - DNA, 13 bp, Unknown
  misc_feature (1)..( 13): Result.006 file - promoters50/4770604
aatgattaagaaa

SEQ ID NO: 191123 - DNA, 13 bp, Unknown
  misc_feature (1)..( 13): Result.006 file - promoters50/4770604
aatgatttcattt

SEQ ID NO: 191124 - DNA, 9 bp, Unknown
  misc_feature (1)..( 9): Result.006 file - promoters50/4770604
aaattttaa

SEQ ID NO: 191125 - DNA, 9 bp, Unknown
  misc_feature (1)..( 9): Result.006 file - promoters50/4770604
gtattttac

SEQ ID NO: 191126 - DNA, 9 bp, Unknown
  misc_feature (1)..( 9): Result.006 file - promoters50/4770604
ctattttta

SEQ ID NO: 191127 - DNA, 9 bp, Unknown
  misc_feature (1)..( 9): Result.006 file - promoters50/4770604
ctattttta

SEQ ID NO: 191128 - DNA, 10 bp, Unknown
  misc_feature (1)..( 10): Result.006 file - promoters50/4770604
ggcaaaggaa

SEQ ID NO: 191129 - DNA, 10 bp, Unknown
  misc_feature (1)..( 10): Result.006 file - promoters50/4770604
caaaaatgaa

SEQ ID NO: 191130 - DNA, 10 bp, Unknown
  misc_feature (1)..( 10): Result.006 file - promoters50/4770604
caaaaaagaa

SEQ ID NO: 191131 - DNA, 10 bp, Unknown
  misc_feature (1)..( 10): Result.006 file - promoters50/4770604
gtaaaataaa

SEQ ID NO: 191132 - DNA, 10 bp, Unknown
  misc_feature (1)..( 10): Result.006 file - promoters50/4770604
caaatattag

SEQ ID NO: 191133 - DNA, 10 bp, Unknown
  misc_feature (1)..( 10): Result.006 file - promoters50/4770604
gaaatattct

SEQ ID NO: 191134 - DNA, 10 bp, Unknown
  misc_feature (1)..( 10): Result.006 file - promoters50/4770604
aacataatct

SEQ ID NO: 191135 - DNA, 10 bp, Unknown
  misc_feature (1)..( 10): Result.006 file - promoters50/4770604
gaaataaaag

SEQ ID NO: 191136 - DNA, 10 bp, Unknown
  misc_feature (1)..( 10): Result.006 file - promoters50/4770604
attaaaatat

SEQ ID NO: 191137 - DNA, 10 bp, Unknown
  misc_feature (1)..( 10): Result.006 file - promoters50/4770604
tttataattg

SEQ ID NO: 191138 - DNA, 10 bp, Unknown
  misc_feature (1)..( 10): Result.006 file - promoters50/4770604
gctataattg

SEQ ID NO: 191139 - DNA, 10 bp, Unknown
  misc_feature (1)..( 10): Result.006 file - promoters50/4770620
tttatactca

SEQ ID NO: 191140 - DNA, 11 bp, Unknown
  misc_feature (1)..( 11): Result.006 file - promoters50/4770620
atcataaataa

SEQ ID NO: 191141 - DNA, 11 bp, Unknown
  misc_feature (1)..( 11): Result.006 file - promoters50/4770620
atcatcaatct

SEQ ID NO: 191142 - DNA, 11 bp, Unknown
  misc_feature (1)..( 11): Result.006 file - promoters50/4770620
cggataaatta

SEQ ID NO: 191143 - DNA, 11 bp, Unknown
  misc_feature (1)..( 11): Result.006 file - promoters50/4770620
ttcttaaattt

SEQ ID NO: 191144 - DNA, 11 bp, Unknown
  misc_feature (1)..( 11): Result.006 file - promoters50/4770620
attttaaatta

SEQ ID NO: 191145 - DNA, 11 bp, Unknown
  misc_feature (1)..( 11): Result.006 file - promoters50/4770620
tctgaaaatta

SEQ ID NO: 191146 - DNA, 10 bp, Unknown
  misc_feature (1)..( 10): Result.006 file - promoters50/4770620
taaataagat

SEQ ID NO: 191147 - DNA, 10 bp, Unknown
  misc_feature (1)..( 10): Result.006 file - promoters50/4770620
aaaataatat

SEQ ID NO: 191148 - DNA, 10 bp, Unknown
  misc_feature (1)..( 10): Result.006 file - promoters50/4770620
aaaatatcaa

SEQ ID NO: 191149 - DNA, 10 bp, Unknown
  misc_feature (1)..( 10): Result.006 file - promoters50/4770620
gaaagatctg

SEQ ID NO: 191150 - DNA, 10 bp, Unknown
  misc_feature (1)..( 10): Result.006 file - promoters50/4770620
aaaatacaaa

SEQ ID NO: 191151 - DNA, 10 bp, Unknown
  misc_feature (1)..( 10): Result.006 file - promoters50/4770620
taaattacaa

SEQ ID NO: 191152 - DNA, 14 bp, Unknown
  misc_feature (1)..( 14): Result.006 file - promoters50/4770620
aacattaatataaa

SEQ ID NO: 191153 - DNA, 14 bp, Unknown
  misc_feature (1)..( 14): Result.006 file - promoters50/4770620
ttcttaaatttaaa

SEQ ID NO: 191154 - DNA, 14 bp, Unknown
  misc_feature (1)..( 14): Result.006 file - promoters50/4770620
ttacaaaatacaaa

SEQ ID NO: 191155 - DNA, 14 bp, Unknown
  misc_feature (1)..( 14): Result.006 file - promoters50/4770620
atcaatctttcaaa

SEQ ID NO: 191156 - DNA, 14 bp, Unknown
  misc_feature (1)..( 14): Result.006 file - promoters50/4770620
ttgacattttcaac

SEQ ID NO: 191157 - DNA, 14 bp, Unknown
  misc_feature (1)..( 14): Result.006 file - promoters50/4770620
tctgaaaattagga

SEQ ID NO: 191158 - DNA, 14 bp, Unknown
  misc_feature (1)..( 14): Result.006 file - promoters50/4770620
cggataaattacaa

SEQ ID NO: 191159 - DNA, 16 bp, Unknown
  misc_feature (1)..( 16): Result.006 file - promoters50/4770620
agataaattgtctccg

SEQ ID NO: 191160 - DNA, 16 bp, Unknown
  misc_feature (1)..( 16): Result.006 file - promoters50/4770620
acacaaaatgtctccg

SEQ ID NO: 191161 - DNA, 16 bp, Unknown
  misc_feature (1)..( 16): Result.006 file - promoters50/4770620
cttggatttgtctaag

SEQ ID NO: 191162 - DNA, 16 bp, Unknown
  misc_feature (1)..( 16): Result.006 file - promoters50/4770620
aagcaaattgttttct

SEQ ID NO: 191163 - DNA, 16 bp, Unknown
  misc_feature (1)..( 16): Result.006 file - promoters50/4770620
ctttaatttgtctttg

SEQ ID NO: 191164 - DNA, 16 bp, Unknown
  misc_feature (1)..( 16): Result.006 file - promoters50/4770620
acataatctccacctg

SEQ ID NO: 191165 - DNA, 10 bp, Unknown
  misc_feature (1)..( 10): Result.006 file - promoters50/4770620
attccatttc

SEQ ID NO: 191166 - DNA, 10 bp, Unknown
  misc_feature (1)..( 10): Result.006 file - promoters50/4770620
gttcccttta

SEQ ID NO: 191167 - DNA, 10 bp, Unknown
  misc_feature (1)..( 10): Result.006 file - promoters50/4770620
atttcatagt

SEQ ID NO: 191168 - DNA, 10 bp, Unknown
  misc_feature (1)..( 10): Result.006 file - promoters50/4770620
gttcgcttga

SEQ ID NO: 191169 - DNA, 10 bp, Unknown
  misc_feature (1)..( 10): Result.006 file - promoters50/4770620
tttccatttt

SEQ ID NO: 191170 - DNA, 10 bp, Unknown
  misc_feature (1)..( 10): Result.006 file - promoters50/4770624
cctacatttt

SEQ ID NO: 191171 - DNA, 13 bp, Unknown
  misc_feature (1)..( 13): Result.006 file - promoters50/4770624
aaacttaaaagta

SEQ ID NO: 191172 - DNA, 13 bp, Unknown
  misc_feature (1)..( 13): Result.006 file - promoters50/4770624
aaacataagatcc

SEQ ID NO: 191173 - DNA, 14 bp, Unknown
  misc_feature (1)..( 14): Result.006 file - promoters50/4770624
gatcttcaaattgt

SEQ ID NO: 191174 - DNA, 14 bp, Unknown
  misc_feature (1)..( 14): Result.006 file - promoters50/4770624
agttgaaaaaaata

SEQ ID NO: 191175 - DNA, 13 bp, Unknown
  misc_feature (1)..( 13): Result.006 file - promoters50/4770624
acttaaaagtaga

SEQ ID NO: 191176 - DNA, 13 bp, Unknown
  misc_feature (1)..( 13): Result.006 file - promoters50/4770624
tgaaaaaaatagc

SEQ ID NO: 191177 - DNA, 13 bp, Unknown
  misc_feature (1)..( 13): Result.006 file - promoters50/4770624
atgcaaacataag

SEQ ID NO: 191178 - DNA, 13 bp, Unknown
  misc_feature (1)..( 13): Result.006 file - promoters50/4770647
atgaaaacaaaag

SEQ ID NO: 191179 - DNA, 8 bp, Unknown
  misc_feature (1)..( 8): Result.006 file - promoters50/4770647
taagacgg

SEQ ID NO: 191180 - DNA, 8 bp, Unknown
  misc_feature (1)..( 8): Result.006 file - promoters50/4770647
taaaacgt

SEQ ID NO: 191181 - DNA, 8 bp, Unknown
  misc_feature (1)..( 8): Result.006 file - promoters50/4770651
taaaacgg

SEQ ID NO: 191182 - DNA, 9 bp, Unknown
  misc_feature (1)..( 9): Result.006 file - promoters50/4770651
ttaccaaac

SEQ ID NO: 191183 - DNA, 9 bp, Unknown
  misc_feature (1)..( 9): Result.006 file - promoters50/4770651
atacaaaac

SEQ ID NO: 191184 - DNA, 9 bp, Unknown
  misc_feature (1)..( 9): Result.006 file - promoters50/4770651
ccacaaaag

SEQ ID NO: 191185 - DNA, 9 bp, Unknown
  misc_feature (1)..( 9): Result.006 file - promoters50/4770651
atagaaaca

SEQ ID NO: 191186 - DNA, 9 bp, Unknown
  misc_feature (1)..( 9): Result.006 file - promoters50/4770651
caacatttt

SEQ ID NO: 191187 - DNA, 9 bp, Unknown
  misc_feature (1)..( 9): Result.006 file - promoters50/4770651
caatattta

SEQ ID NO: 191188 - DNA, 9 bp, Unknown
  misc_feature (1)..( 9): Result.006 file - promoters50/4770651
caaaatttt

SEQ ID NO: 191189 - DNA, 8 bp, Unknown
  misc_feature (1)..( 8): Result.006 file - promoters50/4770651
tattttgt

SEQ ID NO: 191190 - DNA, 8 bp, Unknown
  misc_feature (1)..( 8): Result.006 file - promoters50/4770651
tgttttgt

SEQ ID NO: 191191 - DNA, 8 bp, Unknown
  misc_feature (1)..( 8): Result.006 file - promoters50/4770651
tgttttga

SEQ ID NO: 191192 - DNA, 8 bp, Unknown
  misc_feature (1)..( 8): Result.006 file - promoters50/4770651
tgttttac

SEQ ID NO: 191193 - DNA, 14 bp, Unknown
  misc_feature (1)..( 14): Result.006 file - promoters50/4770651
cggcaaaatatttt

SEQ ID NO: 191194 - DNA, 14 bp, Unknown
  misc_feature (1)..( 14): Result.006 file - promoters50/4770651
aatcaaaatattat

SEQ ID NO: 191195 - DNA, 14 bp, Unknown
  misc_feature (1)..( 14): Result.006 file - promoters50/4770651
aatcaaaattttat

SEQ ID NO: 191196 - DNA, 8 bp, Unknown
  misc_feature (1)..( 8): Result.006 file - promoters50/4770651
atcgaaat

SEQ ID NO: 191197 - DNA, 8 bp, Unknown
  misc_feature (1)..( 8): Result.006 file - promoters50/4770651
atcaaaat

SEQ ID NO: 191198 - DNA, 8 bp, Unknown
  misc_feature (1)..( 8): Result.006 file - promoters50/4770651
aacaaaat

SEQ ID NO: 191199 - DNA, 9 bp, Unknown
  misc_feature (1)..( 9): Result.006 file - promoters50/4770651
tattttaac

SEQ ID NO: 191200 - DNA, 9 bp, Unknown
  misc_feature (1)..( 9): Result.006 file - promoters50/4770651
aattataac

SEQ ID NO: 191201 - DNA, 9 bp, Unknown
  misc_feature (1)..( 9): Result.006 file - promoters50/4770651
cattttttc

SEQ ID NO: 191202 - DNA, 14 bp, Unknown
  misc_feature (1)..( 14): Result.006 file - promoters50/4770651
ttttgtaatttttt

SEQ ID NO: 191203 - DNA, 14 bp, Unknown
  misc_feature (1)..( 14): Result.006 file - promoters50/4770651
aatcaaaattttat

SEQ ID NO: 191204 - DNA, 14 bp, Unknown
  misc_feature (1)..( 14): Result.006 file - promoters50/4770651
aatcaaaatattat

SEQ ID NO: 191205 - DNA, 8 bp, Unknown
  misc_feature (1)..( 8): Result.006 file - promoters50/4770651
tctcatta

SEQ ID NO: 191206 - DNA, 8 bp, Unknown
  misc_feature (1)..( 8): Result.006 file - promoters50/4770651
tctaattt

SEQ ID NO: 191207 - DNA, 8 bp, Unknown
  misc_feature (1)..( 8): Result.006 file - promoters50/4770651
actaattt

SEQ ID NO: 191208 - DNA, 10 bp, Unknown
  misc_feature (1)..( 10): Result.006 file - promoters50/4770651
attaaatccg

SEQ ID NO: 191209 - DNA, 10 bp, Unknown
  misc_feature (1)..( 10): Result.006 file - promoters50/4770651
atttaatata

SEQ ID NO: 191210 - DNA, 10 bp, Unknown
  misc_feature (1)..( 10): Result.006 file - promoters50/4770651
aattaatata

SEQ ID NO: 191211 - DNA, 9 bp, Unknown
  misc_feature (1)..( 9): Result.006 file - promoters50/4770651
ataattaaa

SEQ ID NO: 191212 - DNA, 9 bp, Unknown
  misc_feature (1)..( 9): Result.006 file - promoters50/4770651
ataatcaaa

SEQ ID NO: 191213 - DNA, 9 bp, Unknown
  misc_feature (1)..( 9): Result.006 file - promoters50/4770651
agaatcaaa

SEQ ID NO: 191214 - DNA, 10 bp, Unknown
  misc_feature (1)..( 10): Result.006 file - promoters50/4770651
caaaaattaa

SEQ ID NO: 191215 - DNA, 10 bp, Unknown
  misc_feature (1)..( 10): Result.006 file - promoters50/4770651
caaaatttat

SEQ ID NO: 191216 - DNA, 10 bp, Unknown
  misc_feature (1)..( 10): Result.006 file - promoters50/4770659
tctaatttat

SEQ ID NO: 191217 - DNA, 7 bp, Unknown
  misc_feature (1)..( 7): Result.006 file - promoters50/4770659
agtatat

SEQ ID NO: 191218 - DNA, 7 bp, Unknown
  misc_feature (1)..( 7): Result.006 file - promoters50/4770659
tgtatat

SEQ ID NO: 191219 - DNA, 7 bp, Unknown
  misc_feature (1)..( 7): Result.006 file - promoters50/4770659
agtatat

SEQ ID NO: 191220 - DNA, 10 bp, Unknown
  misc_feature (1)..( 10): Result.006 file - promoters50/4770659
aaactaagaa

SEQ ID NO: 191221 - DNA, 10 bp, Unknown
  misc_feature (1)..( 10): Result.006 file - promoters50/4770659
aaaataaata

SEQ ID NO: 191222 - DNA, 10 bp, Unknown
  misc_feature (1)..( 10): Result.006 file - promoters50/4770659
acaatagata

SEQ ID NO: 191223 - DNA, 8 bp, Unknown
  misc_feature (1)..( 8): Result.006 file - promoters50/4770659
tttagata

SEQ ID NO: 191224 - DNA, 8 bp, Unknown
  misc_feature (1)..( 8): Result.006 file - promoters50/4770659
aatagata

SEQ ID NO: 191225 - DNA, 8 bp, Unknown
  misc_feature (1)..( 8): Result.006 file - promoters50/4770666
aataaata

SEQ ID NO: 191226 - DNA, 7 bp, Unknown
  misc_feature (1)..( 7): Result.006 file - promoters50/4770666
gtggatt

SEQ ID NO: 191227 - DNA, 7 bp, Unknown
  misc_feature (1)..( 7): Result.006 file - promoters50/4770666
ttggatt

SEQ ID NO: 191228 - DNA, 7 bp, Unknown
  misc_feature (1)..( 7): Result.006 file - promoters50/4770666
ttgcatt

SEQ ID NO: 191229 - DNA, 7 bp, Unknown
  misc_feature (1)..( 7): Result.006 file - promoters50/4770666
atatttg

SEQ ID NO: 191230 - DNA, 7 bp, Unknown
  misc_feature (1)..( 7): Result.006 file - promoters50/4770666
ataattg

SEQ ID NO: 191231 - DNA, 7 bp, Unknown
  misc_feature (1)..( 7): Result.006 file - promoters50/4770880
ataattc

SEQ ID NO: 191232 - DNA, 12 bp, Unknown
  misc_feature (1)..( 12): Result.006 file - promoters50/4770880
tggcttttgcat

SEQ ID NO: 191233 - DNA, 12 bp, Unknown
  misc_feature (1)..( 12): Result.006 file - promoters50/4770880
caaatttttcat

SEQ ID NO: 191234 - DNA, 12 bp, Unknown
  misc_feature (1)..( 12): Result.006 file - promoters50/4770880
aatatttaaatc

SEQ ID NO: 191235 - DNA, 7 bp, Unknown
  misc_feature (1)..( 7): Result.006 file - promoters50/4770880
gatttta

SEQ ID NO: 191236 - DNA, 7 bp, Unknown
  misc_feature (1)..( 7): Result.006 file - promoters50/4770880
gattttt

SEQ ID NO: 191237 - DNA, 7 bp, Unknown
  misc_feature (1)..( 7): Result.006 file - promoters50/4770880
aatttta

SEQ ID NO: 191238 - DNA, 10 bp, Unknown
  misc_feature (1)..( 10): Result.006 file - promoters50/4770880
aatgagatta

SEQ ID NO: 191239 - DNA, 10 bp, Unknown
  misc_feature (1)..( 10): Result.006 file - promoters50/4770880
aatgagatca

SEQ ID NO: 191240 - DNA, 10 bp, Unknown
  misc_feature (1)..( 10): Result.006 file - promoters50/4770880
atggagctta

SEQ ID NO: 191241 - DNA, 8 bp, Unknown
  misc_feature (1)..( 8): Result.006 file - promoters50/4770880
atccatag

SEQ ID NO: 191242 - DNA, 8 bp, Unknown
  misc_feature (1)..( 8): Result.006 file - promoters50/4770880
atccatct

SEQ ID NO: 191243 - DNA, 8 bp, Unknown
  misc_feature (1)..( 8): Result.006 file - promoters50/4770880
ttccttct

SEQ ID NO: 191244 - DNA, 9 bp, Unknown
  misc_feature (1)..( 9): Result.006 file - promoters50/4770880
aactaaaga

SEQ ID NO: 191245 - DNA, 9 bp, Unknown
  misc_feature (1)..( 9): Result.006 file - promoters50/4770880
aaccaaaaa

SEQ ID NO: 191246 - DNA, 9 bp, Unknown
  misc_feature (1)..( 9): Result.006 file - promoters50/4770880
cactaaaga

SEQ ID NO: 191247 - DNA, 12 bp, Unknown
  misc_feature (1)..( 12): Result.006 file - promoters50/4770880
tgaaatgataat

SEQ ID NO: 191248 - DNA, 12 bp, Unknown
  misc_feature (1)..( 12): Result.006 file - promoters50/4770880
tgatatgtgttt

SEQ ID NO: 191249 - DNA, 12 bp, Unknown
  misc_feature (1)..( 12): Result.006 file - promoters50/4770880
ggatatgtattt

SEQ ID NO: 191250 - DNA, 8 bp, Unknown
  misc_feature (1)..( 8): Result.006 file - promoters50/4770880
ttaaattt

SEQ ID NO: 191251 - DNA, 8 bp, Unknown
  misc_feature (1)..( 8): Result.006 file - promoters50/4770880
ttaacttt

SEQ ID NO: 191252 - DNA, 8 bp, Unknown
  misc_feature (1)..( 8): Result.006 file - promoters50/4770880
ttagcttt

SEQ ID NO: 191253 - DNA, 6 bp, Unknown
  misc_feature (1)..( 6): Result.006 file - promoters50/4770880
caaatt

SEQ ID NO: 191254 - DNA, 6 bp, Unknown
  misc_feature (1)..( 6): Result.006 file - promoters50/4770880
caaatt

SEQ ID NO: 191255 - DNA, 6 bp, Unknown
  misc_feature (1)..( 6): Result.006 file - promoters50/4770880
caaatt

SEQ ID NO: 191256 - DNA, 7 bp, Unknown
  misc_feature (1)..( 7): Result.006 file - promoters50/4770880
tcatatt

SEQ ID NO: 191257 - DNA, 7 bp, Unknown
  misc_feature (1)..( 7): Result.006 file - promoters50/4770880
tcaaatt

SEQ ID NO: 191258 - DNA, 7 bp, Unknown
  misc_feature (1)..( 7): Result.006 file - promoters50/4771231
ccaaatt

SEQ ID NO: 191259 - DNA, 12 bp, Unknown
  misc_feature (1)..( 12): Result.006 file - promoters50/4771231
tttttgtttttt

SEQ ID NO: 191260 - DNA, 12 bp, Unknown
  misc_feature (1)..( 12): Result.006 file - promoters50/4771231
tttatgtttttt

SEQ ID NO: 191261 - DNA, 12 bp, Unknown
  misc_feature (1)..( 12): Result.006 file - promoters50/4771245
cgtatgtattta

SEQ ID NO: 191262 - DNA, 8 bp, Unknown
  misc_feature (1)..( 8): Result.006 file - promoters50/4771245
atatttat

SEQ ID NO: 191263 - DNA, 8 bp, Unknown
  misc_feature (1)..( 8): Result.006 file - promoters50/4771245
atatttgt

SEQ ID NO: 191264 - DNA, 8 bp, Unknown
  misc_feature (1)..( 8): Result.006 file - promoters50/4771245
gtatctgt

SEQ ID NO: 191265 - DNA, 8 bp, Unknown
  misc_feature (1)..( 8): Result.006 file - promoters50/4771245
tatcagtt

SEQ ID NO: 191266 - DNA, 8 bp, Unknown
  misc_feature (1)..( 8): Result.006 file - promoters50/4771245
tatctgtt

SEQ ID NO: 191267 - DNA, 8 bp, Unknown
  misc_feature (1)..( 8): Result.006 file - promoters50/4771252
tatttgta

SEQ ID NO: 191268 - DNA, 10 bp, Unknown
  misc_feature (1)..( 10): Result.006 file - promoters50/4771252
taaggagaaa

SEQ ID NO: 191269 - DNA, 10 bp, Unknown
  misc_feature (1)..( 10): Result.006 file - promoters50/4771252
aaaggataaa

SEQ ID NO: 191270 - DNA, 10 bp, Unknown
  misc_feature (1)..( 10): Result.006 file - promoters50/4771255
aaagaataat

SEQ ID NO: 191271 - DNA, 8 bp, Unknown
  misc_feature (1)..( 8): Result.006 file - promoters50/4771255
tttgttga

SEQ ID NO: 191272 - DNA, 8 bp, Unknown
  misc_feature (1)..( 8): Result.006 file - promoters50/4771255
tttgatga

SEQ ID NO: 191273 - DNA, 8 bp, Unknown
  misc_feature (1)..( 8): Result.006 file - promoters50/4771255
tttgttta

SEQ ID NO: 191274 - DNA, 14 bp, Unknown
  misc_feature (1)..( 14): Result.006 file - promoters50/4771255
attttgtctctttc

SEQ ID NO: 191275 - DNA, 14 bp, Unknown
  misc_feature (1)..( 14): Result.006 file - promoters50/4771255
attttatctttttc

SEQ ID NO: 191276 - DNA, 14 bp, Unknown
  misc_feature (1)..( 14): Result.006 file - promoters50/4771255
attttaaagttatc

SEQ ID NO: 191277 - DNA, 12 bp, Unknown
  misc_feature (1)..( 12): Result.006 file - promoters50/4771255
ctttattttaat

SEQ ID NO: 191278 - DNA, 12 bp, Unknown
  misc_feature (1)..( 12): Result.006 file - promoters50/4771255
tcttatttcaat

SEQ ID NO: 191279 - DNA, 12 bp, Unknown
  misc_feature (1)..( 12): Result.006 file - promoters50/4771271
tctgattaaatc

SEQ ID NO: 191280 - DNA, 10 bp, Unknown
  misc_feature (1)..( 10): Result.006 file - promoters50/4771271
gtattattag

SEQ ID NO: 191281 - DNA, 10 bp, Unknown
  misc_feature (1)..( 10): Result.006 file - promoters50/4771271
ttataattat

SEQ ID NO: 191282 - DNA, 10 bp, Unknown
  misc_feature (1)..( 10): Result.006 file - promoters50/4771271
attggattaa

SEQ ID NO: 191283 - DNA, 10 bp, Unknown
  misc_feature (1)..( 10): Result.006 file - promoters50/4771271
ctatgatttc

SEQ ID NO: 191284 - DNA, 10 bp, Unknown
  misc_feature (1)..( 10): Result.006 file - promoters50/4771271
gtattattat

SEQ ID NO: 191285 - DNA, 10 bp, Unknown
  misc_feature (1)..( 10): Result.006 file - promoters50/4771278
ttataaggcc

SEQ ID NO: 191286 - DNA, 10 bp, Unknown
  misc_feature (1)..( 10): Result.006 file - promoters50/4771278
aaaatcgaca

SEQ ID NO: 191287 - DNA, 10 bp, Unknown
  misc_feature (1)..( 10): Result.006 file - promoters50/4771278
aaaatcacta

SEQ ID NO: 191288 - DNA, 10 bp, Unknown
  misc_feature (1)..( 10): Result.006 file - promoters50/4771282
caaatcgaca

SEQ ID NO: 191289 - DNA, 9 bp, Unknown
  misc_feature (1)..( 9): Result.006 file - promoters50/4771282
tattctcta

SEQ ID NO: 191290 - DNA, 9 bp, Unknown
  misc_feature (1)..( 9): Result.006 file - promoters50/4771282
tattcttac

SEQ ID NO: 191291 - DNA, 9 bp, Unknown
  misc_feature (1)..( 9): Result.006 file - promoters50/4771286
aatttttac

SEQ ID NO: 191292 - DNA, 8 bp, Unknown
  misc_feature (1)..( 8): Result.006 file - promoters50/4771286
actataaa

SEQ ID NO: 191293 - DNA, 8 bp, Unknown
  misc_feature (1)..( 8): Result.006 file - promoters50/4771286
tttataaa

SEQ ID NO: 191294 - DNA, 8 bp, Unknown
  misc_feature (1)..( 8): Result.006 file - promoters50/4771286
tatataaa

SEQ ID NO: 191295 - DNA, 8 bp, Unknown
  misc_feature (1)..( 8): Result.006 file - promoters50/4771286
tatataaa

SEQ ID NO: 191296 - DNA, 8 bp, Unknown
  misc_feature (1)..( 8): Result.006 file - promoters50/4771286
tatataat

SEQ ID NO: 191297 - DNA, 8 bp, Unknown
  misc_feature (1)..( 8): Result.006 file - promoters50/4771286
tatataaa

SEQ ID NO: 191298 - DNA, 8 bp, Unknown
  misc_feature (1)..( 8): Result.006 file - promoters50/4771286
tatataaa

SEQ ID NO: 191299 - DNA, 8 bp, Unknown
  misc_feature (1)..( 8): Result.006 file - promoters50/4771286
catatata

SEQ ID NO: 191300 - DNA, 11 bp, Unknown
  misc_feature (1)..( 11): Result.006 file - promoters50/4771286
tcattttaaat

SEQ ID NO: 191301 - DNA, 11 bp, Unknown
  misc_feature (1)..( 11): Result.006 file - promoters50/4771286
aattttgaaag

SEQ ID NO: 191302 - DNA, 11 bp, Unknown
  misc_feature (1)..( 11): Result.006 file - promoters50/4771286
tagtttgaatc

SEQ ID NO: 191303 - DNA, 12 bp, Unknown
  misc_feature (1)..( 12): Result.006 file - promoters50/4771286
taagcattaaat

SEQ ID NO: 191304 - DNA, 11 bp, Unknown
  misc_feature (1)..( 11): Result.006 file - promoters50/4771286
aattttgatga

SEQ ID NO: 191305 - DNA, 12 bp, Unknown
  misc_feature (1)..( 12): Result.006 file - promoters50/4771286
acctttcgatgt

SEQ ID NO: 191306 - DNA, 20 bp, Unknown
  misc_feature (1)..( 20): Result.006 file - promoters50/4771286
gttaaactgttagtgcaagc

SEQ ID NO: 191307 - DNA, 20 bp, Unknown
  misc_feature (1)..( 20): Result.006 file - promoters50/4771286
ataaaaatgttagataggaa

SEQ ID NO: 191308 - DNA, 20 bp, Unknown
  misc_feature (1)..( 20): Result.006 file - promoters50/4771286
tcataaattttaaaattatt

SEQ ID NO: 191309 - DNA, 20 bp, Unknown
  misc_feature (1)..( 20): Result.006 file - promoters50/4771286
atataaatacgaccaaaaaa

SEQ ID NO: 191310 - DNA, 20 bp, Unknown
  misc_feature (1)..( 20): Result.006 file - promoters50/4771286
ttacttgtgttaaatatgaa

SEQ ID NO: 191311 - DNA, 20 bp, Unknown
  misc_feature (1)..( 20): Result.006 file - promoters50/4771286
aagcccattataaatacata

SEQ ID NO: 191312 - DNA, 20 bp, Unknown
  misc_feature (1)..( 20): Result.006 file - promoters50/4771286
aaatagatttgaaaaacaga

SEQ ID NO: 191313 - DNA, 18 bp, Unknown
  misc_feature (1)..( 18): Result.006 file - promoters50/4771286
tcatcgatcctcgtcaac

SEQ ID NO: 191314 - DNA, 18 bp, Unknown
  misc_feature (1)..( 18): Result.006 file - promoters50/4771286
tcacgcatccgcgtttca

SEQ ID NO: 191315 - DNA, 18 bp, Unknown
  misc_feature (1)..( 18): Result.006 file - promoters50/4771286
tcatcaatcctcgtgaaa

SEQ ID NO: 191316 - DNA, 18 bp, Unknown
  misc_feature (1)..( 18): Result.006 file - promoters50/4771286
acagcgatccgcgtagtt

SEQ ID NO: 191317 - DNA, 18 bp, Unknown
  misc_feature (1)..( 18): Result.006 file - promoters50/4771286
acatcgatccgcgtgatt

SEQ ID NO: 191318 - DNA, 18 bp, Unknown
  misc_feature (1)..( 18): Result.006 file - promoters50/4771286
ttcacccggatcgttatc

SEQ ID NO: 191319 - DNA, 8 bp, Unknown
  misc_feature (1)..( 8): Result.006 file - promoters50/4771286
atatatat

SEQ ID NO: 191320 - DNA, 8 bp, Unknown
  misc_feature (1)..( 8): Result.006 file - promoters50/4771286
atacataa

SEQ ID NO: 191321 - DNA, 8 bp, Unknown
  misc_feature (1)..( 8): Result.006 file - promoters50/4771286
atagattt

SEQ ID NO: 191322 - DNA, 8 bp, Unknown
  misc_feature (1)..( 8): Result.006 file - promoters50/4771286
ataaattt

SEQ ID NO: 191323 - DNA, 8 bp, Unknown
  misc_feature (1)..( 8): Result.006 file - promoters50/4771286
aaaaagag

SEQ ID NO: 191324 - DNA, 8 bp, Unknown
  misc_feature (1)..( 8): Result.006 file - promoters50/4771325
taagattt

SEQ ID NO: 191325 - DNA, 7 bp, Unknown
  misc_feature (1)..( 7): Result.006 file - promoters50/4771325
gaaaaaa

SEQ ID NO: 191326 - DNA, 7 bp, Unknown
  misc_feature (1)..( 7): Result.006 file - promoters50/4771325
gaagaaa

SEQ ID NO: 191327 - DNA, 7 bp, Unknown
  misc_feature (1)..( 7): Result.006 file - promoters50/4771325
caaaaaa

SEQ ID NO: 191328 - DNA, 7 bp, Unknown
  misc_feature (1)..( 7): Result.006 file - promoters50/4771325
aagaaag

SEQ ID NO: 191329 - DNA, 7 bp, Unknown
  misc_feature (1)..( 7): Result.006 file - promoters50/4771325
aagaaat

SEQ ID NO: 191330 - DNA, 7 bp, Unknown
  misc_feature (1)..( 7): Result.006 file - promoters50/4771325
gagaaat

SEQ ID NO: 191331 - DNA, 12 bp, Unknown
  misc_feature (1)..( 12): Result.006 file - promoters50/4771325
atatttgtattg

SEQ ID NO: 191332 - DNA, 12 bp, Unknown
  misc_feature (1)..( 12): Result.006 file - promoters50/4771325
tcatttgcattg

SEQ ID NO: 191333 - DNA, 12 bp, Unknown
  misc_feature (1)..( 12): Result.006 file - promoters50/4771325
atatttgacagc

SEQ ID NO: 191334 - DNA, 9 bp, Unknown
  misc_feature (1)..( 9): Result.006 file - promoters50/4771325
ttttaattg

SEQ ID NO: 191335 - DNA, 9 bp, Unknown
  misc_feature (1)..( 9): Result.006 file - promoters50/4771325
gtttagttg

SEQ ID NO: 191336 - DNA, 9 bp, Unknown
  misc_feature (1)..( 9): Result.006 file - promoters50/4771330
gttttgttc

SEQ ID NO: 191337 - DNA, 10 bp, Unknown
  misc_feature (1)..( 10): Result.006 file - promoters50/4771330
aagaggaaga

SEQ ID NO: 191338 - DNA, 10 bp, Unknown
  misc_feature (1)..( 10): Result.006 file - promoters50/4771330
ctgaggaaag

SEQ ID NO: 191339 - DNA, 10 bp, Unknown
  misc_feature (1)..( 10): Result.006 file - promoters50/4771330
aggatgaaga

SEQ ID NO: 191340 - DNA, 6 bp, Unknown
  misc_feature (1)..( 6): Result.006 file - promoters50/4771330
gaagag

SEQ ID NO: 191341 - DNA, 6 bp, Unknown
  misc_feature (1)..( 6): Result.006 file - promoters50/4771330
gaagag

SEQ ID NO: 191342 - DNA, 6 bp, Unknown
  misc_feature (1)..( 6): Result.006 file - promoters50/4771330
gaagag

SEQ ID NO: 191343 - DNA, 10 bp, Unknown
  misc_feature (1)..( 10): Result.006 file - promoters50/4771330
gagaggcttg

SEQ ID NO: 191344 - DNA, 10 bp, Unknown
  misc_feature (1)..( 10): Result.006 file - promoters50/4771330
aagaggattg

SEQ ID NO: 191345 - DNA, 10 bp, Unknown
  misc_feature (1)..( 10): Result.006 file - promoters50/4771330
aagatgatgt

SEQ ID NO: 191346 - DNA, 9 bp, Unknown
  misc_feature (1)..( 9): Result.006 file - promoters50/4771330
aaaaagagt

SEQ ID NO: 191347 - DNA, 9 bp, Unknown
  misc_feature (1)..( 9): Result.006 file - promoters50/4771330
aaaaaggcc

SEQ ID NO: 191348 - DNA, 9 bp, Unknown
  misc_feature (1)..( 9): Result.006 file - promoters50/4771334
ttaaaggag

SEQ ID NO: 191349 - DNA, 11 bp, Unknown
  misc_feature (1)..( 11): Result.006 file - promoters50/4771334
taaaaaatatt

SEQ ID NO: 191350 - DNA, 11 bp, Unknown
  misc_feature (1)..( 11): Result.006 file - promoters50/4771334
caaagaataaa

SEQ ID NO: 191351 - DNA, 11 bp, Unknown
  misc_feature (1)..( 11): Result.006 file - promoters50/4771334
caaaacatata

SEQ ID NO: 191352 - DNA, 11 bp, Unknown
  misc_feature (1)..( 11): Result.006 file - promoters50/4771334
taaaaaagtgt

SEQ ID NO: 191353 - DNA, 11 bp, Unknown
  misc_feature (1)..( 11): Result.006 file - promoters50/4771334
taataaatttt

SEQ ID NO: 191354 - DNA, 11 bp, Unknown
  misc_feature (1)..( 11): Result.006 file - promoters50/4771334
cagaaaatatt

SEQ ID NO: 191355 - DNA, 11 bp, Unknown
  misc_feature (1)..( 11): Result.006 file - promoters50/4771334
aaaaaaaaaag

SEQ ID NO: 191356 - DNA, 18 bp, Unknown
  misc_feature (1)..( 18): Result.006 file - promoters50/4771334
gtgcttccaacaaatgca

SEQ ID NO: 191357 - DNA, 18 bp, Unknown
  misc_feature (1)..( 18): Result.006 file - promoters50/4771334
ttgcttctcccaagcgat

SEQ ID NO: 191358 - DNA, 18 bp, Unknown
  misc_feature (1)..( 18): Result.006 file - promoters50/4771334
gtgcttcaaacaaaacta

SEQ ID NO: 191359 - DNA, 18 bp, Unknown
  misc_feature (1)..( 18): Result.006 file - promoters50/4771334
catcttcaaaattatatc

SEQ ID NO: 191360 - DNA, 18 bp, Unknown
  misc_feature (1)..( 18): Result.006 file - promoters50/4771334
ctatttcaaaaatactta

SEQ ID NO: 191361 - DNA, 18 bp, Unknown
  misc_feature (1)..( 18): Result.006 file - promoters50/4771348
atcagctgaacacaacta

SEQ ID NO: 191362 - DNA, 7 bp, Unknown
  misc_feature (1)..( 7): Result.006 file - promoters50/4771348
acactgt

SEQ ID NO: 191363 - DNA, 7 bp, Unknown
  misc_feature (1)..( 7): Result.006 file - promoters50/4771348
acattgt

SEQ ID NO: 191364 - DNA, 7 bp, Unknown
  misc_feature (1)..( 7): Result.006 file - promoters50/4771348
actctca

SEQ ID NO: 191365 - DNA, 8 bp, Unknown
  misc_feature (1)..( 8): Result.006 file - promoters50/4771348
tgtcttta

SEQ ID NO: 191366 - DNA, 8 bp, Unknown
  misc_feature (1)..( 8): Result.006 file - promoters50/4771348
tgtctttc

SEQ ID NO: 191367 - DNA, 8 bp, Unknown
  misc_feature (1)..( 8): Result.006 file - promoters50/4771348
cgtcatta

SEQ ID NO: 191368 - DNA, 10 bp, Unknown
  misc_feature (1)..( 10): Result.006 file - promoters50/4771348
catttgtaga

SEQ ID NO: 191369 - DNA, 10 bp, Unknown
  misc_feature (1)..( 10): Result.006 file - promoters50/4771348
gattagtaaa

SEQ ID NO: 191370 - DNA, 10 bp, Unknown
  misc_feature (1)..( 10): Result.006 file - promoters50/4771348
cattggtact

SEQ ID NO: 191371 - DNA, 10 bp, Unknown
  misc_feature (1)..( 10): Result.006 file - promoters50/4771348
ttctagtaaa

SEQ ID NO: 191372 - DNA, 8 bp, Unknown
  misc_feature (1)..( 8): Result.006 file - promoters50/4771348
caacattt

SEQ ID NO: 191373 - DNA, 8 bp, Unknown
  misc_feature (1)..( 8): Result.006 file - promoters50/4771348
caacattg

SEQ ID NO: 191374 - DNA, 9 bp, Unknown
  misc_feature (1)..( 9): Result.006 file - promoters50/4771348
taacacttt

SEQ ID NO: 191375 - DNA, 9 bp, Unknown
  misc_feature (1)..( 9): Result.006 file - promoters50/4771348
tttggttca

SEQ ID NO: 191376 - DNA, 9 bp, Unknown
  misc_feature (1)..( 9): Result.006 file - promoters50/4771348
tttagttat

SEQ ID NO: 191377 - DNA, 9 bp, Unknown
  misc_feature (1)..( 9): Result.006 file - promoters50/4771348
cttatttat

SEQ ID NO: 191378 - DNA, 10 bp, Unknown
  misc_feature (1)..( 10): Result.006 file - promoters50/4771348
tagtaaatgg

SEQ ID NO: 191379 - DNA, 10 bp, Unknown
  misc_feature (1)..( 10): Result.006 file - promoters50/4771348
tagtaaatgg

SEQ ID NO: 191380 - DNA, 10 bp, Unknown
  misc_feature (1)..( 10): Result.006 file - promoters50/4771360
tagtaaaaaa

SEQ ID NO: 191381 - DNA, 15 bp, Unknown
  misc_feature (1)..( 15): Result.006 file - promoters50/4771360
ggaaaaaacatatat

SEQ ID NO: 191382 - DNA, 15 bp, Unknown
  misc_feature (1)..( 15): Result.006 file - promoters50/4771360
agaaaaatggatttc

SEQ ID NO: 191383 - DNA, 15 bp, Unknown
  misc_feature (1)..( 15): Result.006 file - promoters50/4771360
ggaaaaaacaatttg

SEQ ID NO: 191384 - DNA, 15 bp, Unknown
  misc_feature (1)..( 15): Result.006 file - promoters50/4771360
ggaacaaaggagcac

SEQ ID NO: 191385 - DNA, 15 bp, Unknown
  misc_feature (1)..( 15): Result.006 file - promoters50/4771360
ccaaaaaaaaacaat

SEQ ID NO: 191386 - DNA, 15 bp, Unknown
  misc_feature (1)..( 15): Result.006 file - promoters50/4771360
agagaaattgatttc

SEQ ID NO: 191387 - DNA, 13 bp, Unknown
  misc_feature (1)..( 13): Result.006 file - promoters50/4771360
aaaatgttcactt

SEQ ID NO: 191388 - DNA, 13 bp, Unknown
  misc_feature (1)..( 13): Result.006 file - promoters50/4771360
taaatgttaaaaa

SEQ ID NO: 191389 - DNA, 14 bp, Unknown
  misc_feature (1)..( 14): Result.006 file - promoters50/4771360
aaacatgtttacaa

SEQ ID NO: 191390 - DNA, 14 bp, Unknown
  misc_feature (1)..( 14): Result.006 file - promoters50/4771360
tataatcttaactt

SEQ ID NO: 191391 - DNA, 14 bp, Unknown
  misc_feature (1)..( 14): Result.006 file - promoters50/4771360
gtttttctgaactt

SEQ ID NO: 191392 - DNA, 14 bp, Unknown
  misc_feature (1)..( 14): Result.006 file - promoters50/4771360
gagaatctgaaatc

SEQ ID NO: 191393 - DNA, 14 bp, Unknown
  misc_feature (1)..( 14): Result.006 file - promoters50/4771360
ccaaaaaaaagtct

SEQ ID NO: 191394 - DNA, 14 bp, Unknown
  misc_feature (1)..( 14): Result.006 file - promoters50/4771360
aaaaataaaagtta

SEQ ID NO: 191395 - DNA, 14 bp, Unknown
  misc_feature (1)..( 14): Result.006 file - promoters50/4771360
ccaacaaagttgtt

SEQ ID NO: 191396 - DNA, 14 bp, Unknown
  misc_feature (1)..( 14): Result.006 file - promoters50/4771360
cacaatataagtta

SEQ ID NO: 191397 - DNA, 14 bp, Unknown
  misc_feature (1)..( 14): Result.006 file - promoters50/4771360
actaatataaataa

SEQ ID NO: 191398 - DNA, 14 bp, Unknown
  misc_feature (1)..( 14): Result.006 file - promoters50/4771360
caaacgaaggagac

SEQ ID NO: 191399 - DNA, 14 bp, Unknown
  misc_feature (1)..( 14): Result.006 file - promoters50/4771364
cccaatatacttat

SEQ ID NO: 191400 - DNA, 9 bp, Unknown
  misc_feature (1)..( 9): Result.006 file - promoters50/4771364
ggtttaaca

SEQ ID NO: 191401 - DNA, 9 bp, Unknown
  misc_feature (1)..( 9): Result.006 file - promoters50/4771364
actttgaca

SEQ ID NO: 191402 - DNA, 9 bp, Unknown
  misc_feature (1)..( 9): Result.006 file - promoters50/4771364
actttgatc

SEQ ID NO: 191403 - DNA, 10 bp, Unknown
  misc_feature (1)..( 10): Result.006 file - promoters50/4771364
atggaccaaa

SEQ ID NO: 191404 - DNA, 10 bp, Unknown
  misc_feature (1)..( 10): Result.006 file - promoters50/4771364
tttgacaaaa

SEQ ID NO: 191405 - DNA, 10 bp, Unknown
  misc_feature (1)..( 10): Result.006 file - promoters50/4771372
atgggccaag

SEQ ID NO: 191406 - DNA, 12 bp, Unknown
  misc_feature (1)..( 12): Result.006 file - promoters50/4771372
tagtgacatcta

SEQ ID NO: 191407 - DNA, 12 bp, Unknown
  misc_feature (1)..( 12): Result.006 file - promoters50/4771372
tcttgagatctc

SEQ ID NO: 191408 - DNA, 12 bp, Unknown
  misc_feature (1)..( 12): Result.006 file - promoters50/4771372
cggcatcatcta

SEQ ID NO: 191409 - DNA, 12 bp, Unknown
  misc_feature (1)..( 12): Result.006 file - promoters50/4771372
cgatgagatgag

SEQ ID NO: 191410 - DNA, 12 bp, Unknown
  misc_feature (1)..( 12): Result.006 file - promoters50/4771372
cgaggagaaaag

SEQ ID NO: 191411 - DNA, 12 bp, Unknown
  misc_feature (1)..( 12): Result.006 file - promoters50/4771404
gaatgagaagta

SEQ ID NO: 191412 - DNA, 9 bp, Unknown
  misc_feature (1)..( 9): Result.006 file - promoters50/4771404
taatagaat

SEQ ID NO: 191413 - DNA, 9 bp, Unknown
  misc_feature (1)..( 9): Result.006 file - promoters50/4771404
aaatcgaat

SEQ ID NO: 191414 - DNA, 9 bp, Unknown
  misc_feature (1)..( 9): Result.006 file - promoters50/4771407
taaaagaat

SEQ ID NO: 191415 - DNA, 13 bp, Unknown
  misc_feature (1)..( 13): Result.006 file - promoters50/4771407
taaaataacgttt

SEQ ID NO: 191416 - DNA, 13 bp, Unknown
  misc_feature (1)..( 13): Result.006 file - promoters50/4771407
tgaaataattaat

SEQ ID NO: 191417 - DNA, 14 bp, Unknown
  misc_feature (1)..( 14): Result.006 file - promoters50/4771407
taaaagtaaatcat

SEQ ID NO: 191418 - DNA, 14 bp, Unknown
  misc_feature (1)..( 14): Result.006 file - promoters50/4771407
ttgaactaatgaga

SEQ ID NO: 191419 - DNA, 14 bp, Unknown
  misc_feature (1)..( 14): Result.006 file - promoters50/4771407
acaatctaattaga

SEQ ID NO: 191420 - DNA, 14 bp, Unknown
  misc_feature (1)..( 14): Result.006 file - promoters50/4771407
gtcatccaattttg

SEQ ID NO: 191421 - DNA, 13 bp, Unknown
  misc_feature (1)..( 13): Result.006 file - promoters50/4771407
tattttaatgtgg

SEQ ID NO: 191422 - DNA, 13 bp, Unknown
  misc_feature (1)..( 13): Result.006 file - promoters50/4771407
gtttttcatggaa

SEQ ID NO: 191423 - DNA, 13 bp, Unknown
  misc_feature (1)..( 13): Result.006 file - promoters50/4771407
tgtttacatatac

SEQ ID NO: 191424 - DNA, 13 bp, Unknown
  misc_feature (1)..( 13): Result.006 file - promoters50/4771407
tgttgacaaatgt

SEQ ID NO: 191425 - DNA, 13 bp, Unknown
  misc_feature (1)..( 13): Result.006 file - promoters50/4771407
tattctcaaggaa

SEQ ID NO: 191426 - DNA, 13 bp, Unknown
  misc_feature (1)..( 13): Result.006 file - promoters50/4771410
tgtagactctaaa

SEQ ID NO: 191427 - DNA, 10 bp, Unknown
  misc_feature (1)..( 10): Result.006 file - promoters50/4771410
taacttttga

SEQ ID NO: 191428 - DNA, 10 bp, Unknown
  misc_feature (1)..( 10): Result.006 file - promoters50/4771410
ttacttttaa

SEQ ID NO: 191429 - DNA, 10 bp, Unknown
  misc_feature (1)..( 10): Result.006 file - promoters50/4771410
cttcttttga

SEQ ID NO: 191430 - DNA, 10 bp, Unknown
  misc_feature (1)..( 10): Result.006 file - promoters50/4771410
taaatttttt

SEQ ID NO: 191431 - DNA, 10 bp, Unknown
  misc_feature (1)..( 10): Result.006 file - promoters50/4771410
attctttttg

SEQ ID NO: 191432 - DNA, 10 bp, Unknown
  misc_feature (1)..( 10): Result.006 file - promoters50/4771410
ttcctttttg

SEQ ID NO: 191433 - DNA, 10 bp, Unknown
  misc_feature (1)..( 10): Result.006 file - promoters50/4771410
agaatttttg

SEQ ID NO: 191434 - DNA, 10 bp, Unknown
  misc_feature (1)..( 10): Result.006 file - promoters50/4771410
atcatttttt

SEQ ID NO: 191435 - DNA, 13 bp, Unknown
  misc_feature (1)..( 13): Result.006 file - promoters50/4771410
acactaactaact

SEQ ID NO: 191436 - DNA, 13 bp, Unknown
  misc_feature (1)..( 13): Result.006 file - promoters50/4771410
attttaactacaa

SEQ ID NO: 191437 - DNA, 13 bp, Unknown
  misc_feature (1)..( 13): Result.006 file - promoters50/4771410
atttttactttta

SEQ ID NO: 191438 - DNA, 13 bp, Unknown
  misc_feature (1)..( 13): Result.006 file - promoters50/4771410
gtttttatttctt

SEQ ID NO: 191439 - DNA, 13 bp, Unknown
  misc_feature (1)..( 13): Result.006 file - promoters50/4771410
gttgttactttta

SEQ ID NO: 191440 - DNA, 13 bp, Unknown
  misc_feature (1)..( 13): Result.006 file - promoters50/4771410
ttttttaaaacac

SEQ ID NO: 191441 - DNA, 15 bp, Unknown
  misc_feature (1)..( 15): Result.006 file - promoters50/4771410
tgtgaaagttggtta

SEQ ID NO: 191442 - DNA, 15 bp, Unknown
  misc_feature (1)..( 15): Result.006 file - promoters50/4771410
tttgaaagttttccc

SEQ ID NO: 191443 - DNA, 15 bp, Unknown
  misc_feature (1)..( 15): Result.006 file - promoters50/4771410
gaaaaaaattgtaat

SEQ ID NO: 191444 - DNA, 15 bp, Unknown
  misc_feature (1)..( 15): Result.006 file - promoters50/4771410
tataaaaatttttct

SEQ ID NO: 191445 - DNA, 15 bp, Unknown
  misc_feature (1)..( 15): Result.006 file - promoters50/4771410
gaagaaaaaaaaaat

SEQ ID NO: 191446 - DNA, 15 bp, Unknown
  misc_feature (1)..( 15): Result.006 file - promoters50/4771410
ttttaaataccatca

SEQ ID NO: 191447 - DNA, 12 bp, Unknown
  misc_feature (1)..( 12): Result.006 file - promoters50/4771410
agcccaatagag

SEQ ID NO: 191448 - DNA, 12 bp, Unknown
  misc_feature (1)..( 12): Result.006 file - promoters50/4771410
gacccaattaaa

SEQ ID NO: 191449 - DNA, 12 bp, Unknown
  misc_feature (1)..( 12): Result.006 file - promoters50/4771410
ggcccaacaaga

SEQ ID NO: 191450 - DNA, 12 bp, Unknown
  misc_feature (1)..( 12): Result.006 file - promoters50/4771410
aacccaaacaac

SEQ ID NO: 191451 - DNA, 12 bp, Unknown
  misc_feature (1)..( 12): Result.006 file - promoters50/4771410
ggcccattgttt

SEQ ID NO: 191452 - DNA, 12 bp, Unknown
  misc_feature (1)..( 12): Result.006 file - promoters50/4771422
tatgcaaagcca

SEQ ID NO: 191453 - DNA, 8 bp, Unknown
  misc_feature (1)..( 8): Result.006 file - promoters50/4771422
tcttagtt

SEQ ID NO: 191454 - DNA, 8 bp, Unknown
  misc_feature (1)..( 8): Result.006 file - promoters50/4771422
ttttagtt

SEQ ID NO: 191455 - DNA, 9 bp, Unknown
  misc_feature (1)..( 9): Result.006 file - promoters50/4771422
ttttgagtt

SEQ ID NO: 191456 - DNA, 8 bp, Unknown
  misc_feature (1)..( 8): Result.006 file - promoters50/4771422
aaatgaaa

SEQ ID NO: 191457 - DNA, 8 bp, Unknown
  misc_feature (1)..( 8): Result.006 file - promoters50/4771422
aaatgaat

SEQ ID NO: 191458 - DNA, 8 bp, Unknown
  misc_feature (1)..( 8): Result.006 file - promoters50/4771426
taatgaaa

SEQ ID NO: 191459 - DNA, 14 bp, Unknown
  misc_feature (1)..( 14): Result.006 file - promoters50/4771426
cctattacaatatt

SEQ ID NO: 191460 - DNA, 14 bp, Unknown
  misc_feature (1)..( 14): Result.006 file - promoters50/4771426
caaattacaatatg

SEQ ID NO: 191461 - DNA, 14 bp, Unknown
  misc_feature (1)..( 14): Result.006 file - promoters50/4771426
aaccttacaaaatt

SEQ ID NO: 191462 - DNA, 14 bp, Unknown
  misc_feature (1)..( 14): Result.006 file - promoters50/4771426
caagttaccaaata

SEQ ID NO: 191463 - DNA, 14 bp, Unknown
  misc_feature (1)..( 14): Result.006 file - promoters50/4771426
gataggataaaatt

SEQ ID NO: 191464 - DNA, 25 bp, Unknown
  misc_feature (1)..( 25): Result.006 file - promoters50/4771426
aaagttgctacaaattatagattct

SEQ ID NO: 191465 - DNA, 25 bp, Unknown
  misc_feature (1)..( 25): Result.006 file - promoters50/4771426
aaagttgcttcaaattatagattct

SEQ ID NO: 191466 - DNA, 25 bp, Unknown
  misc_feature (1)..( 25): Result.006 file - promoters50/4771426
gagtttgctagcatcaataatcaca

SEQ ID NO: 191467 - DNA, 25 bp, Unknown
  misc_feature (1)..( 25): Result.006 file - promoters50/4771426
ctggactaaaacaattgtagtggta

SEQ ID NO: 191468 - DNA, 25 bp, Unknown
  misc_feature (1)..( 25): Result.006 file - promoters50/4771426
tcttctcttttctattcttttaccc

SEQ ID NO: 191469 - DNA, 22 bp, Unknown
  misc_feature (1)..( 22): Result.006 file - promoters50/4771426
tcttttctgatattgtttctca

SEQ ID NO: 191470 - DNA, 22 bp, Unknown
  misc_feature (1)..( 22): Result.006 file - promoters50/4771426
tcttttctgattttgtttctca

SEQ ID NO: 191471 - DNA, 22 bp, Unknown
  misc_feature (1)..( 22): Result.006 file - promoters50/4771426
tatttttgaaaaaaactaatat

SEQ ID NO: 191472 - DNA, 22 bp, Unknown
  misc_feature (1)..( 22): Result.006 file - promoters50/4771426
ggtttgctgtttgcagattttt

SEQ ID NO: 191473 - DNA, 23 bp, Unknown
  misc_feature (1)..( 23): Result.006 file - promoters50/4771426
tcttattttgagaggtcggctct

SEQ ID NO: 191474 - DNA, 7 bp, Unknown
  misc_feature (1)..( 7): Result.006 file - promoters50/4771426
aaatata

SEQ ID NO: 191475 - DNA, 7 bp, Unknown
  misc_feature (1)..( 7): Result.006 file - promoters50/4771426
aaatata

SEQ ID NO: 191476 - DNA, 7 bp, Unknown
  misc_feature (1)..( 7): Result.006 file - promoters50/4771426
aaacata

SEQ ID NO: 191477 - DNA, 7 bp, Unknown
  misc_feature (1)..( 7): Result.006 file - promoters50/4771426
aaatata

SEQ ID NO: 191478 - DNA, 11 bp, Unknown
  misc_feature (1)..( 11): Result.006 file - promoters50/4771426
gattcttttga

SEQ ID NO: 191479 - DNA, 11 bp, Unknown
  misc_feature (1)..( 11): Result.006 file - promoters50/4771426
tcttattttga

SEQ ID NO: 191480 - DNA, 11 bp, Unknown
  misc_feature (1)..( 11): Result.006 file - promoters50/4771426
ggtatttttga

SEQ ID NO: 191481 - DNA, 11 bp, Unknown
  misc_feature (1)..( 11): Result.006 file - promoters50/4771426
tctgattttgt

SEQ ID NO: 191482 - DNA, 11 bp, Unknown
  misc_feature (1)..( 11): Result.006 file - promoters50/4771426
aaataaaatat

SEQ ID NO: 191483 - DNA, 11 bp, Unknown
  misc_feature (1)..( 11): Result.006 file - promoters50/4771426
ggataaaattg

SEQ ID NO: 191484 - DNA, 11 bp, Unknown
  misc_feature (1)..( 11): Result.006 file - promoters50/4771426
aaattaaacct

SEQ ID NO: 191485 - DNA, 11 bp, Unknown
  misc_feature (1)..( 11): Result.006 file - promoters50/4771426
caataatattc

SEQ ID NO: 191486 - DNA, 11 bp, Unknown
  misc_feature (1)..( 11): Result.006 file - promoters50/4771426
aactaatattg

SEQ ID NO: 191487 - DNA, 12 bp, Unknown
  misc_feature (1)..( 12): Result.006 file - promoters50/4771426
ctcaaataaaat

SEQ ID NO: 191488 - DNA, 12 bp, Unknown
  misc_feature (1)..( 12): Result.006 file - promoters50/4771426
attaaaaaaatc

SEQ ID NO: 191489 - DNA, 12 bp, Unknown
  misc_feature (1)..( 12): Result.006 file - promoters50/4771426
cttgtataaaaa

SEQ ID NO: 191490 - DNA, 12 bp, Unknown
  misc_feature (1)..( 12): Result.006 file - promoters50/4771426
aaaaaataaaaa

SEQ ID NO: 191491 - DNA, 12 bp, Unknown
  misc_feature (1)..( 12): Result.006 file - promoters50/4771426
attttttaaaaa

SEQ ID NO: 191492 - DNA, 11 bp, Unknown
  misc_feature (1)..( 11): Result.006 file - promoters50/4771426
aaaaataaaaa

SEQ ID NO: 191493 - DNA, 11 bp, Unknown
  misc_feature (1)..( 11): Result.006 file - promoters50/4771426
aaatataaaca

SEQ ID NO: 191494 - DNA, 11 bp, Unknown
  misc_feature (1)..( 11): Result.006 file - promoters50/4771426
gtgtataaaaa

SEQ ID NO: 191495 - DNA, 11 bp, Unknown
  misc_feature (1)..( 11): Result.006 file - promoters50/4771426
ccaaagaaaag

SEQ ID NO: 191496 - DNA, 12 bp, Unknown
  misc_feature (1)..( 12): Result.006 file - promoters50/4771426
aaataaaaagaa

SEQ ID NO: 191497 - DNA, 12 bp, Unknown
  misc_feature (1)..( 12): Result.006 file - promoters50/4771426
aaacaaaaaaat

SEQ ID NO: 191498 - DNA, 12 bp, Unknown
  misc_feature (1)..( 12): Result.006 file - promoters50/4771426
gtataaaaagtt

SEQ ID NO: 191499 - DNA, 12 bp, Unknown
  misc_feature (1)..( 12): Result.006 file - promoters50/4771426
aaggaaaaaata

SEQ ID NO: 191500 - DNA, 9 bp, Unknown
  misc_feature (1)..( 9): Result.006 file - promoters50/4771426
aaattatag

SEQ ID NO: 191501 - DNA, 9 bp, Unknown
  misc_feature (1)..( 9): Result.006 file - promoters50/4771426
gtattttag

SEQ ID NO: 191502 - DNA, 9 bp, Unknown
  misc_feature (1)..( 9): Result.006 file - promoters50/4771426
aaaatattt

SEQ ID NO: 191503 - DNA, 9 bp, Unknown
  misc_feature (1)..( 9): Result.006 file - promoters50/4771433
aaaaaataa

SEQ ID NO: 191504 - DNA, 7 bp, Unknown
  misc_feature (1)..( 7): Result.006 file - promoters50/4771433
ttgacca

SEQ ID NO: 191505 - DNA, 7 bp, Unknown
  misc_feature (1)..( 7): Result.006 file - promoters50/4771433
ttgacca

SEQ ID NO: 191506 - DNA, 7 bp, Unknown
  misc_feature (1)..( 7): Result.006 file - promoters50/4771441
ttgacca

SEQ ID NO: 191507 - DNA, 8 bp, Unknown
  misc_feature (1)..( 8): Result.006 file - promoters50/4771441
gtttgttt

SEQ ID NO: 191508 - DNA, 8 bp, Unknown
  misc_feature (1)..( 8): Result.006 file - promoters50/4771441
gttttttt

SEQ ID NO: 191509 - DNA, 8 bp, Unknown
  misc_feature (1)..( 8): Result.006 file - promoters50/4771441
attttttg

SEQ ID NO: 191510 - DNA, 10 bp, Unknown
  misc_feature (1)..( 10): Result.006 file - promoters50/4771441
tctaatctca

SEQ ID NO: 191511 - DNA, 10 bp, Unknown
  misc_feature (1)..( 10): Result.006 file - promoters50/4771441
tctattcttt

SEQ ID NO: 191512 - DNA, 10 bp, Unknown
  misc_feature (1)..( 10): Result.006 file - promoters50/4771446
cgaatttttt

SEQ ID NO: 191513 - DNA, 13 bp, Unknown
  misc_feature (1)..( 13): Result.006 file - promoters50/4771446
gttttttttgttt

SEQ ID NO: 191514 - DNA, 13 bp, Unknown
  misc_feature (1)..( 13): Result.006 file - promoters50/4771446
tctgagtttgtta

SEQ ID NO: 191515 - DNA, 13 bp, Unknown
  misc_feature (1)..( 13): Result.006 file - promoters50/4771446
gtttcttttgttt

SEQ ID NO: 191516 - DNA, 7 bp, Unknown
  misc_feature (1)..( 7): Result.006 file - promoters50/4771446
ataaaaa

SEQ ID NO: 191517 - DNA, 7 bp, Unknown
  misc_feature (1)..( 7): Result.006 file - promoters50/4771446
ataaaaa

SEQ ID NO: 191518 - DNA, 8 bp, Unknown
  misc_feature (1)..( 8): Result.006 file - promoters50/4771446
atagaaaa

SEQ ID NO: 191519 - DNA, 7 bp, Unknown
  misc_feature (1)..( 7): Result.006 file - promoters50/4771446
caaattt

SEQ ID NO: 191520 - DNA, 7 bp, Unknown
  misc_feature (1)..( 7): Result.006 file - promoters50/4771446
caaattc

SEQ ID NO: 191521 - DNA, 7 bp, Unknown
  misc_feature (1)..( 7): Result.006 file - promoters50/4771446
gaaattt

SEQ ID NO: 191522 - DNA, 8 bp, Unknown
  misc_feature (1)..( 8): Result.006 file - promoters50/4771446
aaagaata

SEQ ID NO: 191523 - DNA, 8 bp, Unknown
  misc_feature (1)..( 8): Result.006 file - promoters50/4771446
aaagaaaa

SEQ ID NO: 191524 - DNA, 8 bp, Unknown
  misc_feature (1)..( 8): Result.006 file - promoters50/4771446
taagaaaa

SEQ ID NO: 191525 - DNA, 10 bp, Unknown
  misc_feature (1)..( 10): Result.006 file - promoters50/4771446
tacgtttttt

SEQ ID NO: 191526 - DNA, 10 bp, Unknown
  misc_feature (1)..( 10): Result.006 file - promoters50/4771446
aatgtttttt

SEQ ID NO: 191527 - DNA, 10 bp, Unknown
  misc_feature (1)..( 10): Result.006 file - promoters50/4771457
atggtttctc

SEQ ID NO: 191528 - DNA, 10 bp, Unknown
  misc_feature (1)..( 10): Result.006 file - promoters50/4771457
ggtttattca

SEQ ID NO: 191529 - DNA, 10 bp, Unknown
  misc_feature (1)..( 10): Result.006 file - promoters50/4771457
ggtttatttt

SEQ ID NO: 191530 - DNA, 10 bp, Unknown
  misc_feature (1)..( 10): Result.006 file - promoters50/4771457
attttatttt

SEQ ID NO: 191531 - DNA, 9 bp, Unknown
  misc_feature (1)..( 9): Result.006 file - promoters50/4771457
aaaacctgt

SEQ ID NO: 191532 - DNA, 9 bp, Unknown
  misc_feature (1)..( 9): Result.006 file - promoters50/4771457
ttaacttgt

SEQ ID NO: 191533 - DNA, 9 bp, Unknown
  misc_feature (1)..( 9): Result.006 file - promoters50/4771457
aaaacctaa

SEQ ID NO: 191534 - DNA, 7 bp, Unknown
  misc_feature (1)..( 7): Result.006 file - promoters50/4771457
cttcctt

SEQ ID NO: 191535 - DNA, 7 bp, Unknown
  misc_feature (1)..( 7): Result.006 file - promoters50/4771457
attcctt

SEQ ID NO: 191536 - DNA, 7 bp, Unknown
  misc_feature (1)..( 7): Result.006 file - promoters50/4771464
atttctt

SEQ ID NO: 191537 - DNA, 11 bp, Unknown
  misc_feature (1)..( 11): Result.006 file - promoters50/4771464
tgaagctttgg

SEQ ID NO: 191538 - DNA, 11 bp, Unknown
  misc_feature (1)..( 11): Result.006 file - promoters50/4771464
tgaggctgatc

SEQ ID NO: 191539 - DNA, 11 bp, Unknown
  misc_feature (1)..( 11): Result.006 file - promoters50/4771464
caaagctttaa

SEQ ID NO: 191540 - DNA, 11 bp, Unknown
  misc_feature (1)..( 11): Result.006 file - promoters50/4771464
cagagcttttt

SEQ ID NO: 191541 - DNA, 11 bp, Unknown
  misc_feature (1)..( 11): Result.006 file - promoters50/4771464
taaatctttgt

SEQ ID NO: 191542 - DNA, 11 bp, Unknown
  misc_feature (1)..( 11): Result.006 file - promoters50/4771467
aatgtctatgt

SEQ ID NO: 191543 - DNA, 9 bp, Unknown
  misc_feature (1)..( 9): Result.006 file - promoters50/4771467
tataatttg

SEQ ID NO: 191544 - DNA, 9 bp, Unknown
  misc_feature (1)..( 9): Result.006 file - promoters50/4771467
tattattac

SEQ ID NO: 191545 - DNA, 9 bp, Unknown
  misc_feature (1)..( 9): Result.006 file - promoters50/4771469
cataatttg

SEQ ID NO: 191546 - DNA, 7 bp, Unknown
  misc_feature (1)..( 7): Result.006 file - promoters50/4771469
caaaact

SEQ ID NO: 191547 - DNA, 7 bp, Unknown
  misc_feature (1)..( 7): Result.006 file - promoters50/4771469
caaaacc

SEQ ID NO: 191548 - DNA, 7 bp, Unknown
  misc_feature (1)..( 7): Result.006 file - promoters50/4771469
caaaact

SEQ ID NO: 191549 - DNA, 8 bp, Unknown
  misc_feature (1)..( 8): Result.006 file - promoters50/4771469
cataaaat

SEQ ID NO: 191550 - DNA, 8 bp, Unknown
  misc_feature (1)..( 8): Result.006 file - promoters50/4771469
catgaaac

SEQ ID NO: 191551 - DNA, 8 bp, Unknown
  misc_feature (1)..( 8): Result.006 file - promoters50/4771469
actaaaat

SEQ ID NO: 191552 - DNA, 8 bp, Unknown
  misc_feature (1)..( 8): Result.006 file - promoters50/4771469
taggctca

SEQ ID NO: 191553 - DNA, 8 bp, Unknown
  misc_feature (1)..( 8): Result.006 file - promoters50/4771469
gaggctca

SEQ ID NO: 191554 - DNA, 8 bp, Unknown
  misc_feature (1)..( 8): Result.006 file - promoters50/4771472
gaggctga

SEQ ID NO: 191555 - DNA, 9 bp, Unknown
  misc_feature (1)..( 9): Result.006 file - promoters50/4771472
taaacttta

SEQ ID NO: 191556 - DNA, 9 bp, Unknown
  misc_feature (1)..( 9): Result.006 file - promoters50/4771472
caaaattta

SEQ ID NO: 191557 - DNA, 9 bp, Unknown
  misc_feature (1)..( 9): Result.006 file - promoters50/4771472
taagctttt

SEQ ID NO: 191558 - DNA, 9 bp, Unknown
  misc_feature (1)..( 9): Result.006 file - promoters50/4771472
aaaagttta

SEQ ID NO: 191559 - DNA, 9 bp, Unknown
  misc_feature (1)..( 9): Result.006 file - promoters50/4771472
tacaattta

SEQ ID NO: 191560 - DNA, 9 bp, Unknown
  misc_feature (1)..( 9): Result.006 file - promoters50/4771472
cacactttt

SEQ ID NO: 191561 - DNA, 10 bp, Unknown
  misc_feature (1)..( 10): Result.006 file - promoters50/4771472
cctatataaa

SEQ ID NO: 191562 - DNA, 10 bp, Unknown
  misc_feature (1)..( 10): Result.006 file - promoters50/4771472
cctttatcat

SEQ ID NO: 191563 - DNA, 10 bp, Unknown
  misc_feature (1)..( 10): Result.006 file - promoters50/4771472
cctatttaaa

SEQ ID NO: 191564 - DNA, 10 bp, Unknown
  misc_feature (1)..( 10): Result.006 file - promoters50/4771472
cttatataaa

SEQ ID NO: 191565 - DNA, 10 bp, Unknown
  misc_feature (1)..( 10): Result.006 file - promoters50/4771472
ttattttaaa

SEQ ID NO: 191566 - DNA, 10 bp, Unknown
  misc_feature (1)..( 10): Result.006 file - promoters50/4771472
cttatattag

SEQ ID NO: 191567 - DNA, 10 bp, Unknown
  misc_feature (1)..( 10): Result.006 file - promoters50/4771472
ataatataaa

SEQ ID NO: 191568 - DNA, 14 bp, Unknown
  misc_feature (1)..( 14): Result.006 file - promoters50/4771472
atgattttcacaag

SEQ ID NO: 191569 - DNA, 15 bp, Unknown
  misc_feature (1)..( 15): Result.006 file - promoters50/4771472
caatattttcaaaag

SEQ ID NO: 191570 - DNA, 15 bp, Unknown
  misc_feature (1)..( 15): Result.006 file - promoters50/4771472
gaccattttccggcg

SEQ ID NO: 191571 - DNA, 15 bp, Unknown
  misc_feature (1)..( 15): Result.006 file - promoters50/4771472
aataatttgaatggt

SEQ ID NO: 191572 - DNA, 15 bp, Unknown
  misc_feature (1)..( 15): Result.006 file - promoters50/4771472
ttgtattttagagaa

SEQ ID NO: 191573 - DNA, 15 bp, Unknown
  misc_feature (1)..( 15): Result.006 file - promoters50/4771478
tgtcattttaaaaac

SEQ ID NO: 191574 - DNA, 13 bp, Unknown
  misc_feature (1)..( 13): Result.006 file - promoters50/4771478
ttaaaataataat

SEQ ID NO: 191575 - DNA, 13 bp, Unknown
  misc_feature (1)..( 13): Result.006 file - promoters50/4771478
agaaaataaaaat

SEQ ID NO: 191576 - DNA, 13 bp, Unknown
  misc_feature (1)..( 13): Result.006 file - promoters50/4771478
gtcaaacaaatac

SEQ ID NO: 191577 - DNA, 13 bp, Unknown
  misc_feature (1)..( 13): Result.006 file - promoters50/4771478
taaaagtaaatca

SEQ ID NO: 191578 - DNA, 13 bp, Unknown
  misc_feature (1)..( 13): Result.006 file - promoters50/4771478
agaaaataaaaaa

SEQ ID NO: 191579 - DNA, 13 bp, Unknown
  misc_feature (1)..( 13): Result.006 file - promoters50/4771478
tatatataaaaat

SEQ ID NO: 191580 - DNA, 13 bp, Unknown
  misc_feature (1)..( 13): Result.006 file - promoters50/4771478
gatccataacagt

SEQ ID NO: 191581 - DNA, 12 bp, Unknown
  misc_feature (1)..( 12): Result.006 file - promoters50/4771478
aataagtaaaag

SEQ ID NO: 191582 - DNA, 12 bp, Unknown
  misc_feature (1)..( 12): Result.006 file - promoters50/4771478
ggccagtcaaac

SEQ ID NO: 191583 - DNA, 12 bp, Unknown
  misc_feature (1)..( 12): Result.006 file - promoters50/4771478
taaaagtaaatc

SEQ ID NO: 191584 - DNA, 12 bp, Unknown
  misc_feature (1)..( 12): Result.006 file - promoters50/4771478
agaaaataaaaa

SEQ ID NO: 191585 - DNA, 12 bp, Unknown
  misc_feature (1)..( 12): Result.006 file - promoters50/4771478
agaaaataaaaa

SEQ ID NO: 191586 - DNA, 12 bp, Unknown
  misc_feature (1)..( 12): Result.006 file - promoters50/4771478
tatatataaaaa

SEQ ID NO: 191587 - DNA, 11 bp, Unknown
  misc_feature (1)..( 11): Result.006 file - promoters50/4771478
tcaaaaataag

SEQ ID NO: 191588 - DNA, 11 bp, Unknown
  misc_feature (1)..( 11): Result.006 file - promoters50/4771478
acataaataaa

SEQ ID NO: 191589 - DNA, 12 bp, Unknown
  misc_feature (1)..( 12): Result.006 file - promoters50/4771478
cttaaaagtaaa

SEQ ID NO: 191590 - DNA, 12 bp, Unknown
  misc_feature (1)..( 12): Result.006 file - promoters50/4771478
agagaaaataaa

SEQ ID NO: 191591 - DNA, 12 bp, Unknown
  misc_feature (1)..( 12): Result.006 file - promoters50/4771478
attatatataaa

SEQ ID NO: 191592 - DNA, 12 bp, Unknown
  misc_feature (1)..( 12): Result.006 file - promoters50/4771482
attttatatatg

SEQ ID NO: 191593 - DNA, 7 bp, Unknown
  misc_feature (1)..( 7): Result.006 file - promoters50/4771482
aaaagtg

SEQ ID NO: 191594 - DNA, 7 bp, Unknown
  misc_feature (1)..( 7): Result.006 file - promoters50/4771482
taaagtg

SEQ ID NO: 191595 - DNA, 7 bp, Unknown
  misc_feature (1)..( 7): Result.006 file - promoters50/4771495
taaagtt

SEQ ID NO: 191596 - DNA, 9 bp, Unknown
  misc_feature (1)..( 9): Result.006 file - promoters50/4771495
taattgttc

SEQ ID NO: 191597 - DNA, 9 bp, Unknown
  misc_feature (1)..( 9): Result.006 file - promoters50/4771495
gaattgtag

SEQ ID NO: 191598 - DNA, 9 bp, Unknown
  misc_feature (1)..( 9): Result.006 file - promoters50/4771495
aaatagttt

SEQ ID NO: 191599 - DNA, 9 bp, Unknown
  misc_feature (1)..( 9): Result.006 file - promoters50/4771495
aaattctag

SEQ ID NO: 191600 - DNA, 9 bp, Unknown
  misc_feature (1)..( 9): Result.006 file - promoters50/4771495
aaattaggc

SEQ ID NO: 191601 - DNA, 9 bp, Unknown
  misc_feature (1)..( 9): Result.006 file - promoters50/4771495
aaatagacg

SEQ ID NO: 191602 - DNA, 12 bp, Unknown
  misc_feature (1)..( 12): Result.006 file - promoters50/4771495
gatttaaattat

SEQ ID NO: 191603 - DNA, 12 bp, Unknown
  misc_feature (1)..( 12): Result.006 file - promoters50/4771495
tatttaacattt

SEQ ID NO: 191604 - DNA, 12 bp, Unknown
  misc_feature (1)..( 12): Result.006 file - promoters50/4771495
aattaaaataaa

SEQ ID NO: 191605 - DNA, 12 bp, Unknown
  misc_feature (1)..( 12): Result.006 file - promoters50/4771495
tattgaaaaatc

SEQ ID NO: 191606 - DNA, 12 bp, Unknown
  misc_feature (1)..( 12): Result.006 file - promoters50/4771495
ggataaaaaaaa

SEQ ID NO: 191607 - DNA, 12 bp, Unknown
  misc_feature (1)..( 12): Result.006 file - promoters50/4771495
tattgatttgtt

SEQ ID NO: 191608 - DNA, 12 bp, Unknown
  misc_feature (1)..( 12): Result.006 file - promoters50/4771495
tctaattgttca

SEQ ID NO: 191609 - DNA, 12 bp, Unknown
  misc_feature (1)..( 12): Result.006 file - promoters50/4771495
ttgatttgttcc

SEQ ID NO: 191610 - DNA, 12 bp, Unknown
  misc_feature (1)..( 12): Result.006 file - promoters50/4771495
taaaatagtttt

SEQ ID NO: 191611 - DNA, 12 bp, Unknown
  misc_feature (1)..( 12): Result.006 file - promoters50/4771495
ttgaattgttcc

SEQ ID NO: 191612 - DNA, 12 bp, Unknown
  misc_feature (1)..( 12): Result.006 file - promoters50/4771495
acaaattaggct

SEQ ID NO: 191613 - DNA, 12 bp, Unknown
  misc_feature (1)..( 12): Result.006 file - promoters50/4771502
gtaaatagacgt

SEQ ID NO: 191614 - DNA, 7 bp, Unknown
  misc_feature (1)..( 7): Result.006 file - promoters50/4771502
taatttt

SEQ ID NO: 191615 - DNA, 7 bp, Unknown
  misc_feature (1)..( 7): Result.006 file - promoters50/4771502
caatttt

SEQ ID NO: 191616 - DNA, 7 bp, Unknown
  misc_feature (1)..( 7): Result.006 file - promoters50/4771502
caatttg

SEQ ID NO: 191617 - DNA, 13 bp, Unknown
  misc_feature (1)..( 13): Result.006 file - promoters50/4771502
atatatttcattt

SEQ ID NO: 191618 - DNA, 13 bp, Unknown
  misc_feature (1)..( 13): Result.006 file - promoters50/4771502
ataaattacattt

SEQ ID NO: 191619 - DNA, 13 bp, Unknown
  misc_feature (1)..( 13): Result.006 file - promoters50/4771519
aggtctttccttt

SEQ ID NO: 191620 - DNA, 14 bp, Unknown
  misc_feature (1)..( 14): Result.006 file - promoters50/4771519
taaatctgtgatat

SEQ ID NO: 191621 - DNA, 14 bp, Unknown
  misc_feature (1)..( 14): Result.006 file - promoters50/4771519
gaaatctccctcta

SEQ ID NO: 191622 - DNA, 14 bp, Unknown
  misc_feature (1)..( 14): Result.006 file - promoters50/4771519
taaatcactcctta

SEQ ID NO: 191623 - DNA, 14 bp, Unknown
  misc_feature (1)..( 14): Result.006 file - promoters50/4771519
ctaatttgttataa

SEQ ID NO: 191624 - DNA, 14 bp, Unknown
  misc_feature (1)..( 14): Result.006 file - promoters50/4771519
ggaatgtgtaatat

SEQ ID NO: 191625 - DNA, 14 bp, Unknown
  misc_feature (1)..( 14): Result.006 file - promoters50/4771519
caaacctccgccga

SEQ ID NO: 191626 - DNA, 14 bp, Unknown
  misc_feature (1)..( 14): Result.006 file - promoters50/4771523
gaattcttttttgt

SEQ ID NO: 191627 - DNA, 10 bp, Unknown
  misc_feature (1)..( 10): Result.006 file - promoters50/4771523
ttagctaacg

SEQ ID NO: 191628 - DNA, 10 bp, Unknown
  misc_feature (1)..( 10): Result.006 file - promoters50/4771523
ttaactaaat

SEQ ID NO: 191629 - DNA, 10 bp, Unknown
  misc_feature (1)..( 10): Result.006 file - promoters50/4771523
tacactaaac

SEQ ID NO: 191630 - DNA, 10 bp, Unknown
  misc_feature (1)..( 10): Result.006 file - promoters50/4771523
aaaaccaaaa

SEQ ID NO: 191631 - DNA, 10 bp, Unknown
  misc_feature (1)..( 10): Result.006 file - promoters50/4771523
taaaacaaca

SEQ ID NO: 191632 - DNA, 10 bp, Unknown
  misc_feature (1)..( 10): Result.006 file - promoters50/4771523
cttaccaaaa

SEQ ID NO: 191633 - DNA, 15 bp, Unknown
  misc_feature (1)..( 15): Result.006 file - promoters50/4771523
tgtgaaaaatcgtca

SEQ ID NO: 191634 - DNA, 15 bp, Unknown
  misc_feature (1)..( 15): Result.006 file - promoters50/4771523
tcagaaaaaggtttt

SEQ ID NO: 191635 - DNA, 15 bp, Unknown
  misc_feature (1)..( 15): Result.006 file - promoters50/4771523
cacaaaaaatgtgaa

SEQ ID NO: 191636 - DNA, 15 bp, Unknown
  misc_feature (1)..( 15): Result.006 file - promoters50/4771523
tcagaaaaaagagag

SEQ ID NO: 191637 - DNA, 15 bp, Unknown
  misc_feature (1)..( 15): Result.006 file - promoters50/4771523
atacaaactgtgaaa

SEQ ID NO: 191638 - DNA, 15 bp, Unknown
  misc_feature (1)..( 15): Result.006 file - promoters50/4771565
tgtgaaatcgtattt

SEQ ID NO: 191639 - DNA, 10 bp, Unknown
  misc_feature (1)..( 10): Result.006 file - promoters50/4771565
catttgggtc

SEQ ID NO: 191640 - DNA, 10 bp, Unknown
  misc_feature (1)..( 10): Result.006 file - promoters50/4771565
cattagggct

SEQ ID NO: 191641 - DNA, 10 bp, Unknown
  misc_feature (1)..( 10): Result.006 file - promoters50/4771565
aacttgagtc

SEQ ID NO: 191642 - DNA, 12 bp, Unknown
  misc_feature (1)..( 12): Result.006 file - promoters50/4771565
tatatatatttt

SEQ ID NO: 191643 - DNA, 12 bp, Unknown
  misc_feature (1)..( 12): Result.006 file - promoters50/4771565
tatatttatttt

SEQ ID NO: 191644 - DNA, 12 bp, Unknown
  misc_feature (1)..( 12): Result.006 file - promoters50/4771565
ggtgattatttg

SEQ ID NO: 191645 - DNA, 10 bp, Unknown
  misc_feature (1)..( 10): Result.006 file - promoters50/4771565
gcttttactc

SEQ ID NO: 191646 - DNA, 10 bp, Unknown
  misc_feature (1)..( 10): Result.006 file - promoters50/4771565
ttttttactt

SEQ ID NO: 191647 - DNA, 10 bp, Unknown
  misc_feature (1)..( 10): Result.006 file - promoters50/4771579
ttttttcctt

SEQ ID NO: 191648 - DNA, 7 bp, Unknown
  misc_feature (1)..( 7): Result.006 file - promoters50/4771579
aaagaaa

SEQ ID NO: 191649 - DNA, 7 bp, Unknown
  misc_feature (1)..( 7): Result.006 file - promoters50/4771579
aaacaaa

SEQ ID NO: 191650 - DNA, 8 bp, Unknown
  misc_feature (1)..( 8): Result.006 file - promoters50/4771579
aaatgaac

SEQ ID NO: 191651 - DNA, 8 bp, Unknown
  misc_feature (1)..( 8): Result.006 file - promoters50/4771586
aaaacaac

SEQ ID NO: 191652 - DNA, 14 bp, Unknown
  misc_feature (1)..( 14): Result.006 file - promoters50/4771586
atttaaaatgttag

SEQ ID NO: 191653 - DNA, 14 bp, Unknown
  misc_feature (1)..( 14): Result.006 file - promoters50/4771586
tgataaaatagttt

SEQ ID NO: 191654 - DNA, 14 bp, Unknown
  misc_feature (1)..( 14): Result.006 file - promoters50/4771586
caaaaaaattgtgg

SEQ ID NO: 191655 - DNA, 14 bp, Unknown
  misc_feature (1)..( 14): Result.006 file - promoters50/4771586
ttataaaacgacgt

SEQ ID NO: 191656 - DNA, 14 bp, Unknown
  misc_feature (1)..( 14): Result.006 file - promoters50/4771586
aagtaaagttgatt

SEQ ID NO: 191657 - DNA, 14 bp, Unknown
  misc_feature (1)..( 14): Result.006 file - promoters50/4771586
ttatcaaattgaat

SEQ ID NO: 191658 - DNA, 14 bp, Unknown
  misc_feature (1)..( 14): Result.006 file - promoters50/4771586
tacataaataaatt

SEQ ID NO: 191659 - DNA, 12 bp, Unknown
  misc_feature (1)..( 12): Result.006 file - promoters50/4771586
tttaaaatgtta

SEQ ID NO: 191660 - DNA, 12 bp, Unknown
  misc_feature (1)..( 12): Result.006 file - promoters50/4771586
tgtataatttta

SEQ ID NO: 191661 - DNA, 12 bp, Unknown
  misc_feature (1)..( 12): Result.006 file - promoters50/4771586
taataaaagttt

SEQ ID NO: 191662 - DNA, 12 bp, Unknown
  misc_feature (1)..( 12): Result.006 file - promoters50/4771586
aaaaaaattgtg

SEQ ID NO: 191663 - DNA, 12 bp, Unknown
  misc_feature (1)..( 12): Result.006 file - promoters50/4771586
gaagtaaagttg

SEQ ID NO: 191664 - DNA, 12 bp, Unknown
  misc_feature (1)..( 12): Result.006 file - promoters50/4771601
aaataaattaat

SEQ ID NO: 191665 - DNA, 8 bp, Unknown
  misc_feature (1)..( 8): Result.006 file - promoters50/4771601
aaaaagtt

SEQ ID NO: 191666 - DNA, 8 bp, Unknown
  misc_feature (1)..( 8): Result.006 file - promoters50/4771601
aaatagtg

SEQ ID NO: 191667 - DNA, 8 bp, Unknown
  misc_feature (1)..( 8): Result.006 file - promoters50/4771601
gaaaagtt

SEQ ID NO: 191668 - DNA, 10 bp, Unknown
  misc_feature (1)..( 10): Result.006 file - promoters50/4771601
aaactcaaaa

SEQ ID NO: 191669 - DNA, 10 bp, Unknown
  misc_feature (1)..( 10): Result.006 file - promoters50/4771601
aaacttaaaa

SEQ ID NO: 191670 - DNA, 11 bp, Unknown
  misc_feature (1)..( 11): Result.006 file - promoters50/4771601
aaaccttactt

SEQ ID NO: 191671 - DNA, 14 bp, Unknown
  misc_feature (1)..( 14): Result.006 file - promoters50/4771601
atatatgtatctct

SEQ ID NO: 191672 - DNA, 14 bp, Unknown
  misc_feature (1)..( 14): Result.006 file - promoters50/4771601
ttatttgtatttct

SEQ ID NO: 191673 - DNA, 14 bp, Unknown
  misc_feature (1)..( 14): Result.006 file - promoters50/4771601
atatatacaacaaa

SEQ ID NO: 191674 - DNA, 7 bp, Unknown
  misc_feature (1)..( 7): Result.006 file - promoters50/4771601
ttatata

SEQ ID NO: 191675 - DNA, 7 bp, Unknown
  misc_feature (1)..( 7): Result.006 file - promoters50/4771601
atatata

SEQ ID NO: 191676 - DNA, 7 bp, Unknown
  misc_feature (1)..( 7): Result.006 file - promoters50/4771601
ataaata

SEQ ID NO: 191677 - DNA, 10 bp, Unknown
  misc_feature (1)..( 10): Result.006 file - promoters50/4771601
tatcaatcaa

SEQ ID NO: 191678 - DNA, 10 bp, Unknown
  misc_feature (1)..( 10): Result.006 file - promoters50/4771601
tatcaaccaa

SEQ ID NO: 191679 - DNA, 10 bp, Unknown
  misc_feature (1)..( 10): Result.006 file - promoters50/4771612
tatcaaaacg

SEQ ID NO: 191680 - DNA, 8 bp, Unknown
  misc_feature (1)..( 8): Result.006 file - promoters50/4771612
cgaatctt

SEQ ID NO: 191681 - DNA, 8 bp, Unknown
  misc_feature (1)..( 8): Result.006 file - promoters50/4771612
tgaatctt

SEQ ID NO: 191682 - DNA, 8 bp, Unknown
  misc_feature (1)..( 8): Result.006 file - promoters50/4771612
cgaatctt

SEQ ID NO: 191683 - DNA, 8 bp, Unknown
  misc_feature (1)..( 8): Result.006 file - promoters50/4771612
ttcacaaa

SEQ ID NO: 191684 - DNA, 8 bp, Unknown
  misc_feature (1)..( 8): Result.006 file - promoters50/4771612
ctcataaa

SEQ ID NO: 191685 - DNA, 8 bp, Unknown
  misc_feature (1)..( 8): Result.006 file - promoters50/4771612
ttcacacc

SEQ ID NO: 191686 - DNA, 8 bp, Unknown
  misc_feature (1)..( 8): Result.006 file - promoters50/4771612
aaaacaaa

SEQ ID NO: 191687 - DNA, 8 bp, Unknown
  misc_feature (1)..( 8): Result.006 file - promoters50/4771612
aaatcaaa

SEQ ID NO: 191688 - DNA, 8 bp, Unknown
  misc_feature (1)..( 8): Result.006 file - promoters50/4771616
gtatcaaa

SEQ ID NO: 191689 - DNA, 8 bp, Unknown
  misc_feature (1)..( 8): Result.006 file - promoters50/4771616
caataatg

SEQ ID NO: 191690 - DNA, 8 bp, Unknown
  misc_feature (1)..( 8): Result.006 file - promoters50/4771616
tcataatg

SEQ ID NO: 191691 - DNA, 8 bp, Unknown
  misc_feature (1)..( 8): Result.006 file - promoters50/4771616
caacaatt

SEQ ID NO: 191692 - DNA, 10 bp, Unknown
  misc_feature (1)..( 10): Result.006 file - promoters50/4771616
atgataaata

SEQ ID NO: 191693 - DNA, 10 bp, Unknown
  misc_feature (1)..( 10): Result.006 file - promoters50/4771616
ttcatagata

SEQ ID NO: 191694 - DNA, 10 bp, Unknown
  misc_feature (1)..( 10): Result.006 file - promoters50/4771616
ttcttagaag

SEQ ID NO: 191695 - DNA, 11 bp, Unknown
  misc_feature (1)..( 11): Result.006 file - promoters50/4771616
tacatgaaatg

SEQ ID NO: 191696 - DNA, 11 bp, Unknown
  misc_feature (1)..( 11): Result.006 file - promoters50/4771616
aaaaagaaatg

SEQ ID NO: 191697 - DNA, 11 bp, Unknown
  misc_feature (1)..( 11): Result.006 file - promoters50/4771616
aaaaaaaaatg

SEQ ID NO: 191698 - DNA, 11 bp, Unknown
  misc_feature (1)..( 11): Result.006 file - promoters50/4771616
ctaaaaaaagg

SEQ ID NO: 191699 - DNA, 8 bp, Unknown
  misc_feature (1)..( 8): Result.006 file - promoters50/4771616
ataaaaaa

SEQ ID NO: 191700 - DNA, 8 bp, Unknown
  misc_feature (1)..( 8): Result.006 file - promoters50/4771616
atataaat

SEQ ID NO: 191701 - DNA, 9 bp, Unknown
  misc_feature (1)..( 9): Result.006 file - promoters50/4771616
ataaataac

SEQ ID NO: 191702 - DNA, 8 bp, Unknown
  misc_feature (1)..( 8): Result.006 file - promoters50/4771616
aaaatttt

SEQ ID NO: 191703 - DNA, 8 bp, Unknown
  misc_feature (1)..( 8): Result.006 file - promoters50/4771616
ataatttt

SEQ ID NO: 191704 - DNA, 8 bp, Unknown
  misc_feature (1)..( 8): Result.006 file - promoters50/4771616
aaaattta

SEQ ID NO: 191705 - DNA, 12 bp, Unknown
  misc_feature (1)..( 12): Result.006 file - promoters50/4771616
aaaactaacttg

SEQ ID NO: 191706 - DNA, 12 bp, Unknown
  misc_feature (1)..( 12): Result.006 file - promoters50/4771616
gtttctatcttt

SEQ ID NO: 191707 - DNA, 12 bp, Unknown
  misc_feature (1)..( 12): Result.006 file - promoters50/4771616
gtttctttcttc

SEQ ID NO: 191708 - DNA, 12 bp, Unknown
  misc_feature (1)..( 12): Result.006 file - promoters50/4771616
gttatttttttt

SEQ ID NO: 191709 - DNA, 13 bp, Unknown
  misc_feature (1)..( 13): Result.006 file - promoters50/4771616
cacgaaatttcca

SEQ ID NO: 191710 - DNA, 13 bp, Unknown
  misc_feature (1)..( 13): Result.006 file - promoters50/4771616
aaagaaaattcga

SEQ ID NO: 191711 - DNA, 13 bp, Unknown
  misc_feature (1)..( 13): Result.006 file - promoters50/4771616
atataaaaaaaaa

SEQ ID NO: 191712 - DNA, 13 bp, Unknown
  misc_feature (1)..( 13): Result.006 file - promoters50/4771616
taataaaattgaa

SEQ ID NO: 191713 - DNA, 7 bp, Unknown
  misc_feature (1)..( 7): Result.006 file - promoters50/4771616
taaaaaa

SEQ ID NO: 191714 - DNA, 7 bp, Unknown
  misc_feature (1)..( 7): Result.006 file - promoters50/4771616
caaaaaa

SEQ ID NO: 191715 - DNA, 8 bp, Unknown
  misc_feature (1)..( 8): Result.006 file - promoters50/4771616
taataaaa

SEQ ID NO: 191716 - DNA, 6 bp, Unknown
  misc_feature (1)..( 6): Result.006 file - promoters50/4771616
acaatt

SEQ ID NO: 191717 - DNA, 6 bp, Unknown
  misc_feature (1)..( 6): Result.006 file - promoters50/4771616
acaatt

SEQ ID NO: 191718 - DNA, 6 bp, Unknown
  misc_feature (1)..( 6): Result.006 file - promoters50/4771616
acaatt

SEQ ID NO: 191719 - DNA, 8 bp, Unknown
  misc_feature (1)..( 8): Result.006 file - promoters50/4771616
ttaaaaaa

SEQ ID NO: 191720 - DNA, 8 bp, Unknown
  misc_feature (1)..( 8): Result.006 file - promoters50/4771616
ttagaaaa

SEQ ID NO: 191721 - DNA, 8 bp, Unknown
  misc_feature (1)..( 8): Result.006 file - promoters50/4771616
ctagaaac

SEQ ID NO: 191722 - DNA, 8 bp, Unknown
  misc_feature (1)..( 8): Result.006 file - promoters50/4771616
taaaaaga

SEQ ID NO: 191723 - DNA, 8 bp, Unknown
  misc_feature (1)..( 8): Result.006 file - promoters50/4771616
taaaaaaa

SEQ ID NO: 191724 - DNA, 8 bp, Unknown
  misc_feature (1)..( 8): Result.006 file - promoters50/4771620
caaaaaaa

SEQ ID NO: 191725 - DNA, 7 bp, Unknown
  misc_feature (1)..( 7): Result.006 file - promoters50/4771620
ttatatt

SEQ ID NO: 191726 - DNA, 7 bp, Unknown
  misc_feature (1)..( 7): Result.006 file - promoters50/4771620
ttatatc

SEQ ID NO: 191727 - DNA, 7 bp, Unknown
  misc_feature (1)..( 7): Result.006 file - promoters50/4771620
ttagatt

SEQ ID NO: 191728 - DNA, 8 bp, Unknown
  misc_feature (1)..( 8): Result.006 file - promoters50/4771620
attacatt

SEQ ID NO: 191729 - DNA, 8 bp, Unknown
  misc_feature (1)..( 8): Result.006 file - promoters50/4771620
catacatt

SEQ ID NO: 191730 - DNA, 8 bp, Unknown
  misc_feature (1)..( 8): Result.006 file - promoters50/4771624
catccatg

SEQ ID NO: 191731 - DNA, 11 bp, Unknown
  misc_feature (1)..( 11): Result.006 file - promoters50/4771624
ggattttcaaa

SEQ ID NO: 191732 - DNA, 11 bp, Unknown
  misc_feature (1)..( 11): Result.006 file - promoters50/4771624
ggagtttaaaa

SEQ ID NO: 191733 - DNA, 11 bp, Unknown
  misc_feature (1)..( 11): Result.006 file - promoters50/4771624
gcattttctta

SEQ ID NO: 191734 - DNA, 11 bp, Unknown
  misc_feature (1)..( 11): Result.006 file - promoters50/4771624
atgttttctat

SEQ ID NO: 191735 - DNA, 8 bp, Unknown
  misc_feature (1)..( 8): Result.006 file - promoters50/4771624
tttacaaa

SEQ ID NO: 191736 - DNA, 8 bp, Unknown
  misc_feature (1)..( 8): Result.006 file - promoters50/4771624
tttataaa

SEQ ID NO: 191737 - DNA, 8 bp, Unknown
  misc_feature (1)..( 8): Result.006 file - promoters50/4771624
agtataaa

SEQ ID NO: 191738 - DNA, 12 bp, Unknown
  misc_feature (1)..( 12): Result.006 file - promoters50/4771624
cttaagaagaag

SEQ ID NO: 191739 - DNA, 12 bp, Unknown
  misc_feature (1)..( 12): Result.006 file - promoters50/4771624
tataaaaagaag

SEQ ID NO: 191740 - DNA, 12 bp, Unknown
  misc_feature (1)..( 12): Result.006 file - promoters50/4771624
tatataaacata

SEQ ID NO: 191741 - DNA, 9 bp, Unknown
  misc_feature (1)..( 9): Result.006 file - promoters50/4771624
aagaaaata

SEQ ID NO: 191742 - DNA, 9 bp, Unknown
  misc_feature (1)..( 9): Result.006 file - promoters50/4771624
aagaaaatt

SEQ ID NO: 191743 - DNA, 9 bp, Unknown
  misc_feature (1)..( 9): Result.006 file - promoters50/4771638
atcaaaatt

SEQ ID NO: 191744 - DNA, 11 bp, Unknown
  misc_feature (1)..( 11): Result.006 file - promoters50/4771638
atagattaatg

SEQ ID NO: 191745 - DNA, 11 bp, Unknown
  misc_feature (1)..( 11): Result.006 file - promoters50/4771638
agttattaatc

SEQ ID NO: 191746 - DNA, 11 bp, Unknown
  misc_feature (1)..( 11): Result.006 file - promoters50/4771638
agtgattcatc

SEQ ID NO: 191747 - DNA, 10 bp, Unknown
  misc_feature (1)..( 10): Result.006 file - promoters50/4771638
gcgattaaag

SEQ ID NO: 191748 - DNA, 10 bp, Unknown
  misc_feature (1)..( 10): Result.006 file - promoters50/4771638
tttattaaag

SEQ ID NO: 191749 - DNA, 10 bp, Unknown
  misc_feature (1)..( 10): Result.006 file - promoters50/4771638
ttttttaaac

SEQ ID NO: 191750 - DNA, 8 bp, Unknown
  misc_feature (1)..( 8): Result.006 file - promoters50/4771638
tttataca

SEQ ID NO: 191751 - DNA, 8 bp, Unknown
  misc_feature (1)..( 8): Result.006 file - promoters50/4771638
cttataca

SEQ ID NO: 191752 - DNA, 9 bp, Unknown
  misc_feature (1)..( 9): Result.006 file - promoters50/4771646
tttaataag

SEQ ID NO: 191753 - DNA, 9 bp, Unknown
  misc_feature (1)..( 9): Result.006 file - promoters50/4771646
gttatatga

SEQ ID NO: 191754 - DNA, 9 bp, Unknown
  misc_feature (1)..( 9): Result.006 file - promoters50/4771646
tttatatgt

SEQ ID NO: 191755 - DNA, 9 bp, Unknown
  misc_feature (1)..( 9): Result.006 file - promoters50/4771646
attatattt

SEQ ID NO: 191756 - DNA, 10 bp, Unknown
  misc_feature (1)..( 10): Result.006 file - promoters50/4771646
attaatagtt

SEQ ID NO: 191757 - DNA, 10 bp, Unknown
  misc_feature (1)..( 10): Result.006 file - promoters50/4771646
cttaagagtt

SEQ ID NO: 191758 - DNA, 10 bp, Unknown
  misc_feature (1)..( 10): Result.006 file - promoters50/4771646
gttaagattt

SEQ ID NO: 191759 - DNA, 10 bp, Unknown
  misc_feature (1)..( 10): Result.006 file - promoters50/4771658
gctaagaggt

SEQ ID NO: 191760 - DNA, 8 bp, Unknown
  misc_feature (1)..( 8): Result.006 file - promoters50/4771658
gatgtttt

SEQ ID NO: 191761 - DNA, 8 bp, Unknown
  misc_feature (1)..( 8): Result.006 file - promoters50/4771658
catgtttc

SEQ ID NO: 191762 - DNA, 8 bp, Unknown
  misc_feature (1)..( 8): Result.006 file - promoters50/4771658
cttgtttt

SEQ ID NO: 191763 - DNA, 8 bp, Unknown
  misc_feature (1)..( 8): Result.006 file - promoters50/4771658
catcttta

SEQ ID NO: 191764 - DNA, 7 bp, Unknown
  misc_feature (1)..( 7): Result.006 file - promoters50/4771658
gatagaa

SEQ ID NO: 191765 - DNA, 7 bp, Unknown
  misc_feature (1)..( 7): Result.006 file - promoters50/4771658
gatcgaa

SEQ ID NO: 191766 - DNA, 7 bp, Unknown
  misc_feature (1)..( 7): Result.006 file - promoters50/4771674
gatggaa

SEQ ID NO: 191767 - DNA, 11 bp, Unknown
  misc_feature (1)..( 11): Result.006 file - promoters50/4771674
cttctttcctc

SEQ ID NO: 191768 - DNA, 11 bp, Unknown
  misc_feature (1)..( 11): Result.006 file - promoters50/4771674
attctatccaa

SEQ ID NO: 191769 - DNA, 11 bp, Unknown
  misc_feature (1)..( 11): Result.006 file - promoters50/4771674
attcaatccaa

SEQ ID NO: 191770 - DNA, 11 bp, Unknown
  misc_feature (1)..( 11): Result.006 file - promoters50/4771674
ttccaatcttg

SEQ ID NO: 191771 - DNA, 12 bp, Unknown
  misc_feature (1)..( 12): Result.006 file - promoters50/4771674
gttctaatcagc

SEQ ID NO: 191772 - DNA, 12 bp, Unknown
  misc_feature (1)..( 12): Result.006 file - promoters50/4771674
aaagcaatctca

SEQ ID NO: 191773 - DNA, 12 bp, Unknown
  misc_feature (1)..( 12): Result.006 file - promoters50/4771677
taaggaatctat

SEQ ID NO: 191774 - DNA, 15 bp, Unknown
  misc_feature (1)..( 15): Result.006 file - promoters50/4771677
aaaataataataaaa

SEQ ID NO: 191775 - DNA, 15 bp, Unknown
  misc_feature (1)..( 15): Result.006 file - promoters50/4771677
gaaatcataatagag

SEQ ID NO: 191776 - DNA, 15 bp, Unknown
  misc_feature (1)..( 15): Result.006 file - promoters50/4771677
attttaaaaaaagaa

SEQ ID NO: 191777 - DNA, 15 bp, Unknown
  misc_feature (1)..( 15): Result.006 file - promoters50/4771677
tcaattatatatata

SEQ ID NO: 191778 - DNA, 15 bp, Unknown
  misc_feature (1)..( 15): Result.006 file - promoters50/4771677
aaaatgaaaaacaaa

SEQ ID NO: 191779 - DNA, 15 bp, Unknown
  misc_feature (1)..( 15): Result.006 file - promoters50/4771677
caaacaaatgtttgt

SEQ ID NO: 191780 - DNA, 15 bp, Unknown
  misc_feature (1)..( 15): Result.006 file - promoters50/4771677
ctacttattccatta

SEQ ID NO: 191781 - DNA, 18 bp, Unknown
  misc_feature (1)..( 18): Result.006 file - promoters50/4771677
ccataaaactcaaaaatc

SEQ ID NO: 191782 - DNA, 18 bp, Unknown
  misc_feature (1)..( 18): Result.006 file - promoters50/4771677
ccataaagcaaacaatgg

SEQ ID NO: 191783 - DNA, 18 bp, Unknown
  misc_feature (1)..( 18): Result.006 file - promoters50/4771677
aaataaaagaattaaacc

SEQ ID NO: 191784 - DNA, 18 bp, Unknown
  misc_feature (1)..( 18): Result.006 file - promoters50/4771677
aattaaaaataaacaaaa

SEQ ID NO: 191785 - DNA, 18 bp, Unknown
  misc_feature (1)..( 18): Result.006 file - promoters50/4771677
ccaaaaaaaaaacaaaga

SEQ ID NO: 191786 - DNA, 18 bp, Unknown
  misc_feature (1)..( 18): Result.006 file - promoters50/4771677
ttatacaagaaaactcat

SEQ ID NO: 191787 - DNA, 10 bp, Unknown
  misc_feature (1)..( 10): Result.006 file - promoters50/4771677
caatctcaat

SEQ ID NO: 191788 - DNA, 10 bp, Unknown
  misc_feature (1)..( 10): Result.006 file - promoters50/4771677
ccatctcacg

SEQ ID NO: 191789 - DNA, 10 bp, Unknown
  misc_feature (1)..( 10): Result.006 file - promoters50/4771677
atatcacaaa

SEQ ID NO: 191790 - DNA, 10 bp, Unknown
  misc_feature (1)..( 10): Result.006 file - promoters50/4771677
aaatgtcaac

SEQ ID NO: 191791 - DNA, 10 bp, Unknown
  misc_feature (1)..( 10): Result.006 file - promoters50/4771677
aaatgttatt

SEQ ID NO: 191792 - DNA, 10 bp, Unknown
  misc_feature (1)..( 10): Result.006 file - promoters50/4771677
caatgatatt

SEQ ID NO: 191793 - DNA, 11 bp, Unknown
  misc_feature (1)..( 11): Result.006 file - promoters50/4771677
aaaactcaaaa

SEQ ID NO: 191794 - DNA, 11 bp, Unknown
  misc_feature (1)..( 11): Result.006 file - promoters50/4771677
caaaatcaaaa

SEQ ID NO: 191795 - DNA, 11 bp, Unknown
  misc_feature (1)..( 11): Result.006 file - promoters50/4771677
aaaactcatta

SEQ ID NO: 191796 - DNA, 11 bp, Unknown
  misc_feature (1)..( 11): Result.006 file - promoters50/4771677
ataaagcaaac

SEQ ID NO: 191797 - DNA, 11 bp, Unknown
  misc_feature (1)..( 11): Result.006 file - promoters50/4771677
aaaaaacaaag

SEQ ID NO: 191798 - DNA, 11 bp, Unknown
  misc_feature (1)..( 11): Result.006 file - promoters50/4771677
ataaataaaag

SEQ ID NO: 191799 - DNA, 15 bp, Unknown
  misc_feature (1)..( 15): Result.006 file - promoters50/4771677
aaccaaaaccaaaac

SEQ ID NO: 191800 - DNA, 15 bp, Unknown
  misc_feature (1)..( 15): Result.006 file - promoters50/4771677
aaaaaaaaacaaaga

SEQ ID NO: 191801 - DNA, 16 bp, Unknown
  misc_feature (1)..( 16): Result.006 file - promoters50/4771677
gcccataaagcaaaca

SEQ ID NO: 191802 - DNA, 16 bp, Unknown
  misc_feature (1)..( 16): Result.006 file - promoters50/4771677
taaaaataaacaaaat

SEQ ID NO: 191803 - DNA, 16 bp, Unknown
  misc_feature (1)..( 16): Result.006 file - promoters50/4771677
taacaataaataaaag

SEQ ID NO: 191804 - DNA, 16 bp, Unknown
  misc_feature (1)..( 16): Result.006 file - promoters50/4771713
gtgttttatacaagaa

SEQ ID NO: 191805 - DNA, 8 bp, Unknown
  misc_feature (1)..( 8): Result.006 file - promoters50/4771713
aaattgtg

SEQ ID NO: 191806 - DNA, 8 bp, Unknown
  misc_feature (1)..( 8): Result.006 file - promoters50/4771713
aaattggg

SEQ ID NO: 191807 - DNA, 8 bp, Unknown
  misc_feature (1)..( 8): Result.006 file - promoters50/4771713
taatcggg

SEQ ID NO: 191808 - DNA, 8 bp, Unknown
  misc_feature (1)..( 8): Result.006 file - promoters50/4771713
atataaag

SEQ ID NO: 191809 - DNA, 8 bp, Unknown
  misc_feature (1)..( 8): Result.006 file - promoters50/4771713
ttattaag

SEQ ID NO: 191810 - DNA, 8 bp, Unknown
  misc_feature (1)..( 8): Result.006 file - promoters50/4771713
ttagtaat

SEQ ID NO: 191811 - DNA, 8 bp, Unknown
  misc_feature (1)..( 8): Result.006 file - promoters50/4771713
aataaaac

SEQ ID NO: 191812 - DNA, 8 bp, Unknown
  misc_feature (1)..( 8): Result.006 file - promoters50/4771713
aataaaaa

SEQ ID NO: 191813 - DNA, 8 bp, Unknown
  misc_feature (1)..( 8): Result.006 file - promoters50/4771713
ggtaaaac

SEQ ID NO: 191814 - DNA, 11 bp, Unknown
  misc_feature (1)..( 11): Result.006 file - promoters50/4771713
gcacaataatt

SEQ ID NO: 191815 - DNA, 11 bp, Unknown
  misc_feature (1)..( 11): Result.006 file - promoters50/4771713
aaacaattatt

SEQ ID NO: 191816 - DNA, 11 bp, Unknown
  misc_feature (1)..( 11): Result.006 file - promoters50/4771713
aaacgattcca

SEQ ID NO: 191817 - DNA, 7 bp, Unknown
  misc_feature (1)..( 7): Result.006 file - promoters50/4771713
atttatt

SEQ ID NO: 191818 - DNA, 7 bp, Unknown
  misc_feature (1)..( 7): Result.006 file - promoters50/4771713
attaatt

SEQ ID NO: 191819 - DNA, 7 bp, Unknown
  misc_feature (1)..( 7): Result.006 file - promoters50/4771713
ctttatt

SEQ ID NO: 191820 - DNA, 9 bp, Unknown
  misc_feature (1)..( 9): Result.006 file - promoters50/4771713
aaaattgct

SEQ ID NO: 191821 - DNA, 9 bp, Unknown
  misc_feature (1)..( 9): Result.006 file - promoters50/4771713
aaatttgtt

SEQ ID NO: 191822 - DNA, 9 bp, Unknown
  misc_feature (1)..( 9): Result.006 file - promoters50/4771713
atatttgtt

SEQ ID NO: 191823 - DNA, 10 bp, Unknown
  misc_feature (1)..( 10): Result.006 file - promoters50/4771713
taaagtaaag

SEQ ID NO: 191824 - DNA, 10 bp, Unknown
  misc_feature (1)..( 10): Result.006 file - promoters50/4771713
aaaagaaaag

SEQ ID NO: 191825 - DNA, 10 bp, Unknown
  misc_feature (1)..( 10): Result.006 file - promoters50/4771725
aaaacaaagg

SEQ ID NO: 191826 - DNA, 13 bp, Unknown
  misc_feature (1)..( 13): Result.006 file - promoters50/4771725
cagagtaatggac

SEQ ID NO: 191827 - DNA, 13 bp, Unknown
  misc_feature (1)..( 13): Result.006 file - promoters50/4771725
cagaataaaaaca

SEQ ID NO: 191828 - DNA, 13 bp, Unknown
  misc_feature (1)..( 13): Result.006 file - promoters50/4771725
cagagtaattgat

SEQ ID NO: 191829 - DNA, 13 bp, Unknown
  misc_feature (1)..( 13): Result.006 file - promoters50/4771725
ttaattaaaagaa

SEQ ID NO: 191830 - DNA, 13 bp, Unknown
  misc_feature (1)..( 13): Result.006 file - promoters50/4771725
aaataataataat

SEQ ID NO: 191831 - DNA, 13 bp, Unknown
  misc_feature (1)..( 13): Result.006 file - promoters50/4771725
aaagaataaaaat

SEQ ID NO: 191832 - DNA, 13 bp, Unknown
  misc_feature (1)..( 13): Result.006 file - promoters50/4771725
cgttaatcaaata

SEQ ID NO: 191833 - DNA, 13 bp, Unknown
  misc_feature (1)..( 13): Result.006 file - promoters50/4771737
cactcatataaat

SEQ ID NO: 191834 - DNA, 11 bp, Unknown
  misc_feature (1)..( 11): Result.006 file - promoters50/4771737
atgaaaataaa

SEQ ID NO: 191835 - DNA, 11 bp, Unknown
  misc_feature (1)..( 11): Result.006 file - promoters50/4771737
ttgcaaataaa

SEQ ID NO: 191836 - DNA, 11 bp, Unknown
  misc_feature (1)..( 11): Result.006 file - promoters50/4771737
ctttcaataaa

SEQ ID NO: 191837 - DNA, 11 bp, Unknown
  misc_feature (1)..( 11): Result.006 file - promoters50/4771741
atgataataat

SEQ ID NO: 191838 - DNA, 9 bp, Unknown
  misc_feature (1)..( 9): Result.006 file - promoters50/4771741
taaaagaag

SEQ ID NO: 191839 - DNA, 9 bp, Unknown
  misc_feature (1)..( 9): Result.006 file - promoters50/4771741
taaaagaat

SEQ ID NO: 191840 - DNA, 9 bp, Unknown
  misc_feature (1)..( 9): Result.006 file - promoters50/4771741
gtaaataag

SEQ ID NO: 191841 - DNA, 12 bp, Unknown
  misc_feature (1)..( 12): Result.006 file - promoters50/4771741
cactttctctct

SEQ ID NO: 191842 - DNA, 12 bp, Unknown
  misc_feature (1)..( 12): Result.006 file - promoters50/4771741
aactttctagca

SEQ ID NO: 191843 - DNA, 12 bp, Unknown
  misc_feature (1)..( 12): Result.006 file - promoters50/4771741
cactctctctct

SEQ ID NO: 191844 - DNA, 10 bp, Unknown
  misc_feature (1)..( 10): Result.006 file - promoters50/4771741
cataagtatt

SEQ ID NO: 191845 - DNA, 10 bp, Unknown
  misc_feature (1)..( 10): Result.006 file - promoters50/4771741
tttaattatt

SEQ ID NO: 191846 - DNA, 10 bp, Unknown
  misc_feature (1)..( 10): Result.006 file - promoters50/4771741
tttaattggt

SEQ ID NO: 191847 - DNA, 8 bp, Unknown
  misc_feature (1)..( 8): Result.006 file - promoters50/4771741
aaaagaaa

SEQ ID NO: 191848 - DNA, 8 bp, Unknown
  misc_feature (1)..( 8): Result.006 file - promoters50/4771741
aaaataaa

SEQ ID NO: 191849 - DNA, 8 bp, Unknown
  misc_feature (1)..( 8): Result.006 file - promoters50/4771741
aaaaaaaa

SEQ ID NO: 191850 - DNA, 8 bp, Unknown
  misc_feature (1)..( 8): Result.006 file - promoters50/4771741
tataaatc

SEQ ID NO: 191851 - DNA, 8 bp, Unknown
  misc_feature (1)..( 8): Result.006 file - promoters50/4771741
tataaata

SEQ ID NO: 191852 - DNA, 8 bp, Unknown
  misc_feature (1)..( 8): Result.006 file - promoters50/4771741
tatatata

SEQ ID NO: 191853 - DNA, 8 bp, Unknown
  misc_feature (1)..( 8): Result.006 file - promoters50/4771741
ttttaact

SEQ ID NO: 191854 - DNA, 8 bp, Unknown
  misc_feature (1)..( 8): Result.006 file - promoters50/4771741
ttttaatt

SEQ ID NO: 191855 - DNA, 8 bp, Unknown
  misc_feature (1)..( 8): Result.006 file - promoters50/4771745
atttaatt

SEQ ID NO: 191856 - DNA, 8 bp, Unknown
  misc_feature (1)..( 8): Result.006 file - promoters50/4771745
tgataatg

SEQ ID NO: 191857 - DNA, 8 bp, Unknown
  misc_feature (1)..( 8): Result.006 file - promoters50/4771745
ggataatt

SEQ ID NO: 191858 - DNA, 8 bp, Unknown
  misc_feature (1)..( 8): Result.006 file - promoters50/4771785
ggatgatt

SEQ ID NO: 191859 - DNA, 10 bp, Unknown
  misc_feature (1)..( 10): Result.006 file - promoters50/4771785
ttattttaat

SEQ ID NO: 191860 - DNA, 10 bp, Unknown
  misc_feature (1)..( 10): Result.006 file - promoters50/4771785
gattttgaat

SEQ ID NO: 191861 - DNA, 10 bp, Unknown
  misc_feature (1)..( 10): Result.006 file - promoters50/4771785
atattttatc

SEQ ID NO: 191862 - DNA, 10 bp, Unknown
  misc_feature (1)..( 10): Result.006 file - promoters50/4771785
atatttaaaa

SEQ ID NO: 191863 - DNA, 12 bp, Unknown
  misc_feature (1)..( 12): Result.006 file - promoters50/4771785
gatatttataat

SEQ ID NO: 191864 - DNA, 12 bp, Unknown
  misc_feature (1)..( 12): Result.006 file - promoters50/4771785
gatattatagga

SEQ ID NO: 191865 - DNA, 12 bp, Unknown
  misc_feature (1)..( 12): Result.006 file - promoters50/4771785
aatatttgtaat

SEQ ID NO: 191866 - DNA, 12 bp, Unknown
  misc_feature (1)..( 12): Result.006 file - promoters50/4771785
atatttataata

SEQ ID NO: 191867 - DNA, 12 bp, Unknown
  misc_feature (1)..( 12): Result.006 file - promoters50/4771785
tctgatattata

SEQ ID NO: 191868 - DNA, 12 bp, Unknown
  misc_feature (1)..( 12): Result.006 file - promoters50/4771785
atatttgtaatt

SEQ ID NO: 191869 - DNA, 11 bp, Unknown
  misc_feature (1)..( 11): Result.006 file - promoters50/4771785
ataaatgagaa

SEQ ID NO: 191870 - DNA, 11 bp, Unknown
  misc_feature (1)..( 11): Result.006 file - promoters50/4771785
ataactgatga

SEQ ID NO: 191871 - DNA, 11 bp, Unknown
  misc_feature (1)..( 11): Result.006 file - promoters50/4771785
ttaaaagagaa

SEQ ID NO: 191872 - DNA, 9 bp, Unknown
  misc_feature (1)..( 9): Result.006 file - promoters50/4771785
tatatgtaa

SEQ ID NO: 191873 - DNA, 9 bp, Unknown
  misc_feature (1)..( 9): Result.006 file - promoters50/4771785
tatatttaa

SEQ ID NO: 191874 - DNA, 9 bp, Unknown
  misc_feature (1)..( 9): Result.006 file - promoters50/4771785
tggatttaa

SEQ ID NO: 191875 - DNA, 7 bp, Unknown
  misc_feature (1)..( 7): Result.006 file - promoters50/4771785
gatttat

SEQ ID NO: 191876 - DNA, 7 bp, Unknown
  misc_feature (1)..( 7): Result.006 file - promoters50/4771785
aatttat

SEQ ID NO: 191877 - DNA, 7 bp, Unknown
  misc_feature (1)..( 7): Result.006 file - promoters50/4771785
gatttat

SEQ ID NO: 191878 - DNA, 9 bp, Unknown
  misc_feature (1)..( 9): Result.006 file - promoters50/4771785
tctttttag

SEQ ID NO: 191879 - DNA, 9 bp, Unknown
  misc_feature (1)..( 9): Result.006 file - promoters50/4771785
tatttttac

SEQ ID NO: 191880 - DNA, 9 bp, Unknown
  misc_feature (1)..( 9): Result.006 file - promoters50/4771785
aattttttt

SEQ ID NO: 191881 - DNA, 8 bp, Unknown
  misc_feature (1)..( 8): Result.006 file - promoters50/4771785
tattttta

SEQ ID NO: 191882 - DNA, 8 bp, Unknown
  misc_feature (1)..( 8): Result.006 file - promoters50/4771785
tatattta

SEQ ID NO: 191883 - DNA, 8 bp, Unknown
  misc_feature (1)..( 8): Result.006 file - promoters50/4771785
tattttat

SEQ ID NO: 191884 - DNA, 9 bp, Unknown
  misc_feature (1)..( 9): Result.006 file - promoters50/4771785
atgtatttt

SEQ ID NO: 191885 - DNA, 9 bp, Unknown
  misc_feature (1)..( 9): Result.006 file - promoters50/4771785
aattatttt

SEQ ID NO: 191886 - DNA, 9 bp, Unknown
  misc_feature (1)..( 9): Result.006 file - promoters50/4771785
atggattta

SEQ ID NO: 191887 - DNA, 9 bp, Unknown
  misc_feature (1)..( 9): Result.006 file - promoters50/4771785
ttggatttt

SEQ ID NO: 191888 - DNA, 9 bp, Unknown
  misc_feature (1)..( 9): Result.006 file - promoters50/4771785
agaaataaa

SEQ ID NO: 191889 - DNA, 9 bp, Unknown
  misc_feature (1)..( 9): Result.006 file - promoters50/4771785
agaaatata

SEQ ID NO: 191890 - DNA, 9 bp, Unknown
  misc_feature (1)..( 9): Result.006 file - promoters50/4771785
ggaactata

SEQ ID NO: 191891 - DNA, 8 bp, Unknown
  misc_feature (1)..( 8): Result.006 file - promoters50/4771785
tcgtgaat

SEQ ID NO: 191892 - DNA, 8 bp, Unknown
  misc_feature (1)..( 8): Result.006 file - promoters50/4771785
aagtgaat

SEQ ID NO: 191893 - DNA, 8 bp, Unknown
  misc_feature (1)..( 8): Result.006 file - promoters50/4771785
aagagaag

SEQ ID NO: 191894 - DNA, 14 bp, Unknown
  misc_feature (1)..( 14): Result.006 file - promoters50/4771785
ttaacacgatttga

SEQ ID NO: 191895 - DNA, 14 bp, Unknown
  misc_feature (1)..( 14): Result.006 file - promoters50/4771785
ttaacaattttttt

SEQ ID NO: 191896 - DNA, 14 bp, Unknown
  misc_feature (1)..( 14): Result.006 file - promoters50/4771785
ttaataatttattt

SEQ ID NO: 191897 - DNA, 14 bp, Unknown
  misc_feature (1)..( 14): Result.006 file - promoters50/4771785
ttttagatttattt

SEQ ID NO: 191898 - DNA, 14 bp, Unknown
  misc_feature (1)..( 14): Result.006 file - promoters50/4771785
ttaacaattttttt

SEQ ID NO: 191899 - DNA, 14 bp, Unknown
  misc_feature (1)..( 14): Result.006 file - promoters50/4771785
ttaataatttattt

SEQ ID NO: 191900 - DNA, 13 bp, Unknown
  misc_feature (1)..( 13): Result.006 file - promoters50/4771785
tatcatcactatt

SEQ ID NO: 191901 - DNA, 13 bp, Unknown
  misc_feature (1)..( 13): Result.006 file - promoters50/4771785
ttgaatcaatatt

SEQ ID NO: 191902 - DNA, 13 bp, Unknown
  misc_feature (1)..( 13): Result.006 file - promoters50/4771785
ttgattcaaaatt

SEQ ID NO: 191903 - DNA, 8 bp, Unknown
  misc_feature (1)..( 8): Result.006 file - promoters50/4771785
tgagaaag

SEQ ID NO: 191904 - DNA, 8 bp, Unknown
  misc_feature (1)..( 8): Result.006 file - promoters50/4771785
tgaaaaaa

SEQ ID NO: 191905 - DNA, 8 bp, Unknown
  misc_feature (1)..( 8): Result.006 file - promoters50/4771785
ctaaaaaa

SEQ ID NO: 191906 - DNA, 9 bp, Unknown
  misc_feature (1)..( 9): Result.006 file - promoters50/4771785
ggtatttct

SEQ ID NO: 191907 - DNA, 9 bp, Unknown
  misc_feature (1)..( 9): Result.006 file - promoters50/4771785
taaatttct

SEQ ID NO: 191908 - DNA, 9 bp, Unknown
  misc_feature (1)..( 9): Result.006 file - promoters50/4771789
taactttca

SEQ ID NO: 191909 - DNA, 14 bp, Unknown
  misc_feature (1)..( 14): Result.006 file - promoters50/4771789
gtatttaagttttt

SEQ ID NO: 191910 - DNA, 14 bp, Unknown
  misc_feature (1)..( 14): Result.006 file - promoters50/4771789
ttctatgagttttt

SEQ ID NO: 191911 - DNA, 14 bp, Unknown
  misc_feature (1)..( 14): Result.006 file - promoters50/4771789
gtacttaagttttg

SEQ ID NO: 191912 - DNA, 12 bp, Unknown
  misc_feature (1)..( 12): Result.006 file - promoters50/4771789
tttttgtttgtt

SEQ ID NO: 191913 - DNA, 12 bp, Unknown
  misc_feature (1)..( 12): Result.006 file - promoters50/4771789
tttttttttgtt

SEQ ID NO: 191914 - DNA, 12 bp, Unknown
  misc_feature (1)..( 12): Result.006 file - promoters50/4771789
gttttgtccgat

SEQ ID NO: 191915 - DNA, 8 bp, Unknown
  misc_feature (1)..( 8): Result.006 file - promoters50/4771789
aaataaat

SEQ ID NO: 191916 - DNA, 8 bp, Unknown
  misc_feature (1)..( 8): Result.006 file - promoters50/4771789
aaataaat

SEQ ID NO: 191917 - DNA, 8 bp, Unknown
  misc_feature (1)..( 8): Result.006 file - promoters50/4771789
tgataaat

SEQ ID NO: 191918 - DNA, 8 bp, Unknown
  misc_feature (1)..( 8): Result.006 file - promoters50/4771789
aaccaaaa

SEQ ID NO: 191919 - DNA, 8 bp, Unknown
  misc_feature (1)..( 8): Result.006 file - promoters50/4771789
aactaaac

SEQ ID NO: 191920 - DNA, 8 bp, Unknown
  misc_feature (1)..( 8): Result.006 file - promoters50/4771793
caccaaaa

SEQ ID NO: 191921 - DNA, 8 bp, Unknown
  misc_feature (1)..( 8): Result.006 file - promoters50/4771793
tacattta

SEQ ID NO: 191922 - DNA, 8 bp, Unknown
  misc_feature (1)..( 8): Result.006 file - promoters50/4771793
tacttttt

SEQ ID NO: 191923 - DNA, 8 bp, Unknown
  misc_feature (1)..( 8): Result.006 file - promoters50/4771793
cccttttt

SEQ ID NO: 191924 - DNA, 9 bp, Unknown
  misc_feature (1)..( 9): Result.006 file - promoters50/4771793
ttaaaaaaa

SEQ ID NO: 191925 - DNA, 9 bp, Unknown
  misc_feature (1)..( 9): Result.006 file - promoters50/4771793
ttaacaaaa

SEQ ID NO: 191926 - DNA, 9 bp, Unknown
  misc_feature (1)..( 9): Result.006 file - promoters50/4771793
gtaataaag

SEQ ID NO: 191927 - DNA, 10 bp, Unknown
  misc_feature (1)..( 10): Result.006 file - promoters50/4771793
aattgaaaaa

SEQ ID NO: 191928 - DNA, 10 bp, Unknown
  misc_feature (1)..( 10): Result.006 file - promoters50/4771793
tgttgagaaa

SEQ ID NO: 191929 - DNA, 10 bp, Unknown
  misc_feature (1)..( 10): Result.006 file - promoters50/4771808
aattgaagac

SEQ ID NO: 191930 - DNA, 9 bp, Unknown
  misc_feature (1)..( 9): Result.006 file - promoters50/4771808
caaacaaaa

SEQ ID NO: 191931 - DNA, 9 bp, Unknown
  misc_feature (1)..( 9): Result.006 file - promoters50/4771808
gaaactaaa

SEQ ID NO: 191932 - DNA, 9 bp, Unknown
  misc_feature (1)..( 9): Result.006 file - promoters50/4771872
gaaactatg

SEQ ID NO: 191933 - DNA, 13 bp, Unknown
  misc_feature (1)..( 13): Result.006 file - promoters50/4771872
aattaaattgtga

SEQ ID NO: 191934 - DNA, 13 bp, Unknown
  misc_feature (1)..( 13): Result.006 file - promoters50/4771872
aaagaaagtgttt

SEQ ID NO: 191935 - DNA, 13 bp, Unknown
  misc_feature (1)..( 13): Result.006 file - promoters50/4771872
tgagaaattgagg

SEQ ID NO: 191936 - DNA, 13 bp, Unknown
  misc_feature (1)..( 13): Result.006 file - promoters50/4771872
cattaaattaatt

SEQ ID NO: 191937 - DNA, 13 bp, Unknown
  misc_feature (1)..( 13): Result.006 file - promoters50/4771872
aatagaagtcttt

SEQ ID NO: 191938 - DNA, 13 bp, Unknown
  misc_feature (1)..( 13): Result.006 file - promoters50/4771872
catgaaacttttt

SEQ ID NO: 191939 - DNA, 13 bp, Unknown
  misc_feature (1)..( 13): Result.006 file - promoters50/4771872
gattaaaccaaac

SEQ ID NO: 191940 - DNA, 13 bp, Unknown
  misc_feature (1)..( 13): Result.006 file - promoters50/4771872
attgtttatgctt

SEQ ID NO: 191941 - DNA, 13 bp, Unknown
  misc_feature (1)..( 13): Result.006 file - promoters50/4771872
tatgtttagtctc

SEQ ID NO: 191942 - DNA, 13 bp, Unknown
  misc_feature (1)..( 13): Result.006 file - promoters50/4771872
attctttcttagg

SEQ ID NO: 191943 - DNA, 13 bp, Unknown
  misc_feature (1)..( 13): Result.006 file - promoters50/4771872
agagtttagagaa

SEQ ID NO: 191944 - DNA, 13 bp, Unknown
  misc_feature (1)..( 13): Result.006 file - promoters50/4771872
aaattttaaagaa

SEQ ID NO: 191945 - DNA, 13 bp, Unknown
  misc_feature (1)..( 13): Result.006 file - promoters50/4771872
attgtaaaaagaa

SEQ ID NO: 191946 - DNA, 8 bp, Unknown
  misc_feature (1)..( 8): Result.006 file - promoters50/4771872
agataaga

SEQ ID NO: 191947 - DNA, 8 bp, Unknown
  misc_feature (1)..( 8): Result.006 file - promoters50/4771872
ggataagg

SEQ ID NO: 191948 - DNA, 8 bp, Unknown
  misc_feature (1)..( 8): Result.006 file - promoters50/4771872
ggataagt

SEQ ID NO: 191949 - DNA, 8 bp, Unknown
  misc_feature (1)..( 8): Result.006 file - promoters50/4771872
ggaaaagc

SEQ ID NO: 191950 - DNA, 8 bp, Unknown
  misc_feature (1)..( 8): Result.006 file - promoters50/4771872
gaaaaagc

SEQ ID NO: 191951 - DNA, 8 bp, Unknown
  misc_feature (1)..( 8): Result.006 file - promoters50/4771879
tgataagt

SEQ ID NO: 191952 - DNA, 12 bp, Unknown
  misc_feature (1)..( 12): Result.006 file - promoters50/4771879
gtcctatgtaat

SEQ ID NO: 191953 - DNA, 12 bp, Unknown
  misc_feature (1)..( 12): Result.006 file - promoters50/4771879
tttatatttaat

SEQ ID NO: 191954 - DNA, 12 bp, Unknown
  misc_feature (1)..( 12): Result.006 file - promoters50/4771879
gtcgtatctaag

SEQ ID NO: 191955 - DNA, 8 bp, Unknown
  misc_feature (1)..( 8): Result.006 file - promoters50/4771879
ataaattg

SEQ ID NO: 191956 - DNA, 8 bp, Unknown
  misc_feature (1)..( 8): Result.006 file - promoters50/4771879
gtaatttg

SEQ ID NO: 191957 - DNA, 8 bp, Unknown
  misc_feature (1)..( 8): Result.006 file - promoters50/4771883
gtaattta

SEQ ID NO: 191958 - DNA, 18 bp, Unknown
  misc_feature (1)..( 18): Result.006 file - promoters50/4771883
aagacatacatataacat

SEQ ID NO: 191959 - DNA, 18 bp, Unknown
  misc_feature (1)..( 18): Result.006 file - promoters50/4771883
atattatatatatatata

SEQ ID NO: 191960 - DNA, 18 bp, Unknown
  misc_feature (1)..( 18): Result.006 file - promoters50/4771883
atatttttcatttaattg

SEQ ID NO: 191961 - DNA, 18 bp, Unknown
  misc_feature (1)..( 18): Result.006 file - promoters50/4771883
atatcatatatatatagc

SEQ ID NO: 191962 - DNA, 18 bp, Unknown
  misc_feature (1)..( 18): Result.006 file - promoters50/4771883
ttcgaccaaatttatcat

SEQ ID NO: 191963 - DNA, 10 bp, Unknown
  misc_feature (1)..( 10): Result.006 file - promoters50/4771883
atttacaaag

SEQ ID NO: 191964 - DNA, 10 bp, Unknown
  misc_feature (1)..( 10): Result.006 file - promoters50/4771883
aaatacaaag

SEQ ID NO: 191965 - DNA, 10 bp, Unknown
  misc_feature (1)..( 10): Result.006 file - promoters50/4771883
aactacaaat

SEQ ID NO: 191966 - DNA, 10 bp, Unknown
  misc_feature (1)..( 10): Result.006 file - promoters50/4771883
aaataaaaat

SEQ ID NO: 191967 - DNA, 9 bp, Unknown
  misc_feature (1)..( 9): Result.006 file - promoters50/4771883
caacaatgg

SEQ ID NO: 191968 - DNA, 9 bp, Unknown
  misc_feature (1)..( 9): Result.006 file - promoters50/4771883
caataataa

SEQ ID NO: 191969 - DNA, 9 bp, Unknown
  misc_feature (1)..( 9): Result.006 file - promoters50/4771883
aaataatta

SEQ ID NO: 191970 - DNA, 9 bp, Unknown
  misc_feature (1)..( 9): Result.006 file - promoters50/4771883
atatattta

SEQ ID NO: 191971 - DNA, 8 bp, Unknown
  misc_feature (1)..( 8): Result.006 file - promoters50/4771883
ttggttta

SEQ ID NO: 191972 - DNA, 8 bp, Unknown
  misc_feature (1)..( 8): Result.006 file - promoters50/4771883
ttgttttg

SEQ ID NO: 191973 - DNA, 8 bp, Unknown
  misc_feature (1)..( 8): Result.006 file - promoters50/4771883
acggttta

SEQ ID NO: 191974 - DNA, 8 bp, Unknown
  misc_feature (1)..( 8): Result.006 file - promoters50/4771895
gcggtttc

SEQ ID NO: 191975 - DNA, 13 bp, Unknown
  misc_feature (1)..( 13): Result.006 file - promoters50/4771895
tattcgatctttt

SEQ ID NO: 191976 - DNA, 13 bp, Unknown
  misc_feature (1)..( 13): Result.006 file - promoters50/4771895
aattagatttttt

SEQ ID NO: 191977 - DNA, 13 bp, Unknown
  misc_feature (1)..( 13): Result.006 file - promoters50/4771895
atagagatcttta

SEQ ID NO: 191978 - DNA, 13 bp, Unknown
  misc_feature (1)..( 13): Result.006 file - promoters50/4771895
aattggatccgaa

SEQ ID NO: 191979 - DNA, 13 bp, Unknown
  misc_feature (1)..( 13): Result.006 file - promoters50/4771895
atttacattctat

SEQ ID NO: 191980 - DNA, 16 bp, Unknown
  misc_feature (1)..( 16): Result.006 file - promoters50/4771895
ttgatatcaaactaat

SEQ ID NO: 191981 - DNA, 16 bp, Unknown
  misc_feature (1)..( 16): Result.006 file - promoters50/4771895
tgtcacaaaaactaga

SEQ ID NO: 191982 - DNA, 15 bp, Unknown
  misc_feature (1)..( 15): Result.006 file - promoters50/4771895
aaagagaaaacaaga

SEQ ID NO: 191983 - DNA, 16 bp, Unknown
  misc_feature (1)..( 16): Result.006 file - promoters50/4771895
tattcaaaaatctaaa

SEQ ID NO: 191984 - DNA, 17 bp, Unknown
  misc_feature (1)..( 17): Result.006 file - promoters50/4771903
ttatccaataatctaca

SEQ ID NO: 191985 - DNA, 11 bp, Unknown
  misc_feature (1)..( 11): Result.006 file - promoters50/4771903
ttcttcttttt

SEQ ID NO: 191986 - DNA, 11 bp, Unknown
  misc_feature (1)..( 11): Result.006 file - promoters50/4771903
ttcttatttta

SEQ ID NO: 191987 - DNA, 12 bp, Unknown
  misc_feature (1)..( 12): Result.006 file - promoters50/4771903
cgcttccttttc

SEQ ID NO: 191988 - DNA, 12 bp, Unknown
  misc_feature (1)..( 12): Result.006 file - promoters50/4771903
taccatattttc

SEQ ID NO: 191989 - DNA, 12 bp, Unknown
  misc_feature (1)..( 12): Result.006 file - promoters50/4771903
aaaaagatttta

SEQ ID NO: 191990 - DNA, 12 bp, Unknown
  misc_feature (1)..( 12): Result.006 file - promoters50/4771903
ttgtttccttca

SEQ ID NO: 191991 - DNA, 15 bp, Unknown
  misc_feature (1)..( 15): Result.006 file - promoters50/4771903
attttaaaaaattaa

SEQ ID NO: 191992 - DNA, 15 bp, Unknown
  misc_feature (1)..( 15): Result.006 file - promoters50/4771903
ttgaatcaaaattat

SEQ ID NO: 191993 - DNA, 15 bp, Unknown
  misc_feature (1)..( 15): Result.006 file - promoters50/4771903
cttcctacaaattat

SEQ ID NO: 191994 - DNA, 15 bp, Unknown
  misc_feature (1)..( 15): Result.006 file - promoters50/4771903
tagtgaggaaagtat

SEQ ID NO: 191995 - DNA, 15 bp, Unknown
  misc_feature (1)..( 15): Result.006 file - promoters50/4771903
tacgattacaattat

SEQ ID NO: 191996 - DNA, 15 bp, Unknown
  misc_feature (1)..( 15): Result.006 file - promoters50/4771903
ttgaatctaaatcat

SEQ ID NO: 191997 - DNA, 10 bp, Unknown
  misc_feature (1)..( 10): Result.006 file - promoters50/4771903
tgttatttga

SEQ ID NO: 191998 - DNA, 10 bp, Unknown
  misc_feature (1)..( 10): Result.006 file - promoters50/4771903
aggtatttga

SEQ ID NO: 191999 - DNA, 10 bp, Unknown
  misc_feature (1)..( 10): Result.006 file - promoters50/4771903
aataatttga

SEQ ID NO: 192000 - DNA, 10 bp, Unknown
  misc_feature (1)..( 10): Result.006 file - promoters50/4771903
acttatttta

SEQ ID NO: 192001 - DNA, 10 bp, Unknown
  misc_feature (1)..( 10): Result.006 file - promoters50/4771903
acaaatttgc

SEQ ID NO: 192002 - DNA, 10 bp, Unknown
  misc_feature (1)..( 10): Result.006 file - promoters50/4771903
acatattttt

SEQ ID NO: 192003 - DNA, 11 bp, Unknown
  misc_feature (1)..( 11): Result.006 file - promoters50/4771903
gctaaaagtaa

SEQ ID NO: 192004 - DNA, 11 bp, Unknown
  misc_feature (1)..( 11): Result.006 file - promoters50/4771903
tctaaaaattg

SEQ ID NO: 192005 - DNA, 11 bp, Unknown
  misc_feature (1)..( 11): Result.006 file - promoters50/4771903
gctaaaataaa

SEQ ID NO: 192006 - DNA, 11 bp, Unknown
  misc_feature (1)..( 11): Result.006 file - promoters50/4771903
aataaaaattg

SEQ ID NO: 192007 - DNA, 11 bp, Unknown
  misc_feature (1)..( 11): Result.006 file - promoters50/4771903
tataaaataca

SEQ ID NO: 192008 - DNA, 11 bp, Unknown
  misc_feature (1)..( 11): Result.006 file - promoters50/4771903
gagaaaattga

SEQ ID NO: 192009 - DNA, 9 bp, Unknown
  misc_feature (1)..( 9): Result.006 file - promoters50/4771903
tctttttat

SEQ ID NO: 192010 - DNA, 9 bp, Unknown
  misc_feature (1)..( 9): Result.006 file - promoters50/4771903
attttctat

SEQ ID NO: 192011 - DNA, 9 bp, Unknown
  misc_feature (1)..( 9): Result.006 file - promoters50/4771903
cgtttttac

SEQ ID NO: 192012 - DNA, 9 bp, Unknown
  misc_feature (1)..( 9): Result.006 file - promoters50/4771903
agattttat

SEQ ID NO: 192013 - DNA, 9 bp, Unknown
  misc_feature (1)..( 9): Result.006 file - promoters50/4771903
attttctta

SEQ ID NO: 192014 - DNA, 9 bp, Unknown
  misc_feature (1)..( 9): Result.006 file - promoters50/4771903
tgtttcctt

SEQ ID NO: 192015 - DNA, 9 bp, Unknown
  misc_feature (1)..( 9): Result.006 file - promoters50/4771903
cttttccta

SEQ ID NO: 192016 - DNA, 9 bp, Unknown
  misc_feature (1)..( 9): Result.006 file - promoters50/4771903
ggtttttgc

SEQ ID NO: 192017 - DNA, 10 bp, Unknown
  misc_feature (1)..( 10): Result.006 file - promoters50/4771903
gaaagttttt

SEQ ID NO: 192018 - DNA, 10 bp, Unknown
  misc_feature (1)..( 10): Result.006 file - promoters50/4771903
gaaagtatcg

SEQ ID NO: 192019 - DNA, 10 bp, Unknown
  misc_feature (1)..( 10): Result.006 file - promoters50/4771903
aaaactttta

SEQ ID NO: 192020 - DNA, 10 bp, Unknown
  misc_feature (1)..( 10): Result.006 file - promoters50/4771903
aaaattattt

SEQ ID NO: 192021 - DNA, 10 bp, Unknown
  misc_feature (1)..( 10): Result.006 file - promoters50/4771903
acaattatat

SEQ ID NO: 192022 - DNA, 10 bp, Unknown
  misc_feature (1)..( 10): Result.006 file - promoters50/4771903
gatatttttt

SEQ ID NO: 192023 - DNA, 9 bp, Unknown
  misc_feature (1)..( 9): Result.006 file - promoters50/4771903
caaaattat

SEQ ID NO: 192024 - DNA, 9 bp, Unknown
  misc_feature (1)..( 9): Result.006 file - promoters50/4771903
aaaaattgt

SEQ ID NO: 192025 - DNA, 9 bp, Unknown
  misc_feature (1)..( 9): Result.006 file - promoters50/4771903
aaaaatata

SEQ ID NO: 192026 - DNA, 9 bp, Unknown
  misc_feature (1)..( 9): Result.006 file - promoters50/4771903
aaaaattgg

SEQ ID NO: 192027 - DNA, 9 bp, Unknown
  misc_feature (1)..( 9): Result.006 file - promoters50/4771903
gaaaattga

SEQ ID NO: 192028 - DNA, 9 bp, Unknown
  misc_feature (1)..( 9): Result.006 file - promoters50/4771911
taaaataaa

SEQ ID NO: 192029 - DNA, 13 bp, Unknown
  misc_feature (1)..( 13): Result.006 file - promoters50/4771911
tatacaaatacat

SEQ ID NO: 192030 - DNA, 13 bp, Unknown
  misc_feature (1)..( 13): Result.006 file - promoters50/4771911
gaaacaaaaacat

SEQ ID NO: 192031 - DNA, 13 bp, Unknown
  misc_feature (1)..( 13): Result.006 file - promoters50/4771911
gaaagaaagcttt

SEQ ID NO: 192032 - DNA, 9 bp, Unknown
  misc_feature (1)..( 9): Result.006 file - promoters50/4771911
aaaataaaa

SEQ ID NO: 192033 - DNA, 9 bp, Unknown
  misc_feature (1)..( 9): Result.006 file - promoters50/4771911
gaaatgaaa

SEQ ID NO: 192034 - DNA, 9 bp, Unknown
  misc_feature (1)..( 9): Result.006 file - promoters50/4771911
aaaataaaa

SEQ ID NO: 192035 - DNA, 8 bp, Unknown
  misc_feature (1)..( 8): Result.006 file - promoters50/4771911
aaaatatc

SEQ ID NO: 192036 - DNA, 8 bp, Unknown
  misc_feature (1)..( 8): Result.006 file - promoters50/4771911
gaaatatc

SEQ ID NO: 192037 - DNA, 8 bp, Unknown
  misc_feature (1)..( 8): Result.006 file - promoters50/4771911
aaaataaa

SEQ ID NO: 192038 - DNA, 8 bp, Unknown
  misc_feature (1)..( 8): Result.006 file - promoters50/4771911
aacaaaat

SEQ ID NO: 192039 - DNA, 8 bp, Unknown
  misc_feature (1)..( 8): Result.006 file - promoters50/4771911
aactaaac

SEQ ID NO: 192040 - DNA, 8 bp, Unknown
  misc_feature (1)..( 8): Result.006 file - promoters50/4771911
cacaaaat

SEQ ID NO: 192041 - DNA, 13 bp, Unknown
  misc_feature (1)..( 13): Result.006 file - promoters50/4771911
tttagaaaaataa

SEQ ID NO: 192042 - DNA, 13 bp, Unknown
  misc_feature (1)..( 13): Result.006 file - promoters50/4771911
tttggaaaagaaa

SEQ ID NO: 192043 - DNA, 13 bp, Unknown
  misc_feature (1)..( 13): Result.006 file - promoters50/4771911
aagggaaatgaaa

SEQ ID NO: 192044 - DNA, 8 bp, Unknown
  misc_feature (1)..( 8): Result.006 file - promoters50/4771911
aaatttat

SEQ ID NO: 192045 - DNA, 8 bp, Unknown
  misc_feature (1)..( 8): Result.006 file - promoters50/4771911
ttatttat

SEQ ID NO: 192046 - DNA, 8 bp, Unknown
  misc_feature (1)..( 8): Result.006 file - promoters50/4771911
ttatttag

SEQ ID NO: 192047 - DNA, 13 bp, Unknown
  misc_feature (1)..( 13): Result.006 file - promoters50/4771911
aaaaaaagaaaaa

SEQ ID NO: 192048 - DNA, 13 bp, Unknown
  misc_feature (1)..( 13): Result.006 file - promoters50/4771911
aaaaaaagaaaaa

SEQ ID NO: 192049 - DNA, 13 bp, Unknown
  misc_feature (1)..( 13): Result.006 file - promoters50/4771913
gccaaaagagtaa

SEQ ID NO: 192050 - DNA, 12 bp, Unknown
  misc_feature (1)..( 12): Result.006 file - promoters50/4771913
caaagatatatc

SEQ ID NO: 192051 - DNA, 12 bp, Unknown
  misc_feature (1)..( 12): Result.006 file - promoters50/4771913
taaaaatatatt

SEQ ID NO: 192052 - DNA, 12 bp, Unknown
  misc_feature (1)..( 12): Result.006 file - promoters50/4771913
caaagaaagaca

SEQ ID NO: 192053 - DNA, 12 bp, Unknown
  misc_feature (1)..( 12): Result.006 file - promoters50/4771913
caaagattacat

SEQ ID NO: 192054 - DNA, 12 bp, Unknown
  misc_feature (1)..( 12): Result.006 file - promoters50/4771913
gacaaatttatt

SEQ ID NO: 192055 - DNA, 12 bp, Unknown
  misc_feature (1)..( 12): Result.006 file - promoters50/4771913
aaaacattccaa

SEQ ID NO: 192056 - DNA, 10 bp, Unknown
  misc_feature (1)..( 10): Result.006 file - promoters50/4771913
cacaaaaaga

SEQ ID NO: 192057 - DNA, 10 bp, Unknown
  misc_feature (1)..( 10): Result.006 file - promoters50/4771913
tacaaaaaaa

SEQ ID NO: 192058 - DNA, 10 bp, Unknown
  misc_feature (1)..( 10): Result.006 file - promoters50/4771913
gacaaaaaaa

SEQ ID NO: 192059 - DNA, 10 bp, Unknown
  misc_feature (1)..( 10): Result.006 file - promoters50/4771913
cgcaaaaatt

SEQ ID NO: 192060 - DNA, 10 bp, Unknown
  misc_feature (1)..( 10): Result.006 file - promoters50/4771913
cacaaatatc

SEQ ID NO: 192061 - DNA, 10 bp, Unknown
  misc_feature (1)..( 10): Result.006 file - promoters50/4771913
gtaaaaaaga

SEQ ID NO: 192062 - DNA, 11 bp, Unknown
  misc_feature (1)..( 11): Result.006 file - promoters50/4771928
attaaataaat

SEQ ID NO: 192063 - DNA, 16 bp, Unknown
  misc_feature (1)..( 16): Result.006 file - promoters50/4771928
agaactactattcgtg

SEQ ID NO: 192064 - DNA, 16 bp, Unknown
  misc_feature (1)..( 16): Result.006 file - promoters50/4771928
agaaatacaattttgt

SEQ ID NO: 192065 - DNA, 16 bp, Unknown
  misc_feature (1)..( 16): Result.006 file - promoters50/4771928
aagtcagctatttgtg

SEQ ID NO: 192066 - DNA, 16 bp, Unknown
  misc_feature (1)..( 16): Result.006 file - promoters50/4771928
ggtcttacaatttttt

SEQ ID NO: 192067 - DNA, 16 bp, Unknown
  misc_feature (1)..( 16): Result.006 file - promoters50/4771928
tttgataaaaaatata

SEQ ID NO: 192068 - DNA, 8 bp, Unknown
  misc_feature (1)..( 8): Result.006 file - promoters50/4771928
gtttttgt

SEQ ID NO: 192069 - DNA, 8 bp, Unknown
  misc_feature (1)..( 8): Result.006 file - promoters50/4771928
atttttgg

SEQ ID NO: 192070 - DNA, 8 bp, Unknown
  misc_feature (1)..( 8): Result.006 file - promoters50/4771928
acttttgg

SEQ ID NO: 192071 - DNA, 8 bp, Unknown
  misc_feature (1)..( 8): Result.006 file - promoters50/4771928
attgttgt

SEQ ID NO: 192072 - DNA, 8 bp, Unknown
  misc_feature (1)..( 8): Result.006 file - promoters50/4771928
aataaatc

SEQ ID NO: 192073 - DNA, 8 bp, Unknown
  misc_feature (1)..( 8): Result.006 file - promoters50/4771928
tataaatt

SEQ ID NO: 192074 - DNA, 8 bp, Unknown
  misc_feature (1)..( 8): Result.006 file - promoters50/4771928
aatcaatc

SEQ ID NO: 192075 - DNA, 8 bp, Unknown
  misc_feature (1)..( 8): Result.006 file - promoters50/4771928
aatccatc

SEQ ID NO: 192076 - DNA, 10 bp, Unknown
  misc_feature (1)..( 10): Result.006 file - promoters50/4771928
ttgcaaaaaa

SEQ ID NO: 192077 - DNA, 10 bp, Unknown
  misc_feature (1)..( 10): Result.006 file - promoters50/4771928
tttcaaaaaa

SEQ ID NO: 192078 - DNA, 10 bp, Unknown
  misc_feature (1)..( 10): Result.006 file - promoters50/4771928
ttttaaaaga

SEQ ID NO: 192079 - DNA, 10 bp, Unknown
  misc_feature (1)..( 10): Result.006 file - promoters50/4771944
cttcacaaac

SEQ ID NO: 192080 - DNA, 13 bp, Unknown
  misc_feature (1)..( 13): Result.006 file - promoters50/4771944
ttaagtaaaaact

SEQ ID NO: 192081 - DNA, 13 bp, Unknown
  misc_feature (1)..( 13): Result.006 file - promoters50/4771944
ttaaataaaaaac

SEQ ID NO: 192082 - DNA, 13 bp, Unknown
  misc_feature (1)..( 13): Result.006 file - promoters50/4771944
gacaaaaaaaact

SEQ ID NO: 192083 - DNA, 16 bp, Unknown
  misc_feature (1)..( 16): Result.006 file - promoters50/4771944
tacttttttttttttg

SEQ ID NO: 192084 - DNA, 16 bp, Unknown
  misc_feature (1)..( 16): Result.006 file - promoters50/4771944
tactgtttttcattct

SEQ ID NO: 192085 - DNA, 16 bp, Unknown
  misc_feature (1)..( 16): Result.006 file - promoters50/4771952
taacgtttgtcaatct

SEQ ID NO: 192086 - DNA, 8 bp, Unknown
  misc_feature (1)..( 8): Result.006 file - promoters50/4771952
aacaaatt

SEQ ID NO: 192087 - DNA, 8 bp, Unknown
  misc_feature (1)..( 8): Result.006 file - promoters50/4771952
ctcaaatt

SEQ ID NO: 192088 - DNA, 8 bp, Unknown
  misc_feature (1)..( 8): Result.006 file - promoters50/4771956
ctcacatt

SEQ ID NO: 192089 - DNA, 12 bp, Unknown
  misc_feature (1)..( 12): Result.006 file - promoters50/4771956
aaattattttat

SEQ ID NO: 192090 - DNA, 12 bp, Unknown
  misc_feature (1)..( 12): Result.006 file - promoters50/4771956
tttttaatttaa

SEQ ID NO: 192091 - DNA, 12 bp, Unknown
  misc_feature (1)..( 12): Result.006 file - promoters50/4771956
gaaacgttttat

SEQ ID NO: 192092 - DNA, 12 bp, Unknown
  misc_feature (1)..( 12): Result.006 file - promoters50/4771956
aaactatttaaa

SEQ ID NO: 192093 - DNA, 12 bp, Unknown
  misc_feature (1)..( 12): Result.006 file - promoters50/4771956
caaccattcgca

SEQ ID NO: 192094 - DNA, 10 bp, Unknown
  misc_feature (1)..( 10): Result.006 file - promoters50/4771956
taaataagta

SEQ ID NO: 192095 - DNA, 10 bp, Unknown
  misc_feature (1)..( 10): Result.006 file - promoters50/4771956
tatataagtt

SEQ ID NO: 192096 - DNA, 10 bp, Unknown
  misc_feature (1)..( 10): Result.006 file - promoters50/4771956
taaataatat

SEQ ID NO: 192097 - DNA, 10 bp, Unknown
  misc_feature (1)..( 10): Result.006 file - promoters50/4771956
aaaaaaatta

SEQ ID NO: 192098 - DNA, 10 bp, Unknown
  misc_feature (1)..( 10): Result.006 file - promoters50/4771960
ataatcatat

SEQ ID NO: 192099 - DNA, 10 bp, Unknown
  misc_feature (1)..( 10): Result.006 file - promoters50/4771960
ttaatagttg

SEQ ID NO: 192100 - DNA, 10 bp, Unknown
  misc_feature (1)..( 10): Result.006 file - promoters50/4771960
taaatacttg

SEQ ID NO: 192101 - DNA, 10 bp, Unknown
  misc_feature (1)..( 10): Result.006 file - promoters50/4771960
caaatacatg

SEQ ID NO: 192102 - DNA, 10 bp, Unknown
  misc_feature (1)..( 10): Result.006 file - promoters50/4771960
acactacttg

SEQ ID NO: 192103 - DNA, 10 bp, Unknown
  misc_feature (1)..( 10): Result.006 file - promoters50/4771960
catataattg

SEQ ID NO: 192104 - DNA, 10 bp, Unknown
  misc_feature (1)..( 10): Result.006 file - promoters50/4771960
caaattcatg

SEQ ID NO: 192105 - DNA, 16 bp, Unknown
  misc_feature (1)..( 16): Result.006 file - promoters50/4771960
caaaaataaaagtgaa

SEQ ID NO: 192106 - DNA, 16 bp, Unknown
  misc_feature (1)..( 16): Result.006 file - promoters50/4771960
caaaaacaaaaaaaaa

SEQ ID NO: 192107 - DNA, 16 bp, Unknown
  misc_feature (1)..( 16): Result.006 file - promoters50/4771960
tcttaatagtatgttg

SEQ ID NO: 192108 - DNA, 16 bp, Unknown
  misc_feature (1)..( 16): Result.006 file - promoters50/4771960
aaaacttaaatgtgaa

SEQ ID NO: 192109 - DNA, 16 bp, Unknown
  misc_feature (1)..( 16): Result.006 file - promoters50/4771960
tttcaacaacttcttc

SEQ ID NO: 192110 - DNA, 16 bp, Unknown
  misc_feature (1)..( 16): Result.006 file - promoters50/4771960
aatttttaaatcagaa

SEQ ID NO: 192111 - DNA, 13 bp, Unknown
  misc_feature (1)..( 13): Result.006 file - promoters50/4771960
gtaatattacatc

SEQ ID NO: 192112 - DNA, 13 bp, Unknown
  misc_feature (1)..( 13): Result.006 file - promoters50/4771960
tatacattaaatc

SEQ ID NO: 192113 - DNA, 13 bp, Unknown
  misc_feature (1)..( 13): Result.006 file - promoters50/4771960
aaaacattgaatc

SEQ ID NO: 192114 - DNA, 13 bp, Unknown
  misc_feature (1)..( 13): Result.006 file - promoters50/4771960
atatcattaacat

SEQ ID NO: 192115 - DNA, 13 bp, Unknown
  misc_feature (1)..( 13): Result.006 file - promoters50/4771960
aaaatattatata

SEQ ID NO: 192116 - DNA, 13 bp, Unknown
  misc_feature (1)..( 13): Result.006 file - promoters50/4771968
atgaaattaactt

SEQ ID NO: 192117 - DNA, 10 bp, Unknown
  misc_feature (1)..( 10): Result.006 file - promoters50/4771968
catatcatac

SEQ ID NO: 192118 - DNA, 10 bp, Unknown
  misc_feature (1)..( 10): Result.006 file - promoters50/4771968
tttataatat

SEQ ID NO: 192119 - DNA, 10 bp, Unknown
  misc_feature (1)..( 10): Result.006 file - promoters50/4771968
catttcacta

SEQ ID NO: 192120 - DNA, 10 bp, Unknown
  misc_feature (1)..( 10): Result.006 file - promoters50/4771968
gctaagatat

SEQ ID NO: 192121 - DNA, 10 bp, Unknown
  misc_feature (1)..( 10): Result.006 file - promoters50/4771968
attaaaatat

SEQ ID NO: 192122 - DNA, 10 bp, Unknown
  misc_feature (1)..( 10): Result.006 file - promoters50/4771968
ttttttttaa

SEQ ID NO: 192123 - DNA, 12 bp, Unknown
  misc_feature (1)..( 12): Result.006 file - promoters50/4771968
ttcaaaaatcca

SEQ ID NO: 192124 - DNA, 12 bp, Unknown
  misc_feature (1)..( 12): Result.006 file - promoters50/4771968
atataaactccc

SEQ ID NO: 192125 - DNA, 13 bp, Unknown
  misc_feature (1)..( 13): Result.006 file - promoters50/4771968
ttataaagatcct

SEQ ID NO: 192126 - DNA, 13 bp, Unknown
  misc_feature (1)..( 13): Result.006 file - promoters50/4771968
tatatatactctc

SEQ ID NO: 192127 - DNA, 13 bp, Unknown
  misc_feature (1)..( 13): Result.006 file - promoters50/4771968
gaataataatgat

SEQ ID NO: 192128 - DNA, 13 bp, Unknown
  misc_feature (1)..( 13): Result.006 file - promoters50/4771972
tatatataaagac

SEQ ID NO: 192129 - DNA, 9 bp, Unknown
  misc_feature (1)..( 9): Result.006 file - promoters50/4771972
ctaactaaa

SEQ ID NO: 192130 - DNA, 9 bp, Unknown
  misc_feature (1)..( 9): Result.006 file - promoters50/4771972
gaaacaaaa

SEQ ID NO: 192131 - DNA, 9 bp, Unknown
  misc_feature (1)..( 9): Result.006 file - promoters50/4771972
gaaagaaag

SEQ ID NO: 192132 - DNA, 8 bp, Unknown
  misc_feature (1)..( 8): Result.006 file - promoters50/4771972
ttttgttt

SEQ ID NO: 192133 - DNA, 8 bp, Unknown
  misc_feature (1)..( 8): Result.006 file - promoters50/4771972
atttgtta

SEQ ID NO: 192134 - DNA, 8 bp, Unknown
  misc_feature (1)..( 8): Result.006 file - promoters50/4771972
ttttcttt

SEQ ID NO: 192135 - DNA, 7 bp, Unknown
  misc_feature (1)..( 7): Result.006 file - promoters50/4771972
taaaaat

SEQ ID NO: 192136 - DNA, 7 bp, Unknown
  misc_feature (1)..( 7): Result.006 file - promoters50/4771972
taataat

SEQ ID NO: 192137 - DNA, 7 bp, Unknown
  misc_feature (1)..( 7): Result.006 file - promoters50/4771972
taaaaag

SEQ ID NO: 192138 - DNA, 10 bp, Unknown
  misc_feature (1)..( 10): Result.006 file - promoters50/4771972
taaaataaca

SEQ ID NO: 192139 - DNA, 10 bp, Unknown
  misc_feature (1)..( 10): Result.006 file - promoters50/4771972
taaagtaaag

SEQ ID NO: 192140 - DNA, 10 bp, Unknown
  misc_feature (1)..( 10): Result.006 file - promoters50/4771975
aaaagaaaag

SEQ ID NO: 192141 - DNA, 10 bp, Unknown
  misc_feature (1)..( 10): Result.006 file - promoters50/4771975
tgttagtaat

SEQ ID NO: 192142 - DNA, 10 bp, Unknown
  misc_feature (1)..( 10): Result.006 file - promoters50/4771975
acttaataac

SEQ ID NO: 192143 - DNA, 11 bp, Unknown
  misc_feature (1)..( 11): Result.006 file - promoters50/4771990
atttaattaat

SEQ ID NO: 192144 - DNA, 8 bp, Unknown
  misc_feature (1)..( 8): Result.006 file - promoters50/4771990
aattaaat

SEQ ID NO: 192145 - DNA, 8 bp, Unknown
  misc_feature (1)..( 8): Result.006 file - promoters50/4771990
aatgaaat

SEQ ID NO: 192146 - DNA, 8 bp, Unknown
  misc_feature (1)..( 8): Result.006 file - promoters50/4772005
aataaaat

SEQ ID NO: 192147 - DNA, 14 bp, Unknown
  misc_feature (1)..( 14): Result.006 file - promoters50/4772005
gcttcttaaattga

SEQ ID NO: 192148 - DNA, 14 bp, Unknown
  misc_feature (1)..( 14): Result.006 file - promoters50/4772005
tgtatttaagttga

SEQ ID NO: 192149 - DNA, 14 bp, Unknown
  misc_feature (1)..( 14): Result.006 file - promoters50/4772005
tctttttaaaaaag

SEQ ID NO: 192150 - DNA, 14 bp, Unknown
  misc_feature (1)..( 14): Result.006 file - promoters50/4772005
tcttttcccaatta

SEQ ID NO: 192151 - DNA, 14 bp, Unknown
  misc_feature (1)..( 14): Result.006 file - promoters50/4772005
tcgttttaaaaatc

SEQ ID NO: 192152 - DNA, 11 bp, Unknown
  misc_feature (1)..( 11): Result.006 file - promoters50/4772005
ataacatattt

SEQ ID NO: 192153 - DNA, 11 bp, Unknown
  misc_feature (1)..( 11): Result.006 file - promoters50/4772005
gaaacaaattt

SEQ ID NO: 192154 - DNA, 11 bp, Unknown
  misc_feature (1)..( 11): Result.006 file - promoters50/4772005
ttaatatacgt

SEQ ID NO: 192155 - DNA, 11 bp, Unknown
  misc_feature (1)..( 11): Result.006 file - promoters50/4772005
aaaataaaaaa

SEQ ID NO: 192156 - DNA, 11 bp, Unknown
  misc_feature (1)..( 11): Result.006 file - promoters50/4772005
ttaatatccaa

SEQ ID NO: 192157 - DNA, 12 bp, Unknown
  misc_feature (1)..( 12): Result.006 file - promoters50/4772005
tttgaaatattt

SEQ ID NO: 192158 - DNA, 12 bp, Unknown
  misc_feature (1)..( 12): Result.006 file - promoters50/4772005
ctttcaatattg

SEQ ID NO: 192159 - DNA, 11 bp, Unknown
  misc_feature (1)..( 11): Result.006 file - promoters50/4772005
ttttaatatat

SEQ ID NO: 192160 - DNA, 12 bp, Unknown
  misc_feature (1)..( 12): Result.006 file - promoters50/4772005
ttttatatattt

SEQ ID NO: 192161 - DNA, 12 bp, Unknown
  misc_feature (1)..( 12): Result.006 file - promoters50/4772042
cttgcaatgtta

SEQ ID NO: 192162 - DNA, 8 bp, Unknown
  misc_feature (1)..( 8): Result.006 file - promoters50/4772042
taaaaaca

SEQ ID NO: 192163 - DNA, 8 bp, Unknown
  misc_feature (1)..( 8): Result.006 file - promoters50/4772042
gcaaaaca

SEQ ID NO: 192164 - DNA, 8 bp, Unknown
  misc_feature (1)..( 8): Result.006 file - promoters50/4772042
taaaaacc

SEQ ID NO: 192165 - DNA, 8 bp, Unknown
  misc_feature (1)..( 8): Result.006 file - promoters50/4772042
ttatcttt

SEQ ID NO: 192166 - DNA, 8 bp, Unknown
  misc_feature (1)..( 8): Result.006 file - promoters50/4772042
ttattttt

SEQ ID NO: 192167 - DNA, 8 bp, Unknown
  misc_feature (1)..( 8): Result.006 file - promoters50/4772050
gtatctta

SEQ ID NO: 192168 - DNA, 10 bp, Unknown
  misc_feature (1)..( 10): Result.006 file - promoters50/4772050
tccaacattc

SEQ ID NO: 192169 - DNA, 10 bp, Unknown
  misc_feature (1)..( 10): Result.006 file - promoters50/4772050
aacaacatgt

SEQ ID NO: 192170 - DNA, 10 bp, Unknown
  misc_feature (1)..( 10): Result.006 file - promoters50/4772062
aacaacttgt

SEQ ID NO: 192171 - DNA, 10 bp, Unknown
  misc_feature (1)..( 10): Result.006 file - promoters50/4772062
cacaactaat

SEQ ID NO: 192172 - DNA, 10 bp, Unknown
  misc_feature (1)..( 10): Result.006 file - promoters50/4772062
aacaattaaa

SEQ ID NO: 192173 - DNA, 10 bp, Unknown
  misc_feature (1)..( 10): Result.006 file - promoters50/4772062
atcaattaat

SEQ ID NO: 192174 - DNA, 10 bp, Unknown
  misc_feature (1)..( 10): Result.006 file - promoters50/4772062
atttactaat

SEQ ID NO: 192175 - DNA, 10 bp, Unknown
  misc_feature (1)..( 10): Result.006 file - promoters50/4772062
caatactaat

SEQ ID NO: 192176 - DNA, 10 bp, Unknown
  misc_feature (1)..( 10): Result.006 file - promoters50/4772062
tataattaat

SEQ ID NO: 192177 - DNA, 10 bp, Unknown
  misc_feature (1)..( 10): Result.006 file - promoters50/4772062
gattattaaa

SEQ ID NO: 192178 - DNA, 10 bp, Unknown
  misc_feature (1)..( 10): Result.006 file - promoters50/4772062
tatgattata

SEQ ID NO: 192179 - DNA, 9 bp, Unknown
  misc_feature (1)..( 9): Result.006 file - promoters50/4772062
tagttggta

SEQ ID NO: 192180 - DNA, 9 bp, Unknown
  misc_feature (1)..( 9): Result.006 file - promoters50/4772062
gatttggta

SEQ ID NO: 192181 - DNA, 9 bp, Unknown
  misc_feature (1)..( 9): Result.006 file - promoters50/4772062
tagtcggtc

SEQ ID NO: 192182 - DNA, 9 bp, Unknown
  misc_feature (1)..( 9): Result.006 file - promoters50/4772062
tttttggtc

SEQ ID NO: 192183 - DNA, 9 bp, Unknown
  misc_feature (1)..( 9): Result.006 file - promoters50/4772062
tctttggtt

SEQ ID NO: 192184 - DNA, 9 bp, Unknown
  misc_feature (1)..( 9): Result.006 file - promoters50/4772062
actttggat

SEQ ID NO: 192185 - DNA, 13 bp, Unknown
  misc_feature (1)..( 13): Result.006 file - promoters50/4772062
ataaccaaaatca

SEQ ID NO: 192186 - DNA, 13 bp, Unknown
  misc_feature (1)..( 13): Result.006 file - promoters50/4772062
tgaacaaaaacag

SEQ ID NO: 192187 - DNA, 13 bp, Unknown
  misc_feature (1)..( 13): Result.006 file - promoters50/4772062
cttaccaaatgat

SEQ ID NO: 192188 - DNA, 13 bp, Unknown
  misc_feature (1)..( 13): Result.006 file - promoters50/4772062
ggtacaaaaatta

SEQ ID NO: 192189 - DNA, 13 bp, Unknown
  misc_feature (1)..( 13): Result.006 file - promoters50/4772062
agaacaatagagg

SEQ ID NO: 192190 - DNA, 13 bp, Unknown
  misc_feature (1)..( 13): Result.006 file - promoters50/4772062
agaacatggctta

SEQ ID NO: 192191 - DNA, 13 bp, Unknown
  misc_feature (1)..( 13): Result.006 file - promoters50/4772062
tttaaaaaaatta

SEQ ID NO: 192192 - DNA, 9 bp, Unknown
  misc_feature (1)..( 9): Result.006 file - promoters50/4772062
agaaaaaga

SEQ ID NO: 192193 - DNA, 9 bp, Unknown
  misc_feature (1)..( 9): Result.006 file - promoters50/4772062
agaaaaaga

SEQ ID NO: 192194 - DNA, 9 bp, Unknown
  misc_feature (1)..( 9): Result.006 file - promoters50/4772062
gaaaaaaga

SEQ ID NO: 192195 - DNA, 9 bp, Unknown
  misc_feature (1)..( 9): Result.006 file - promoters50/4772062
aaacaaaga

SEQ ID NO: 192196 - DNA, 9 bp, Unknown
  misc_feature (1)..( 9): Result.006 file - promoters50/4772062
agaaaaaag

SEQ ID NO: 192197 - DNA, 9 bp, Unknown
  misc_feature (1)..( 9): Result.006 file - promoters50/4772062
taaaaaaaa

SEQ ID NO: 192198 - DNA, 9 bp, Unknown
  misc_feature (1)..( 9): Result.006 file - promoters50/4772062
caaaaaagt

SEQ ID NO: 192199 - DNA, 22 bp, Unknown
  misc_feature (1)..( 22): Result.006 file - promoters50/4772062
ttataaaaactaatgatgctaa

SEQ ID NO: 192200 - DNA, 22 bp, Unknown
  misc_feature (1)..( 22): Result.006 file - promoters50/4772062
acaagaaaactaggaaaaaaaa

SEQ ID NO: 192201 - DNA, 22 bp, Unknown
  misc_feature (1)..( 22): Result.006 file - promoters50/4772062
ttaaaaaaattaaggatggtaa

SEQ ID NO: 192202 - DNA, 22 bp, Unknown
  misc_feature (1)..( 22): Result.006 file - promoters50/4772062
gaagaaatattgataatatatg

SEQ ID NO: 192203 - DNA, 22 bp, Unknown
  misc_feature (1)..( 22): Result.006 file - promoters50/4772062
tttcaaatcattaacatggtac

SEQ ID NO: 192204 - DNA, 22 bp, Unknown
  misc_feature (1)..( 22): Result.006 file - promoters50/4772062
tcatgcatgctaatatttactg

SEQ ID NO: 192205 - DNA, 22 bp, Unknown
  misc_feature (1)..( 22): Result.006 file - promoters50/4772062
ttttgttaattataaaaactaa

SEQ ID NO: 192206 - DNA, 22 bp, Unknown
  misc_feature (1)..( 22): Result.006 file - promoters50/4772062
tctaacaaataatatgctcatg

SEQ ID NO: 192207 - DNA, 22 bp, Unknown
  misc_feature (1)..( 22): Result.006 file - promoters50/4772062
ttaaaaaaattaaggatggtaa

SEQ ID NO: 192208 - DNA, 22 bp, Unknown
  misc_feature (1)..( 22): Result.006 file - promoters50/4772062
aaagaagaaatattgataatat

SEQ ID NO: 192209 - DNA, 22 bp, Unknown
  misc_feature (1)..( 22): Result.006 file - promoters50/4772062
tggattgtttttcaaatcatta

SEQ ID NO: 192210 - DNA, 22 bp, Unknown
  misc_feature (1)..( 22): Result.006 file - promoters50/4772062
ttcaaaaaaaaatgtcaatttt

SEQ ID NO: 192211 - DNA, 11 bp, Unknown
  misc_feature (1)..( 11): Result.006 file - promoters50/4772062
tgaaaaagcaa

SEQ ID NO: 192212 - DNA, 11 bp, Unknown
  misc_feature (1)..( 11): Result.006 file - promoters50/4772062
tttaaaatcaa

SEQ ID NO: 192213 - DNA, 11 bp, Unknown
  misc_feature (1)..( 11): Result.006 file - promoters50/4772062
aagaaaaatta

SEQ ID NO: 192214 - DNA, 11 bp, Unknown
  misc_feature (1)..( 11): Result.006 file - promoters50/4772062
aagaaaaatta

SEQ ID NO: 192215 - DNA, 11 bp, Unknown
  misc_feature (1)..( 11): Result.006 file - promoters50/4772062
aagcaaaatta

SEQ ID NO: 192216 - DNA, 11 bp, Unknown
  misc_feature (1)..( 11): Result.006 file - promoters50/4772066
attataatttt

SEQ ID NO: 192217 - DNA, 7 bp, Unknown
  misc_feature (1)..( 7): Result.006 file - promoters50/4772066
agatcaa

SEQ ID NO: 192218 - DNA, 12 bp, Unknown
  misc_feature (1)..( 12): Result.006 file - promoters50/4772066
actatagatcaa

SEQ ID NO: 192219 - DNA, 12 bp, Unknown
  misc_feature (1)..( 12): Result.006 file - promoters50/4772066
actatagatctt

SEQ ID NO: 192220 - DNA, 9 bp, Unknown
  misc_feature (1)..( 9): Result.006 file - promoters50/4772066
ttggatgat

SEQ ID NO: 192221 - DNA, 9 bp, Unknown
  misc_feature (1)..( 9): Result.006 file - promoters50/4772066
ttgaatggt

SEQ ID NO: 192222 - DNA, 9 bp, Unknown
  misc_feature (1)..( 9): Result.006 file - promoters50/4772070
ctggaagat

SEQ ID NO: 192223 - DNA, 9 bp, Unknown
  misc_feature (1)..( 9): Result.006 file - promoters50/4772070
agatggtac

SEQ ID NO: 192224 - DNA, 9 bp, Unknown
  misc_feature (1)..( 9): Result.006 file - promoters50/4772070
ttatggtat

SEQ ID NO: 192225 - DNA, 9 bp, Unknown
  misc_feature (1)..( 9): Result.006 file - promoters50/4772070
tgatgatac

SEQ ID NO: 192226 - DNA, 9 bp, Unknown
  misc_feature (1)..( 9): Result.006 file - promoters50/4772070
taatggtaa

SEQ ID NO: 192227 - DNA, 9 bp, Unknown
  misc_feature (1)..( 9): Result.006 file - promoters50/4772070
tgatgaatc

SEQ ID NO: 192228 - DNA, 9 bp, Unknown
  misc_feature (1)..( 9): Result.006 file - promoters50/4772084
gcttggtaa

SEQ ID NO: 192229 - DNA, 11 bp, Unknown
  misc_feature (1)..( 11): Result.006 file - promoters50/4772084
tgaacttatga

SEQ ID NO: 192230 - DNA, 9 bp, Unknown
  misc_feature (1)..( 9): Result.006 file - promoters50/4772084
aacttagca

SEQ ID NO: 192231 - DNA, 11 bp, Unknown
  misc_feature (1)..( 11): Result.006 file - promoters50/4772084
tgaatttataa

SEQ ID NO: 192232 - DNA, 11 bp, Unknown
  misc_feature (1)..( 11): Result.006 file - promoters50/4772084
tacttttttaa

SEQ ID NO: 192233 - DNA, 8 bp, Unknown
  misc_feature (1)..( 8): Result.006 file - promoters50/4772084
tctttttt

SEQ ID NO: 192234 - DNA, 11 bp, Unknown
  misc_feature (1)..( 11): Result.006 file - promoters50/4772084
tttctgtttta

SEQ ID NO: 192235 - DNA, 10 bp, Unknown
  misc_feature (1)..( 10): Result.006 file - promoters50/4772084
ctaaatgata

SEQ ID NO: 192236 - DNA, 10 bp, Unknown
  misc_feature (1)..( 10): Result.006 file - promoters50/4772084
aaaaaagatt

SEQ ID NO: 192237 - DNA, 10 bp, Unknown
  misc_feature (1)..( 10): Result.006 file - promoters50/4772084
ataaatgggc

SEQ ID NO: 192238 - DNA, 10 bp, Unknown
  misc_feature (1)..( 10): Result.006 file - promoters50/4772084
aaaaataata

SEQ ID NO: 192239 - DNA, 10 bp, Unknown
  misc_feature (1)..( 10): Result.006 file - promoters50/4772084
cgaaatggac

SEQ ID NO: 192240 - DNA, 10 bp, Unknown
  misc_feature (1)..( 10): Result.006 file - promoters50/4772084
aaaaaaaatt

SEQ ID NO: 192241 - DNA, 17 bp, Unknown
  misc_feature (1)..( 17): Result.006 file - promoters50/4772084
aattcaacaatagaggt

SEQ ID NO: 192242 - DNA, 17 bp, Unknown
  misc_feature (1)..( 17): Result.006 file - promoters50/4772084
ttgaaaacaatttatat

SEQ ID NO: 192243 - DNA, 17 bp, Unknown
  misc_feature (1)..( 17): Result.006 file - promoters50/4772084
ttttaaaaaatgttatc

SEQ ID NO: 192244 - DNA, 17 bp, Unknown
  misc_feature (1)..( 17): Result.006 file - promoters50/4772084
atagaaagaataataat

SEQ ID NO: 192245 - DNA, 17 bp, Unknown
  misc_feature (1)..( 17): Result.006 file - promoters50/4772084
gtttcaacaacttatat

SEQ ID NO: 192246 - DNA, 17 bp, Unknown
  misc_feature (1)..( 17): Result.006 file - promoters50/4772084
ttataaacttttttttg

SEQ ID NO: 192247 - DNA, 12 bp, Unknown
  misc_feature (1)..( 12): Result.006 file - promoters50/4772084
tcaatttaattt

SEQ ID NO: 192248 - DNA, 12 bp, Unknown
  misc_feature (1)..( 12): Result.006 file - promoters50/4772084
tatttttagttt

SEQ ID NO: 192249 - DNA, 12 bp, Unknown
  misc_feature (1)..( 12): Result.006 file - promoters50/4772084
ataatttaactt

SEQ ID NO: 192250 - DNA, 12 bp, Unknown
  misc_feature (1)..( 12): Result.006 file - promoters50/4772084
gaaccttatttt

SEQ ID NO: 192251 - DNA, 12 bp, Unknown
  misc_feature (1)..( 12): Result.006 file - promoters50/4772084
acaatttatatt

SEQ ID NO: 192252 - DNA, 12 bp, Unknown
  misc_feature (1)..( 12): Result.006 file - promoters50/4772084
tatttttagtta

SEQ ID NO: 192253 - DNA, 9 bp, Unknown
  misc_feature (1)..( 9): Result.006 file - promoters50/4772084
ggtactttc

SEQ ID NO: 192254 - DNA, 9 bp, Unknown
  misc_feature (1)..( 9): Result.006 file - promoters50/4772084
ggtacttga

SEQ ID NO: 192255 - DNA, 9 bp, Unknown
  misc_feature (1)..( 9): Result.006 file - promoters50/4772084
gatactttt

SEQ ID NO: 192256 - DNA, 9 bp, Unknown
  misc_feature (1)..( 9): Result.006 file - promoters50/4772084
gatattttt

SEQ ID NO: 192257 - DNA, 9 bp, Unknown
  misc_feature (1)..( 9): Result.006 file - promoters50/4772084
gttattttt

SEQ ID NO: 192258 - DNA, 9 bp, Unknown
  misc_feature (1)..( 9): Result.006 file - promoters50/4772084
actattttt

SEQ ID NO: 192259 - DNA, 9 bp, Unknown
  misc_feature (1)..( 9): Result.006 file - promoters50/4772084
gaattcaaa

SEQ ID NO: 192260 - DNA, 9 bp, Unknown
  misc_feature (1)..( 9): Result.006 file - promoters50/4772084
aaatacaaa

SEQ ID NO: 192261 - DNA, 9 bp, Unknown
  misc_feature (1)..( 9): Result.006 file - promoters50/4772084
tcataaaaa

SEQ ID NO: 192262 - DNA, 9 bp, Unknown
  misc_feature (1)..( 9): Result.006 file - promoters50/4772084
tcataaatg

SEQ ID NO: 192263 - DNA, 9 bp, Unknown
  misc_feature (1)..( 9): Result.006 file - promoters50/4772084
ttataaaac

SEQ ID NO: 192264 - DNA, 9 bp, Unknown
  misc_feature (1)..( 9): Result.006 file - promoters50/4772095
ttagaaaaa

SEQ ID NO: 192265 - DNA, 14 bp, Unknown
  misc_feature (1)..( 14): Result.006 file - promoters50/4772095
aaaaaaacaattat

SEQ ID NO: 192266 - DNA, 14 bp, Unknown
  misc_feature (1)..( 14): Result.006 file - promoters50/4772095
tagtcttcaaatat

SEQ ID NO: 192267 - DNA, 14 bp, Unknown
  misc_feature (1)..( 14): Result.006 file - promoters50/4772095
tatggttcaaatct

SEQ ID NO: 192268 - DNA, 14 bp, Unknown
  misc_feature (1)..( 14): Result.006 file - promoters50/4772095
tatgtttccaatat

SEQ ID NO: 192269 - DNA, 14 bp, Unknown
  misc_feature (1)..( 14): Result.006 file - promoters50/4772103
gatttttcaatttt

SEQ ID NO: 192270 - DNA, 17 bp, Unknown
  misc_feature (1)..( 17): Result.006 file - promoters50/4772103
aaaaacaaaaaagttaa

SEQ ID NO: 192271 - DNA, 17 bp, Unknown
  misc_feature (1)..( 17): Result.006 file - promoters50/4772103
aaaaagaaaaaagttaa

SEQ ID NO: 192272 - DNA, 17 bp, Unknown
  misc_feature (1)..( 17): Result.006 file - promoters50/4772103
agaaccaaaagaatcta

SEQ ID NO: 192273 - DNA, 17 bp, Unknown
  misc_feature (1)..( 17): Result.006 file - promoters50/4772115
agcaacagatgatgact

SEQ ID NO: 192274 - DNA, 10 bp, Unknown
  misc_feature (1)..( 10): Result.006 file - promoters50/4772115
aaacccactc

SEQ ID NO: 192275 - DNA, 10 bp, Unknown
  misc_feature (1)..( 10): Result.006 file - promoters50/4772115
aaacctactc

SEQ ID NO: 192276 - DNA, 10 bp, Unknown
  misc_feature (1)..( 10): Result.006 file - promoters50/4772115
aaaccctact

SEQ ID NO: 192277 - DNA, 7 bp, Unknown
  misc_feature (1)..( 7): Result.006 file - promoters50/4772115
atagttt

SEQ ID NO: 192278 - DNA, 7 bp, Unknown
  misc_feature (1)..( 7): Result.006 file - promoters50/4772115
ataattt

SEQ ID NO: 192279 - DNA, 7 bp, Unknown
  misc_feature (1)..( 7): Result.006 file - promoters50/4772122
ttaattt

SEQ ID NO: 192280 - DNA, 9 bp, Unknown
  misc_feature (1)..( 9): Result.006 file - promoters50/4772122
aaataaaat

SEQ ID NO: 192281 - DNA, 9 bp, Unknown
  misc_feature (1)..( 9): Result.006 file - promoters50/4772122
ggataaaac

SEQ ID NO: 192282 - DNA, 9 bp, Unknown
  misc_feature (1)..( 9): Result.006 file - promoters50/4772122
ggacaaaat

SEQ ID NO: 192283 - DNA, 9 bp, Unknown
  misc_feature (1)..( 9): Result.006 file - promoters50/4772130
gcacataat

SEQ ID NO: 192284 - DNA, 10 bp, Unknown
  misc_feature (1)..( 10): Result.006 file - promoters50/4772130
gaataaattc

SEQ ID NO: 192285 - DNA, 10 bp, Unknown
  misc_feature (1)..( 10): Result.006 file - promoters50/4772130
ccttaacttc

SEQ ID NO: 192286 - DNA, 10 bp, Unknown
  misc_feature (1)..( 10): Result.006 file - promoters50/4772130
acataaataa

SEQ ID NO: 192287 - DNA, 10 bp, Unknown
  misc_feature (1)..( 10): Result.006 file - promoters50/4772130
gcataaattt

SEQ ID NO: 192288 - DNA, 10 bp, Unknown
  misc_feature (1)..( 10): Result.006 file - promoters50/4772130
attaaaattg

SEQ ID NO: 192289 - DNA, 10 bp, Unknown
  misc_feature (1)..( 10): Result.006 file - promoters50/4772130
gcatcaatcg

SEQ ID NO: 192290 - DNA, 10 bp, Unknown
  misc_feature (1)..( 10): Result.006 file - promoters50/4772130
gcatcaacaa

SEQ ID NO: 192291 - DNA, 14 bp, Unknown
  misc_feature (1)..( 14): Result.006 file - promoters50/4772130
atattaaaattgaa

SEQ ID NO: 192292 - DNA, 14 bp, Unknown
  misc_feature (1)..( 14): Result.006 file - promoters50/4772130
aaataaaaatttgt

SEQ ID NO: 192293 - DNA, 14 bp, Unknown
  misc_feature (1)..( 14): Result.006 file - promoters50/4772130
tagcataaatttga

SEQ ID NO: 192294 - DNA, 14 bp, Unknown
  misc_feature (1)..( 14): Result.006 file - promoters50/4772130
acattaaaattgtc

SEQ ID NO: 192295 - DNA, 14 bp, Unknown
  misc_feature (1)..( 14): Result.006 file - promoters50/4772130
gcatcaatcgtgaa

SEQ ID NO: 192296 - DNA, 14 bp, Unknown
  misc_feature (1)..( 14): Result.006 file - promoters50/4772133
gcatcaacaacgcc

SEQ ID NO: 192297 - DNA, 7 bp, Unknown
  misc_feature (1)..( 7): Result.006 file - promoters50/4772133
aagaatg

SEQ ID NO: 192298 - DNA, 7 bp, Unknown
  misc_feature (1)..( 7): Result.006 file - promoters50/4772133
gagaatg

SEQ ID NO: 192299 - DNA, 7 bp, Unknown
  misc_feature (1)..( 7): Result.006 file - promoters50/4772137
aagaatt

SEQ ID NO: 192300 - DNA, 17 bp, Unknown
  misc_feature (1)..( 17): Result.006 file - promoters50/4772137
tatgatctgattttaag

SEQ ID NO: 192301 - DNA, 17 bp, Unknown
  misc_feature (1)..( 17): Result.006 file - promoters50/4772137
ccatgtgagatcttagt

SEQ ID NO: 192302 - DNA, 17 bp, Unknown
  misc_feature (1)..( 17): Result.006 file - promoters50/4772137
gttctttctattgtaag

SEQ ID NO: 192303 - DNA, 17 bp, Unknown
  misc_feature (1)..( 17): Result.006 file - promoters50/4772137
tctggagagattttgat

SEQ ID NO: 192304 - DNA, 17 bp, Unknown
  misc_feature (1)..( 17): Result.006 file - promoters50/4772137
tctggagagattttgat

SEQ ID NO: 192305 - DNA, 17 bp, Unknown
  misc_feature (1)..( 17): Result.006 file - promoters50/4772137
ttggcaaaaattgtgat

SEQ ID NO: 192306 - DNA, 10 bp, Unknown
  misc_feature (1)..( 10): Result.006 file - promoters50/4772137
gaagtttagt

SEQ ID NO: 192307 - DNA, 10 bp, Unknown
  misc_feature (1)..( 10): Result.006 file - promoters50/4772137
gaaatttata

SEQ ID NO: 192308 - DNA, 10 bp, Unknown
  misc_feature (1)..( 10): Result.006 file - promoters50/4772137
aatatttata

SEQ ID NO: 192309 - DNA, 10 bp, Unknown
  misc_feature (1)..( 10): Result.006 file - promoters50/4772137
gaaattgtcg

SEQ ID NO: 192310 - DNA, 10 bp, Unknown
  misc_feature (1)..( 10): Result.006 file - promoters50/4772137
gaacttggca

SEQ ID NO: 192311 - DNA, 10 bp, Unknown
  misc_feature (1)..( 10): Result.006 file - promoters50/4772137
atgatttatt

SEQ ID NO: 192312 - DNA, 15 bp, Unknown
  misc_feature (1)..( 15): Result.006 file - promoters50/4772137
ctttttttttttggt

SEQ ID NO: 192313 - DNA, 15 bp, Unknown
  misc_feature (1)..( 15): Result.006 file - promoters50/4772137
ctttctttttttggt

SEQ ID NO: 192314 - DNA, 15 bp, Unknown
  misc_feature (1)..( 15): Result.006 file - promoters50/4772137
atttatttgttaaac

SEQ ID NO: 192315 - DNA, 15 bp, Unknown
  misc_feature (1)..( 15): Result.006 file - promoters50/4772137
gtttttttaatacga

SEQ ID NO: 192316 - DNA, 15 bp, Unknown
  misc_feature (1)..( 15): Result.006 file - promoters50/4772137
tggtcttttgcaatt

SEQ ID NO: 192317 - DNA, 15 bp, Unknown
  misc_feature (1)..( 15): Result.006 file - promoters50/4772137
gcttctttttggtta

SEQ ID NO: 192318 - DNA, 15 bp, Unknown
  misc_feature (1)..( 15): Result.006 file - promoters50/4772155
ctttctttttttggt

SEQ ID NO: 192319 - DNA, 11 bp, Unknown
  misc_feature (1)..( 11): Result.006 file - promoters50/4772155
caataaaatcc

SEQ ID NO: 192320 - DNA, 11 bp, Unknown
  misc_feature (1)..( 11): Result.006 file - promoters50/4772155
caaaaaaaaaa

SEQ ID NO: 192321 - DNA, 11 bp, Unknown
  misc_feature (1)..( 11): Result.006 file - promoters50/4772155
ttctaaaatct

SEQ ID NO: 192322 - DNA, 11 bp, Unknown
  misc_feature (1)..( 11): Result.006 file - promoters50/4772155
caagaaagaaa

SEQ ID NO: 192323 - DNA, 8 bp, Unknown
  misc_feature (1)..( 8): Result.006 file - promoters50/4772155
attttttt

SEQ ID NO: 192324 - DNA, 8 bp, Unknown
  misc_feature (1)..( 8): Result.006 file - promoters50/4772155
attttttc

SEQ ID NO: 192325 - DNA, 8 bp, Unknown
  misc_feature (1)..( 8): Result.006 file - promoters50/4772155
atttgtta

SEQ ID NO: 192326 - DNA, 10 bp, Unknown
  misc_feature (1)..( 10): Result.006 file - promoters50/4772155
tatcttaacc

SEQ ID NO: 192327 - DNA, 10 bp, Unknown
  misc_feature (1)..( 10): Result.006 file - promoters50/4772155
gatcataaca

SEQ ID NO: 192328 - DNA, 10 bp, Unknown
  misc_feature (1)..( 10): Result.006 file - promoters50/4772155
gatcacaaca

SEQ ID NO: 192329 - DNA, 8 bp, Unknown
  misc_feature (1)..( 8): Result.006 file - promoters50/4772155
tctttaga

SEQ ID NO: 192330 - DNA, 8 bp, Unknown
  misc_feature (1)..( 8): Result.006 file - promoters50/4772155
tctataga

SEQ ID NO: 192331 - DNA, 8 bp, Unknown
  misc_feature (1)..( 8): Result.006 file - promoters50/4772155
acttaaga

SEQ ID NO: 192332 - DNA, 8 bp, Unknown
  misc_feature (1)..( 8): Result.006 file - promoters50/4772155
tttgttta

SEQ ID NO: 192333 - DNA, 8 bp, Unknown
  misc_feature (1)..( 8): Result.006 file - promoters50/4772155
ttttttta

SEQ ID NO: 192334 - DNA, 8 bp, Unknown
  misc_feature (1)..( 8): Result.006 file - promoters50/4772167
attgatta

SEQ ID NO: 192335 - DNA, 7 bp, Unknown
  misc_feature (1)..( 7): Result.006 file - promoters50/4772167
gaagaaa

SEQ ID NO: 192336 - DNA, 7 bp, Unknown
  misc_feature (1)..( 7): Result.006 file - promoters50/4772167
aaagaaa

SEQ ID NO: 192337 - DNA, 7 bp, Unknown
  misc_feature (1)..( 7): Result.006 file - promoters50/4772167
gaagaat

SEQ ID NO: 192338 - DNA, 8 bp, Unknown
  misc_feature (1)..( 8): Result.006 file - promoters50/4772167
aaacgaac

SEQ ID NO: 192339 - DNA, 8 bp, Unknown
  misc_feature (1)..( 8): Result.006 file - promoters50/4772167
aaacaaac

SEQ ID NO: 192340 - DNA, 8 bp, Unknown
  misc_feature (1)..( 8): Result.006 file - promoters50/4772167
taaccaac

SEQ ID NO: 192341 - DNA, 6 bp, Unknown
  misc_feature (1)..( 6): Result.006 file - promoters50/4772167
aaaccc

SEQ ID NO: 192342 - DNA, 6 bp, Unknown
  misc_feature (1)..( 6): Result.006 file - promoters50/4772167
aaaccc

SEQ ID NO: 192343 - DNA, 7 bp, Unknown
  misc_feature (1)..( 7): Result.006 file - promoters50/4772167
aaagccc

SEQ ID NO: 192344 - DNA, 9 bp, Unknown
  misc_feature (1)..( 9): Result.006 file - promoters50/4772167
gagaatata

SEQ ID NO: 192345 - DNA, 9 bp, Unknown
  misc_feature (1)..( 9): Result.006 file - promoters50/4772167
gagaatctt

SEQ ID NO: 192346 - DNA, 9 bp, Unknown
  misc_feature (1)..( 9): Result.006 file - promoters50/4772167
cagattctt

SEQ ID NO: 192347 - DNA, 8 bp, Unknown
  misc_feature (1)..( 8): Result.006 file - promoters50/4772167
tgaatcag

SEQ ID NO: 192348 - DNA, 8 bp, Unknown
  misc_feature (1)..( 8): Result.006 file - promoters50/4772167
tgaatcaa

SEQ ID NO: 192349 - DNA, 8 bp, Unknown
  misc_feature (1)..( 8): Result.006 file - promoters50/4772167
ttaatcaa

SEQ ID NO: 192350 - DNA, 9 bp, Unknown
  misc_feature (1)..( 9): Result.006 file - promoters50/4772167
tttgaattt

SEQ ID NO: 192351 - DNA, 9 bp, Unknown
  misc_feature (1)..( 9): Result.006 file - promoters50/4772167
tttgaagaa

SEQ ID NO: 192352 - DNA, 9 bp, Unknown
  misc_feature (1)..( 9): Result.006 file - promoters50/4772167
tttaaattt

SEQ ID NO: 192353 - DNA, 10 bp, Unknown
  misc_feature (1)..( 10): Result.006 file - promoters50/4772167
atgattctac

SEQ ID NO: 192354 - DNA, 10 bp, Unknown
  misc_feature (1)..( 10): Result.006 file - promoters50/4772167
atgattttaa

SEQ ID NO: 192355 - DNA, 10 bp, Unknown
  misc_feature (1)..( 10): Result.006 file - promoters50/4772167
atgattttac

SEQ ID NO: 192356 - DNA, 8 bp, Unknown
  misc_feature (1)..( 8): Result.006 file - promoters50/4772167
taatgttt

SEQ ID NO: 192357 - DNA, 8 bp, Unknown
  misc_feature (1)..( 8): Result.006 file - promoters50/4772167
aaattttt

SEQ ID NO: 192358 - DNA, 8 bp, Unknown
  misc_feature (1)..( 8): Result.006 file - promoters50/4772171
aaatttga

SEQ ID NO: 192359 - DNA, 7 bp, Unknown
  misc_feature (1)..( 7): Result.006 file - promoters50/4772171
aaattta

SEQ ID NO: 192360 - DNA, 7 bp, Unknown
  misc_feature (1)..( 7): Result.006 file - promoters50/4772171
taattta

SEQ ID NO: 192361 - DNA, 7 bp, Unknown
  misc_feature (1)..( 7): Result.006 file - promoters50/4772171
taatttg

SEQ ID NO: 192362 - DNA, 9 bp, Unknown
  misc_feature (1)..( 9): Result.006 file - promoters50/4772171
ctatataaa

SEQ ID NO: 192363 - DNA, 9 bp, Unknown
  misc_feature (1)..( 9): Result.006 file - promoters50/4772171
atatatata

SEQ ID NO: 192364 - DNA, 9 bp, Unknown
  misc_feature (1)..( 9): Result.006 file - promoters50/4772171
ctatatata

SEQ ID NO: 192365 - DNA, 9 bp, Unknown
  misc_feature (1)..( 9): Result.006 file - promoters50/4772171
ttatttata

SEQ ID NO: 192366 - DNA, 7 bp, Unknown
  misc_feature (1)..( 7): Result.006 file - promoters50/4772171
attcaat

SEQ ID NO: 192367 - DNA, 7 bp, Unknown
  misc_feature (1)..( 7): Result.006 file - promoters50/4772171
attcaat

SEQ ID NO: 192368 - DNA, 7 bp, Unknown
  misc_feature (1)..( 7): Result.006 file - promoters50/4772171
attcaac

SEQ ID NO: 192369 - DNA, 11 bp, Unknown
  misc_feature (1)..( 11): Result.006 file - promoters50/4772171
tatagcaaata

SEQ ID NO: 192370 - DNA, 11 bp, Unknown
  misc_feature (1)..( 11): Result.006 file - promoters50/4772171
tatagcaaaac

SEQ ID NO: 192371 - DNA, 11 bp, Unknown
  misc_feature (1)..( 11): Result.006 file - promoters50/4772171
tgtagatgtag

SEQ ID NO: 192372 - DNA, 11 bp, Unknown
  misc_feature (1)..( 11): Result.006 file - promoters50/4772171
gctggcaaaaa

SEQ ID NO: 192373 - DNA, 7 bp, Unknown
  misc_feature (1)..( 7): Result.006 file - promoters50/4772171
gttttct

SEQ ID NO: 192374 - DNA, 7 bp, Unknown
  misc_feature (1)..( 7): Result.006 file - promoters50/4772171
cttttct

SEQ ID NO: 192375 - DNA, 7 bp, Unknown
  misc_feature (1)..( 7): Result.006 file - promoters50/4772195
cttatct

SEQ ID NO: 192376 - DNA, 13 bp, Unknown
  misc_feature (1)..( 13): Result.006 file - promoters50/4772195
ttcattttatttt

SEQ ID NO: 192377 - DNA, 13 bp, Unknown
  misc_feature (1)..( 13): Result.006 file - promoters50/4772195
ttctttttctttt

SEQ ID NO: 192378 - DNA, 13 bp, Unknown
  misc_feature (1)..( 13): Result.006 file - promoters50/4772195
attctttaattac

SEQ ID NO: 192379 - DNA, 13 bp, Unknown
  misc_feature (1)..( 13): Result.006 file - promoters50/4772195
aagattttcaatg

SEQ ID NO: 192380 - DNA, 13 bp, Unknown
  misc_feature (1)..( 13): Result.006 file - promoters50/4772195
ggaagttaatttc

SEQ ID NO: 192381 - DNA, 13 bp, Unknown
  misc_feature (1)..( 13): Result.006 file - promoters50/4772198
ttggtttaatcat

SEQ ID NO: 192382 - DNA, 9 bp, Unknown
  misc_feature (1)..( 9): Result.006 file - promoters50/4772198
aatttgttt

SEQ ID NO: 192383 - DNA, 9 bp, Unknown
  misc_feature (1)..( 9): Result.006 file - promoters50/4772198
catttgtat

SEQ ID NO: 192384 - DNA, 9 bp, Unknown
  misc_feature (1)..( 9): Result.006 file - promoters50/4772198
aatttgttt

SEQ ID NO: 192385 - DNA, 9 bp, Unknown
  misc_feature (1)..( 9): Result.006 file - promoters50/4772198
tatttttat

SEQ ID NO: 192386 - DNA, 7 bp, Unknown
  misc_feature (1)..( 7): Result.006 file - promoters50/4772198
caaaaag

SEQ ID NO: 192387 - DNA, 7 bp, Unknown
  misc_feature (1)..( 7): Result.006 file - promoters50/4772198
gaaaaag

SEQ ID NO: 192388 - DNA, 7 bp, Unknown
  misc_feature (1)..( 7): Result.006 file - promoters50/4772198
gaaaaat

SEQ ID NO: 192389 - DNA, 7 bp, Unknown
  misc_feature (1)..( 7): Result.006 file - promoters50/4772198
aaaaaat

SEQ ID NO: 192390 - DNA, 8 bp, Unknown
  misc_feature (1)..( 8): Result.006 file - promoters50/4772198
aaaaaaat

SEQ ID NO: 192391 - DNA, 8 bp, Unknown
  misc_feature (1)..( 8): Result.006 file - promoters50/4772198
aaaaaaaa

SEQ ID NO: 192392 - DNA, 9 bp, Unknown
  misc_feature (1)..( 9): Result.006 file - promoters50/4772198
aaacaaaaa

SEQ ID NO: 192393 - DNA, 9 bp, Unknown
  misc_feature (1)..( 9): Result.006 file - promoters50/4772208
taaaaaaat

SEQ ID NO: 192394 - DNA, 14 bp, Unknown
  misc_feature (1)..( 14): Result.006 file - promoters50/4772208
atattttgatttag

SEQ ID NO: 192395 - DNA, 14 bp, Unknown
  misc_feature (1)..( 14): Result.006 file - promoters50/4772208
ttatttggattttt

SEQ ID NO: 192396 - DNA, 14 bp, Unknown
  misc_feature (1)..( 14): Result.006 file - promoters50/4772208
ataatttaaaactg

SEQ ID NO: 192397 - DNA, 14 bp, Unknown
  misc_feature (1)..( 14): Result.006 file - promoters50/4772208
ttatgtggaaaatt

SEQ ID NO: 192398 - DNA, 14 bp, Unknown
  misc_feature (1)..( 14): Result.006 file - promoters50/4772208
gtattcggattttt

SEQ ID NO: 192399 - DNA, 14 bp, Unknown
  misc_feature (1)..( 14): Result.006 file - promoters50/4772208
ataatttcaaataa

SEQ ID NO: 192400 - DNA, 14 bp, Unknown
  misc_feature (1)..( 14): Result.006 file - promoters50/4772208
acaatttcatttat

SEQ ID NO: 192401 - DNA, 10 bp, Unknown
  misc_feature (1)..( 10): Result.006 file - promoters50/4772208
tataaatgtt

SEQ ID NO: 192402 - DNA, 10 bp, Unknown
  misc_feature (1)..( 10): Result.006 file - promoters50/4772208
agtaactgtc

SEQ ID NO: 192403 - DNA, 10 bp, Unknown
  misc_feature (1)..( 10): Result.006 file - promoters50/4772208
atcaaatgta

SEQ ID NO: 192404 - DNA, 10 bp, Unknown
  misc_feature (1)..( 10): Result.006 file - promoters50/4772208
attaattgtt

SEQ ID NO: 192405 - DNA, 10 bp, Unknown
  misc_feature (1)..( 10): Result.006 file - promoters50/4772208
aaagaatgtt

SEQ ID NO: 192406 - DNA, 10 bp, Unknown
  misc_feature (1)..( 10): Result.006 file - promoters50/4772208
attatttgga

SEQ ID NO: 192407 - DNA, 13 bp, Unknown
  misc_feature (1)..( 13): Result.006 file - promoters50/4772208
ttctttcaaaatg

SEQ ID NO: 192408 - DNA, 13 bp, Unknown
  misc_feature (1)..( 13): Result.006 file - promoters50/4772208
atctttcagactt

SEQ ID NO: 192409 - DNA, 13 bp, Unknown
  misc_feature (1)..( 13): Result.006 file - promoters50/4772208
ttctttacggtat

SEQ ID NO: 192410 - DNA, 13 bp, Unknown
  misc_feature (1)..( 13): Result.006 file - promoters50/4772208
taatttcaaataa

SEQ ID NO: 192411 - DNA, 13 bp, Unknown
  misc_feature (1)..( 13): Result.006 file - promoters50/4772208
tgtcatcaaatgt

SEQ ID NO: 192412 - DNA, 13 bp, Unknown
  misc_feature (1)..( 13): Result.006 file - promoters50/4772208
aatgttcaaaact

SEQ ID NO: 192413 - DNA, 13 bp, Unknown
  misc_feature (1)..( 13): Result.006 file - promoters50/4772208
attgttcacataa

SEQ ID NO: 192414 - DNA, 13 bp, Unknown
  misc_feature (1)..( 13): Result.006 file - promoters50/4772208
caatttcatttat

SEQ ID NO: 192415 - DNA, 11 bp, Unknown
  misc_feature (1)..( 11): Result.006 file - promoters50/4772208
ttcacattata

SEQ ID NO: 192416 - DNA, 11 bp, Unknown
  misc_feature (1)..( 11): Result.006 file - promoters50/4772208
gtcaaattaat

SEQ ID NO: 192417 - DNA, 11 bp, Unknown
  misc_feature (1)..( 11): Result.006 file - promoters50/4772208
ttcccatcatc

SEQ ID NO: 192418 - DNA, 11 bp, Unknown
  misc_feature (1)..( 11): Result.006 file - promoters50/4772208
aaataattaat

SEQ ID NO: 192419 - DNA, 11 bp, Unknown
  misc_feature (1)..( 11): Result.006 file - promoters50/4772208
cattaatcaat

SEQ ID NO: 192420 - DNA, 11 bp, Unknown
  misc_feature (1)..( 11): Result.006 file - promoters50/4772212
atcaaatgtag

SEQ ID NO: 192421 - DNA, 8 bp, Unknown
  misc_feature (1)..( 8): Result.006 file - promoters50/4772212
tttgttta

SEQ ID NO: 192422 - DNA, 8 bp, Unknown
  misc_feature (1)..( 8): Result.006 file - promoters50/4772212
agtgttta

SEQ ID NO: 192423 - DNA, 8 bp, Unknown
  misc_feature (1)..( 8): Result.006 file - promoters50/4772212
tttattta

SEQ ID NO: 192424 - DNA, 10 bp, Unknown
  misc_feature (1)..( 10): Result.006 file - promoters50/4772212
tataatattt

SEQ ID NO: 192425 - DNA, 10 bp, Unknown
  misc_feature (1)..( 10): Result.006 file - promoters50/4772212
tatattatat

SEQ ID NO: 192426 - DNA, 10 bp, Unknown
  misc_feature (1)..( 10): Result.006 file - promoters50/4772212
actaatattt

SEQ ID NO: 192427 - DNA, 7 bp, Unknown
  misc_feature (1)..( 7): Result.006 file - promoters50/4772212
cttgtaa

SEQ ID NO: 192428 - DNA, 7 bp, Unknown
  misc_feature (1)..( 7): Result.006 file - promoters50/4772212
cttgtat

SEQ ID NO: 192429 - DNA, 7 bp, Unknown
  misc_feature (1)..( 7): Result.006 file - promoters50/4772212
cttttaa

SEQ ID NO: 192430 - DNA, 9 bp, Unknown
  misc_feature (1)..( 9): Result.006 file - promoters50/4772212
tccaatctt

SEQ ID NO: 192431 - DNA, 9 bp, Unknown
  misc_feature (1)..( 9): Result.006 file - promoters50/4772212
tccaataat

SEQ ID NO: 192432 - DNA, 9 bp, Unknown
  misc_feature (1)..( 9): Result.006 file - promoters50/4772212
cccaaaaat

SEQ ID NO: 192433 - DNA, 9 bp, Unknown
  misc_feature (1)..( 9): Result.006 file - promoters50/4772212
ttttcatat

SEQ ID NO: 192434 - DNA, 9 bp, Unknown
  misc_feature (1)..( 9): Result.006 file - promoters50/4772212
atttcatct

SEQ ID NO: 192435 - DNA, 9 bp, Unknown
  misc_feature (1)..( 9): Result.006 file - promoters50/4772212
ttttcatat

SEQ ID NO: 192436 - DNA, 8 bp, Unknown
  misc_feature (1)..( 8): Result.006 file - promoters50/4772212
ttttgttt

SEQ ID NO: 192437 - DNA, 8 bp, Unknown
  misc_feature (1)..( 8): Result.006 file - promoters50/4772212
ttttattt

SEQ ID NO: 192438 - DNA, 8 bp, Unknown
  misc_feature (1)..( 8): Result.006 file - promoters50/4772212
gtttatta

SEQ ID NO: 192439 - DNA, 8 bp, Unknown
  misc_feature (1)..( 8): Result.006 file - promoters50/4772212
atattttt

SEQ ID NO: 192440 - DNA, 8 bp, Unknown
  misc_feature (1)..( 8): Result.006 file - promoters50/4772212
atactttg

SEQ ID NO: 192441 - DNA, 8 bp, Unknown
  misc_feature (1)..( 8): Result.006 file - promoters50/4772212
aaactttg

SEQ ID NO: 192442 - DNA, 7 bp, Unknown
  misc_feature (1)..( 7): Result.006 file - promoters50/4772212
ctataat

SEQ ID NO: 192443 - DNA, 7 bp, Unknown
  misc_feature (1)..( 7): Result.006 file - promoters50/4772212
ttataat

SEQ ID NO: 192444 - DNA, 7 bp, Unknown
  misc_feature (1)..( 7): Result.006 file - promoters50/4772219
ctataat

SEQ ID NO: 192445 - DNA, 12 bp, Unknown
  misc_feature (1)..( 12): Result.006 file - promoters50/4772219
tataaaaacata

SEQ ID NO: 192446 - DNA, 12 bp, Unknown
  misc_feature (1)..( 12): Result.006 file - promoters50/4772219
tatagaaatgga

SEQ ID NO: 192447 - DNA, 12 bp, Unknown
  misc_feature (1)..( 12): Result.006 file - promoters50/4772219
gttaaaaatcct

SEQ ID NO: 192448 - DNA, 12 bp, Unknown
  misc_feature (1)..( 12): Result.006 file - promoters50/4772223
aatagaaaaata

SEQ ID NO: 192449 - DNA, 9 bp, Unknown
  misc_feature (1)..( 9): Result.006 file - promoters50/4772223
tcttaaata

SEQ ID NO: 192450 - DNA, 9 bp, Unknown
  misc_feature (1)..( 9): Result.006 file - promoters50/4772223
acttatata

SEQ ID NO: 192451 - DNA, 9 bp, Unknown
  misc_feature (1)..( 9): Result.006 file - promoters50/4772223
actaataaa

SEQ ID NO: 192452 - DNA, 9 bp, Unknown
  misc_feature (1)..( 9): Result.006 file - promoters50/4772223
caaacacta

SEQ ID NO: 192453 - DNA, 9 bp, Unknown
  misc_feature (1)..( 9): Result.006 file - promoters50/4772223
aaaacacac

SEQ ID NO: 192454 - DNA, 9 bp, Unknown
  misc_feature (1)..( 9): Result.006 file - promoters50/4772223
caatcactt

SEQ ID NO: 192455 - DNA, 9 bp, Unknown
  misc_feature (1)..( 9): Result.006 file - promoters50/4772223
gaaatacta

SEQ ID NO: 192456 - DNA, 8 bp, Unknown
  misc_feature (1)..( 8): Result.006 file - promoters50/4772223
ataatttt

SEQ ID NO: 192457 - DNA, 8 bp, Unknown
  misc_feature (1)..( 8): Result.006 file - promoters50/4772223
ataattgt

SEQ ID NO: 192458 - DNA, 8 bp, Unknown
  misc_feature (1)..( 8): Result.006 file - promoters50/4772223
ctaatttt

SEQ ID NO: 192459 - DNA, 8 bp, Unknown
  misc_feature (1)..( 8): Result.006 file - promoters50/4772223
acaagaaa

SEQ ID NO: 192460 - DNA, 8 bp, Unknown
  misc_feature (1)..( 8): Result.006 file - promoters50/4772223
acatgaaa

SEQ ID NO: 192461 - DNA, 9 bp, Unknown
  misc_feature (1)..( 9): Result.006 file - promoters50/4772223
caaagtaaa

SEQ ID NO: 192462 - DNA, 9 bp, Unknown
  misc_feature (1)..( 9): Result.006 file - promoters50/4772223
tcaaatcaa

SEQ ID NO: 192463 - DNA, 9 bp, Unknown
  misc_feature (1)..( 9): Result.006 file - promoters50/4772223
tcaaaacaa

SEQ ID NO: 192464 - DNA, 9 bp, Unknown
  misc_feature (1)..( 9): Result.006 file - promoters50/4772223
tgaaaaaaa

SEQ ID NO: 192465 - DNA, 8 bp, Unknown
  misc_feature (1)..( 8): Result.006 file - promoters50/4772223
tttagaca

SEQ ID NO: 192466 - DNA, 8 bp, Unknown
  misc_feature (1)..( 8): Result.006 file - promoters50/4772223
ttttgaca

SEQ ID NO: 192467 - DNA, 8 bp, Unknown
  misc_feature (1)..( 8): Result.006 file - promoters50/4772223
atgagaat

SEQ ID NO: 192468 - DNA, 12 bp, Unknown
  misc_feature (1)..( 12): Result.006 file - promoters50/4772223
atattaaatttt

SEQ ID NO: 192469 - DNA, 12 bp, Unknown
  misc_feature (1)..( 12): Result.006 file - promoters50/4772223
ttatcaaattga

SEQ ID NO: 192470 - DNA, 12 bp, Unknown
  misc_feature (1)..( 12): Result.006 file - promoters50/4772223
ttaccaaaatga

SEQ ID NO: 192471 - DNA, 8 bp, Unknown
  misc_feature (1)..( 8): Result.006 file - promoters50/4772223
gtttaaaa

SEQ ID NO: 192472 - DNA, 8 bp, Unknown
  misc_feature (1)..( 8): Result.006 file - promoters50/4772223
atttcaaa

SEQ ID NO: 192473 - DNA, 8 bp, Unknown
  misc_feature (1)..( 8): Result.006 file - promoters50/4772230
atttcaat

SEQ ID NO: 192474 - DNA, 9 bp, Unknown
  misc_feature (1)..( 9): Result.006 file - promoters50/4772230
aatagtttt

SEQ ID NO: 192475 - DNA, 9 bp, Unknown
  misc_feature (1)..( 9): Result.006 file - promoters50/4772230
aatagattt

SEQ ID NO: 192476 - DNA, 9 bp, Unknown
  misc_feature (1)..( 9): Result.006 file - promoters50/4772230
tgtagattc

SEQ ID NO: 192477 - DNA, 9 bp, Unknown
  misc_feature (1)..( 9): Result.006 file - promoters50/4772230
tgttgatta

SEQ ID NO: 192478 - DNA, 10 bp, Unknown
  misc_feature (1)..( 10): Result.006 file - promoters50/4772230
aaatattaat

SEQ ID NO: 192479 - DNA, 10 bp, Unknown
  misc_feature (1)..( 10): Result.006 file - promoters50/4772230
aaatattcac

SEQ ID NO: 192480 - DNA, 10 bp, Unknown
  misc_feature (1)..( 10): Result.006 file - promoters50/4772230
caatattggc

SEQ ID NO: 192481 - DNA, 10 bp, Unknown
  misc_feature (1)..( 10): Result.006 file - promoters50/4772240
ctatatacac

SEQ ID NO: 192482 - DNA, 16 bp, Unknown
  misc_feature (1)..( 16): Result.006 file - promoters50/4772240
attgttacaaaaagaa

SEQ ID NO: 192483 - DNA, 16 bp, Unknown
  misc_feature (1)..( 16): Result.006 file - promoters50/4772240
attcttataaagtcag

SEQ ID NO: 192484 - DNA, 16 bp, Unknown
  misc_feature (1)..( 16): Result.006 file - promoters50/4772240
ctagatacaaaaaagg

SEQ ID NO: 192485 - DNA, 17 bp, Unknown
  misc_feature (1)..( 17): Result.006 file - promoters50/4772240
tggattacgaaaaaaaa

SEQ ID NO: 192486 - DNA, 17 bp, Unknown
  misc_feature (1)..( 17): Result.006 file - promoters50/4772240
aattttgctaaaaatcc

SEQ ID NO: 192487 - DNA, 17 bp, Unknown
  misc_feature (1)..( 17): Result.006 file - promoters50/4772240
tcgatagctgaaaacga

SEQ ID NO: 192488 - DNA, 18 bp, Unknown
  misc_feature (1)..( 18): Result.006 file - promoters50/4772240
ttttttaagaataaaaag

SEQ ID NO: 192489 - DNA, 15 bp, Unknown
  misc_feature (1)..( 15): Result.006 file - promoters50/4772240
attcattcttcgtga

SEQ ID NO: 192490 - DNA, 15 bp, Unknown
  misc_feature (1)..( 15): Result.006 file - promoters50/4772240
tctaattgttcatga

SEQ ID NO: 192491 - DNA, 15 bp, Unknown
  misc_feature (1)..( 15): Result.006 file - promoters50/4772240
ttgatttgttcctcc

SEQ ID NO: 192492 - DNA, 15 bp, Unknown
  misc_feature (1)..( 15): Result.006 file - promoters50/4772240
taaaatagttttatt

SEQ ID NO: 192493 - DNA, 15 bp, Unknown
  misc_feature (1)..( 15): Result.006 file - promoters50/4772240
gtaaatagacgttag

SEQ ID NO: 192494 - DNA, 15 bp, Unknown
  misc_feature (1)..( 15): Result.006 file - promoters50/4772240
ttgaattgttccccc

SEQ ID NO: 192495 - DNA, 13 bp, Unknown
  misc_feature (1)..( 13): Result.006 file - promoters50/4772240
gttacaaaaagaa

SEQ ID NO: 192496 - DNA, 13 bp, Unknown
  misc_feature (1)..( 13): Result.006 file - promoters50/4772240
atacaaaaaaggc

SEQ ID NO: 192497 - DNA, 13 bp, Unknown
  misc_feature (1)..( 13): Result.006 file - promoters50/4772240
ttacgaaaaaaaa

SEQ ID NO: 192498 - DNA, 13 bp, Unknown
  misc_feature (1)..( 13): Result.006 file - promoters50/4772240
ttgctaaaaatcc

SEQ ID NO: 192499 - DNA, 13 bp, Unknown
  misc_feature (1)..( 13): Result.006 file - promoters50/4772240
agctgaaaacgaa

SEQ ID NO: 192500 - DNA, 13 bp, Unknown
  misc_feature (1)..( 13): Result.006 file - promoters50/4772248
agaataaaaagac

SEQ ID NO: 192501 - DNA, 13 bp, Unknown
  misc_feature (1)..( 13): Result.006 file - promoters50/4772248
tttatgtttagtt

SEQ ID NO: 192502 - DNA, 13 bp, Unknown
  misc_feature (1)..( 13): Result.006 file - promoters50/4772248
ataaagtttagta

SEQ ID NO: 192503 - DNA, 13 bp, Unknown
  misc_feature (1)..( 13): Result.006 file - promoters50/4772248
ctctttttttgtt

SEQ ID NO: 192504 - DNA, 13 bp, Unknown
  misc_feature (1)..( 13): Result.006 file - promoters50/4772248
ggtgtgtttaatc

SEQ ID NO: 192505 - DNA, 13 bp, Unknown
  misc_feature (1)..( 13): Result.006 file - promoters50/4772248
tttctgtttgata

SEQ ID NO: 192506 - DNA, 13 bp, Unknown
  misc_feature (1)..( 13): Result.006 file - promoters50/4772248
ctgacgtttttgt

SEQ ID NO: 192507 - DNA, 13 bp, Unknown
  misc_feature (1)..( 13): Result.006 file - promoters50/4772248
atcgtgtttttga

SEQ ID NO: 192508 - DNA, 13 bp, Unknown
  misc_feature (1)..( 13): Result.006 file - promoters50/4772248
aactttatattct

SEQ ID NO: 192509 - DNA, 13 bp, Unknown
  misc_feature (1)..( 13): Result.006 file - promoters50/4772248
tttaatattttcg

SEQ ID NO: 192510 - DNA, 13 bp, Unknown
  misc_feature (1)..( 13): Result.006 file - promoters50/4772248
caatttatatctt

SEQ ID NO: 192511 - DNA, 13 bp, Unknown
  misc_feature (1)..( 13): Result.006 file - promoters50/4772248
tttattatatagc

SEQ ID NO: 192512 - DNA, 13 bp, Unknown
  misc_feature (1)..( 13): Result.006 file - promoters50/4772248
tatacaatatttt

SEQ ID NO: 192513 - DNA, 13 bp, Unknown
  misc_feature (1)..( 13): Result.006 file - promoters50/4772248
caatttatctaac

SEQ ID NO: 192514 - DNA, 15 bp, Unknown
  misc_feature (1)..( 15): Result.006 file - promoters50/4772248
tctagtttagtttgc

SEQ ID NO: 192515 - DNA, 15 bp, Unknown
  misc_feature (1)..( 15): Result.006 file - promoters50/4772248
actatttttaattat

SEQ ID NO: 192516 - DNA, 15 bp, Unknown
  misc_feature (1)..( 15): Result.006 file - promoters50/4772248
tctaattttgtcaaa

SEQ ID NO: 192517 - DNA, 15 bp, Unknown
  misc_feature (1)..( 15): Result.006 file - promoters50/4772248
ataaattttgattaa

SEQ ID NO: 192518 - DNA, 15 bp, Unknown
  misc_feature (1)..( 15): Result.006 file - promoters50/4772248
tttttttttgtaaac

SEQ ID NO: 192519 - DNA, 15 bp, Unknown
  misc_feature (1)..( 15): Result.006 file - promoters50/4772248
agtcgttttgttttt

SEQ ID NO: 192520 - DNA, 13 bp, Unknown
  misc_feature (1)..( 13): Result.006 file - promoters50/4772248
actgtgtttctat

SEQ ID NO: 192521 - DNA, 13 bp, Unknown
  misc_feature (1)..( 13): Result.006 file - promoters50/4772248
taaatgtttctgt

SEQ ID NO: 192522 - DNA, 13 bp, Unknown
  misc_feature (1)..( 13): Result.006 file - promoters50/4772248
ggtgtgtttaatc

SEQ ID NO: 192523 - DNA, 13 bp, Unknown
  misc_feature (1)..( 13): Result.006 file - promoters50/4772248
atcgtgtttttga

SEQ ID NO: 192524 - DNA, 13 bp, Unknown
  misc_feature (1)..( 13): Result.006 file - promoters50/4772248
atcgggtttttcg

SEQ ID NO: 192525 - DNA, 13 bp, Unknown
  misc_feature (1)..( 13): Result.006 file - promoters50/4772248
tttttgtttctct

SEQ ID NO: 192526 - DNA, 13 bp, Unknown
  misc_feature (1)..( 13): Result.006 file - promoters50/4772248
ctgacgtttttgt

SEQ ID NO: 192527 - DNA, 10 bp, Unknown
  misc_feature (1)..( 10): Result.006 file - promoters50/4772248
acataacttt

SEQ ID NO: 192528 - DNA, 10 bp, Unknown
  misc_feature (1)..( 10): Result.006 file - promoters50/4772248
ttatatcttt

SEQ ID NO: 192529 - DNA, 10 bp, Unknown
  misc_feature (1)..( 10): Result.006 file - promoters50/4772248
gcatcactct

SEQ ID NO: 192530 - DNA, 10 bp, Unknown
  misc_feature (1)..( 10): Result.006 file - promoters50/4772248
tcataaattt

SEQ ID NO: 192531 - DNA, 10 bp, Unknown
  misc_feature (1)..( 10): Result.006 file - promoters50/4772248
taatattttc

SEQ ID NO: 192532 - DNA, 10 bp, Unknown
  misc_feature (1)..( 10): Result.006 file - promoters50/4772248
ccaaaatttc

SEQ ID NO: 192533 - DNA, 10 bp, Unknown
  misc_feature (1)..( 10): Result.006 file - promoters50/4772248
aaataaatat

SEQ ID NO: 192534 - DNA, 10 bp, Unknown
  misc_feature (1)..( 10): Result.006 file - promoters50/4772248
tcaaaaataa

SEQ ID NO: 192535 - DNA, 14 bp, Unknown
  misc_feature (1)..( 14): Result.006 file - promoters50/4772248
catcaaacccacct

SEQ ID NO: 192536 - DNA, 14 bp, Unknown
  misc_feature (1)..( 14): Result.006 file - promoters50/4772248
cataaaactttgaa

SEQ ID NO: 192537 - DNA, 14 bp, Unknown
  misc_feature (1)..( 14): Result.006 file - promoters50/4772248
gataaaattagtga

SEQ ID NO: 192538 - DNA, 14 bp, Unknown
  misc_feature (1)..( 14): Result.006 file - promoters50/4772248
tacaaaacttctct

SEQ ID NO: 192539 - DNA, 14 bp, Unknown
  misc_feature (1)..( 14): Result.006 file - promoters50/4772248
ttccaaaatttctc

SEQ ID NO: 192540 - DNA, 14 bp, Unknown
  misc_feature (1)..( 14): Result.006 file - promoters50/4772248
tcataaattttttt

SEQ ID NO: 192541 - DNA, 15 bp, Unknown
  misc_feature (1)..( 15): Result.006 file - promoters50/4772248
atacttttaatattt

SEQ ID NO: 192542 - DNA, 15 bp, Unknown
  misc_feature (1)..( 15): Result.006 file - promoters50/4772248
tctattttattatat

SEQ ID NO: 192543 - DNA, 15 bp, Unknown
  misc_feature (1)..( 15): Result.006 file - promoters50/4772248
atatttttcataaat

SEQ ID NO: 192544 - DNA, 15 bp, Unknown
  misc_feature (1)..( 15): Result.006 file - promoters50/4772248
atatctttgattttt

SEQ ID NO: 192545 - DNA, 15 bp, Unknown
  misc_feature (1)..( 15): Result.006 file - promoters50/4772248
attttttgcatcact

SEQ ID NO: 192546 - DNA, 15 bp, Unknown
  misc_feature (1)..( 15): Result.006 file - promoters50/4772248
gtttctctcaaaaat

SEQ ID NO: 192547 - DNA, 11 bp, Unknown
  misc_feature (1)..( 11): Result.006 file - promoters50/4772248
ttttataaata

SEQ ID NO: 192548 - DNA, 11 bp, Unknown
  misc_feature (1)..( 11): Result.006 file - promoters50/4772248
cgttattaata

SEQ ID NO: 192549 - DNA, 11 bp, Unknown
  misc_feature (1)..( 11): Result.006 file - promoters50/4772248
gttttttaatt

SEQ ID NO: 192550 - DNA, 11 bp, Unknown
  misc_feature (1)..( 11): Result.006 file - promoters50/4772248
atttatacata

SEQ ID NO: 192551 - DNA, 11 bp, Unknown
  misc_feature (1)..( 11): Result.006 file - promoters50/4772248
ttttgtaaacc

SEQ ID NO: 192552 - DNA, 11 bp, Unknown
  misc_feature (1)..( 11): Result.006 file - promoters50/4772248
agttattctct

SEQ ID NO: 192553 - DNA, 11 bp, Unknown
  misc_feature (1)..( 11): Result.006 file - promoters50/4772248
tgtttttacct

SEQ ID NO: 192554 - DNA, 10 bp, Unknown
  misc_feature (1)..( 10): Result.006 file - promoters50/4772248
tttttaatta

SEQ ID NO: 192555 - DNA, 10 bp, Unknown
  misc_feature (1)..( 10): Result.006 file - promoters50/4772248
attttgatta

SEQ ID NO: 192556 - DNA, 11 bp, Unknown
  misc_feature (1)..( 11): Result.006 file - promoters50/4772248
ttttataatcg

SEQ ID NO: 192557 - DNA, 11 bp, Unknown
  misc_feature (1)..( 11): Result.006 file - promoters50/4772248
ttttctaattt

SEQ ID NO: 192558 - DNA, 11 bp, Unknown
  misc_feature (1)..( 11): Result.006 file - promoters50/4772248
gtttctaaacc

SEQ ID NO: 192559 - DNA, 11 bp, Unknown
  misc_feature (1)..( 11): Result.006 file - promoters50/4772248
gttattctctt

SEQ ID NO: 192560 - DNA, 12 bp, Unknown
  misc_feature (1)..( 12): Result.006 file - promoters50/4772248
gattattttggg

SEQ ID NO: 192561 - DNA, 12 bp, Unknown
  misc_feature (1)..( 12): Result.006 file - promoters50/4772248
ctatatttttca

SEQ ID NO: 192562 - DNA, 12 bp, Unknown
  misc_feature (1)..( 12): Result.006 file - promoters50/4772248
ataaattttttt

SEQ ID NO: 192563 - DNA, 12 bp, Unknown
  misc_feature (1)..( 12): Result.006 file - promoters50/4772248
tttgatttttga

SEQ ID NO: 192564 - DNA, 12 bp, Unknown
  misc_feature (1)..( 12): Result.006 file - promoters50/4772248
caaaatttctca

SEQ ID NO: 192565 - DNA, 12 bp, Unknown
  misc_feature (1)..( 12): Result.006 file - promoters50/4772248
caaaacttctct

SEQ ID NO: 192566 - DNA, 15 bp, Unknown
  misc_feature (1)..( 15): Result.006 file - promoters50/4772248
ttcggttataaagtt

SEQ ID NO: 192567 - DNA, 15 bp, Unknown
  misc_feature (1)..( 15): Result.006 file - promoters50/4772248
caaacttataagtct

SEQ ID NO: 192568 - DNA, 15 bp, Unknown
  misc_feature (1)..( 15): Result.006 file - promoters50/4772248
atcacttgtaaatgt

SEQ ID NO: 192569 - DNA, 15 bp, Unknown
  misc_feature (1)..( 15): Result.006 file - promoters50/4772248
tgtttttgaaaatcg

SEQ ID NO: 192570 - DNA, 15 bp, Unknown
  misc_feature (1)..( 15): Result.006 file - promoters50/4772248
ctctcttaaaagtct

SEQ ID NO: 192571 - DNA, 15 bp, Unknown
  misc_feature (1)..( 15): Result.006 file - promoters50/4772248
caaacatatatacaa

SEQ ID NO: 192572 - DNA, 10 bp, Unknown
  misc_feature (1)..( 10): Result.006 file - promoters50/4772248
aaaactttga

SEQ ID NO: 192573 - DNA, 10 bp, Unknown
  misc_feature (1)..( 10): Result.006 file - promoters50/4772248
caaaatttct

SEQ ID NO: 192574 - DNA, 10 bp, Unknown
  misc_feature (1)..( 10): Result.006 file - promoters50/4772248
tgaactttta

SEQ ID NO: 192575 - DNA, 10 bp, Unknown
  misc_feature (1)..( 10): Result.006 file - promoters50/4772248
aaaacttctc

SEQ ID NO: 192576 - DNA, 10 bp, Unknown
  misc_feature (1)..( 10): Result.006 file - promoters50/4772248
ataaatatct

SEQ ID NO: 192577 - DNA, 10 bp, Unknown
  misc_feature (1)..( 10): Result.006 file - promoters50/4772258
ataaattttt

SEQ ID NO: 192578 - DNA, 8 bp, Unknown
  misc_feature (1)..( 8): Result.006 file - promoters50/4772258
tgttgttg

SEQ ID NO: 192579 - DNA, 8 bp, Unknown
  misc_feature (1)..( 8): Result.006 file - promoters50/4772258
tgttgttt

SEQ ID NO: 192580 - DNA, 8 bp, Unknown
  misc_feature (1)..( 8): Result.006 file - promoters50/4772258
agtttttt

SEQ ID NO: 192581 - DNA, 8 bp, Unknown
  misc_feature (1)..( 8): Result.006 file - promoters50/4772258
cgtttttt

SEQ ID NO: 192582 - DNA, 9 bp, Unknown
  misc_feature (1)..( 9): Result.006 file - promoters50/4772258
attttttat

SEQ ID NO: 192583 - DNA, 9 bp, Unknown
  misc_feature (1)..( 9): Result.006 file - promoters50/4772258
atttttcgt

SEQ ID NO: 192584 - DNA, 9 bp, Unknown
  misc_feature (1)..( 9): Result.006 file - promoters50/4772258
gttttatat

SEQ ID NO: 192585 - DNA, 9 bp, Unknown
  misc_feature (1)..( 9): Result.006 file - promoters50/4772274
tttttttgt

SEQ ID NO: 192586 - DNA, 8 bp, Unknown
  misc_feature (1)..( 8): Result.006 file - promoters50/4772274
attcttct

SEQ ID NO: 192587 - DNA, 8 bp, Unknown
  misc_feature (1)..( 8): Result.006 file - promoters50/4772274
attcttta

SEQ ID NO: 192588 - DNA, 8 bp, Unknown
  misc_feature (1)..( 8): Result.006 file - promoters50/4772274
gttctttt

SEQ ID NO: 192589 - DNA, 8 bp, Unknown
  misc_feature (1)..( 8): Result.006 file - promoters50/4772274
tttcttta

SEQ ID NO: 192590 - DNA, 9 bp, Unknown
  misc_feature (1)..( 9): Result.006 file - promoters50/4772274
tttcatttg

SEQ ID NO: 192591 - DNA, 9 bp, Unknown
  misc_feature (1)..( 9): Result.006 file - promoters50/4772274
atttctttt

SEQ ID NO: 192592 - DNA, 6 bp, Unknown
  misc_feature (1)..( 6): Result.006 file - promoters50/4772274
ttcttt

SEQ ID NO: 192593 - DNA, 6 bp, Unknown
  misc_feature (1)..( 6): Result.006 file - promoters50/4772274
ttcttt

SEQ ID NO: 192594 - DNA, 6 bp, Unknown
  misc_feature (1)..( 6): Result.006 file - promoters50/4772274
ttcttt

SEQ ID NO: 192595 - DNA, 6 bp, Unknown
  misc_feature (1)..( 6): Result.006 file - promoters50/4772274
ttcttt

SEQ ID NO: 192596 - DNA, 7 bp, Unknown
  misc_feature (1)..( 7): Result.006 file - promoters50/4772274
ttcattt

SEQ ID NO: 192597 - DNA, 7 bp, Unknown
  misc_feature (1)..( 7): Result.006 file - promoters50/4772274
tttcttt

SEQ ID NO: 192598 - DNA, 16 bp, Unknown
  misc_feature (1)..( 16): Result.006 file - promoters50/4772274
aaaaaaaggttatctc

SEQ ID NO: 192599 - DNA, 16 bp, Unknown
  misc_feature (1)..( 16): Result.006 file - promoters50/4772274
atacaaaagttatcat

SEQ ID NO: 192600 - DNA, 16 bp, Unknown
  misc_feature (1)..( 16): Result.006 file - promoters50/4772274
tgagttagtttaccat

SEQ ID NO: 192601 - DNA, 16 bp, Unknown
  misc_feature (1)..( 16): Result.006 file - promoters50/4772274
ataccaaatttaatgt

SEQ ID NO: 192602 - DNA, 16 bp, Unknown
  misc_feature (1)..( 16): Result.006 file - promoters50/4772274
ctaccaaacttatctt

SEQ ID NO: 192603 - DNA, 16 bp, Unknown
  misc_feature (1)..( 16): Result.006 file - promoters50/4772285
atatcaaactcgatta

SEQ ID NO: 192604 - DNA, 12 bp, Unknown
  misc_feature (1)..( 12): Result.006 file - promoters50/4772285
gataatgaaagt

SEQ ID NO: 192605 - DNA, 12 bp, Unknown
  misc_feature (1)..( 12): Result.006 file - promoters50/4772285
ctaaataaaagt

SEQ ID NO: 192606 - DNA, 12 bp, Unknown
  misc_feature (1)..( 12): Result.006 file - promoters50/4772285
gataattaaaag

SEQ ID NO: 192607 - DNA, 7 bp, Unknown
  misc_feature (1)..( 7): Result.006 file - promoters50/4772285
aaaataa

SEQ ID NO: 192608 - DNA, 7 bp, Unknown
  misc_feature (1)..( 7): Result.006 file - promoters50/4772285
aaaataa

SEQ ID NO: 192609 - DNA, 7 bp, Unknown
  misc_feature (1)..( 7): Result.006 file - promoters50/4772285
aaaaaag

SEQ ID NO: 192610 - DNA, 9 bp, Unknown
  misc_feature (1)..( 9): Result.006 file - promoters50/4772285
taaaattgt

SEQ ID NO: 192611 - DNA, 9 bp, Unknown
  misc_feature (1)..( 9): Result.006 file - promoters50/4772285
taatattat

SEQ ID NO: 192612 - DNA, 9 bp, Unknown
  misc_feature (1)..( 9): Result.006 file - promoters50/4772285
gaattttat

SEQ ID NO: 192613 - DNA, 10 bp, Unknown
  misc_feature (1)..( 10): Result.006 file - promoters50/4772285
caaaaatgta

SEQ ID NO: 192614 - DNA, 10 bp, Unknown
  misc_feature (1)..( 10): Result.006 file - promoters50/4772285
caaaaaagta

SEQ ID NO: 192615 - DNA, 10 bp, Unknown
  misc_feature (1)..( 10): Result.006 file - promoters50/4772289
agaaaataaa

SEQ ID NO: 192616 - DNA, 8 bp, Unknown
  misc_feature (1)..( 8): Result.006 file - promoters50/4772289
gaatcaat

SEQ ID NO: 192617 - DNA, 8 bp, Unknown
  misc_feature (1)..( 8): Result.006 file - promoters50/4772289
gaaacaaa

SEQ ID NO: 192618 - DNA, 8 bp, Unknown
  misc_feature (1)..( 8): Result.006 file - promoters50/4772289
gaaagaaa

SEQ ID NO: 192619 - DNA, 7 bp, Unknown
  misc_feature (1)..( 7): Result.006 file - promoters50/4772289
agatgtc

SEQ ID NO: 192620 - DNA, 7 bp, Unknown
  misc_feature (1)..( 7): Result.006 file - promoters50/4772289
agatgtg

SEQ ID NO: 192621 - DNA, 7 bp, Unknown
  misc_feature (1)..( 7): Result.006 file - promoters50/4772311
tgatgtg

SEQ ID NO: 192622 - DNA, 10 bp, Unknown
  misc_feature (1)..( 10): Result.006 file - promoters50/4772311
caaaacaaga

SEQ ID NO: 192623 - DNA, 10 bp, Unknown
  misc_feature (1)..( 10): Result.006 file - promoters50/4772311
aaaatcaagt

SEQ ID NO: 192624 - DNA, 10 bp, Unknown
  misc_feature (1)..( 10): Result.006 file - promoters50/4772311
aaaaacatat

SEQ ID NO: 192625 - DNA, 10 bp, Unknown
  misc_feature (1)..( 10): Result.006 file - promoters50/4772311
taaaccaagc

SEQ ID NO: 192626 - DNA, 10 bp, Unknown
  misc_feature (1)..( 10): Result.006 file - promoters50/4772311
aaaatcgtaa

SEQ ID NO: 192627 - DNA, 10 bp, Unknown
  misc_feature (1)..( 10): Result.006 file - promoters50/4772311
aaaaatggat

SEQ ID NO: 192628 - DNA, 10 bp, Unknown
  misc_feature (1)..( 10): Result.006 file - promoters50/4772311
taaaataatc

SEQ ID NO: 192629 - DNA, 10 bp, Unknown
  misc_feature (1)..( 10): Result.006 file - promoters50/4772311
tcaaacattg

SEQ ID NO: 192630 - DNA, 11 bp, Unknown
  misc_feature (1)..( 11): Result.006 file - promoters50/4772311
aaacttcatgt

SEQ ID NO: 192631 - DNA, 11 bp, Unknown
  misc_feature (1)..( 11): Result.006 file - promoters50/4772311
aaatttcataa

SEQ ID NO: 192632 - DNA, 11 bp, Unknown
  misc_feature (1)..( 11): Result.006 file - promoters50/4772311
aaaattcccaa

SEQ ID NO: 192633 - DNA, 11 bp, Unknown
  misc_feature (1)..( 11): Result.006 file - promoters50/4772311
aatgttcatat

SEQ ID NO: 192634 - DNA, 11 bp, Unknown
  misc_feature (1)..( 11): Result.006 file - promoters50/4772311
gtattttataa

SEQ ID NO: 192635 - DNA, 11 bp, Unknown
  misc_feature (1)..( 11): Result.006 file - promoters50/4772311
taatctcaacg

SEQ ID NO: 192636 - DNA, 13 bp, Unknown
  misc_feature (1)..( 13): Result.006 file - promoters50/4772311
atgatgtttctct

SEQ ID NO: 192637 - DNA, 13 bp, Unknown
  misc_feature (1)..( 13): Result.006 file - promoters50/4772311
caaatgtttgtct

SEQ ID NO: 192638 - DNA, 13 bp, Unknown
  misc_feature (1)..( 13): Result.006 file - promoters50/4772311
tagatattttttt

SEQ ID NO: 192639 - DNA, 13 bp, Unknown
  misc_feature (1)..( 13): Result.006 file - promoters50/4772311
aaaatgttaggtc

SEQ ID NO: 192640 - DNA, 13 bp, Unknown
  misc_feature (1)..( 13): Result.006 file - promoters50/4772311
aaaatgttgaata

SEQ ID NO: 192641 - DNA, 13 bp, Unknown
  misc_feature (1)..( 13): Result.006 file - promoters50/4772311
aaaatgttttatt

SEQ ID NO: 192642 - DNA, 14 bp, Unknown
  misc_feature (1)..( 14): Result.006 file - promoters50/4772311
tgtttataaaaaaa

SEQ ID NO: 192643 - DNA, 14 bp, Unknown
  misc_feature (1)..( 14): Result.006 file - promoters50/4772311
cacatataaataaa

SEQ ID NO: 192644 - DNA, 14 bp, Unknown
  misc_feature (1)..( 14): Result.006 file - promoters50/4772311
attttataattatt

SEQ ID NO: 192645 - DNA, 14 bp, Unknown
  misc_feature (1)..( 14): Result.006 file - promoters50/4772311
gattacgaaaaaat

SEQ ID NO: 192646 - DNA, 14 bp, Unknown
  misc_feature (1)..( 14): Result.006 file - promoters50/4772311
atttcataaccgtt

SEQ ID NO: 192647 - DNA, 14 bp, Unknown
  misc_feature (1)..( 14): Result.006 file - promoters50/4772311
ctaaaataatctca

SEQ ID NO: 192648 - DNA, 11 bp, Unknown
  misc_feature (1)..( 11): Result.006 file - promoters50/4772311
aaacgaaaaaa

SEQ ID NO: 192649 - DNA, 11 bp, Unknown
  misc_feature (1)..( 11): Result.006 file - promoters50/4772311
tccagaagaaa

SEQ ID NO: 192650 - DNA, 11 bp, Unknown
  misc_feature (1)..( 11): Result.006 file - promoters50/4772311
aatggaaaaac

SEQ ID NO: 192651 - DNA, 12 bp, Unknown
  misc_feature (1)..( 12): Result.006 file - promoters50/4772311
ttagtaaataaa

SEQ ID NO: 192652 - DNA, 12 bp, Unknown
  misc_feature (1)..( 12): Result.006 file - promoters50/4772311
ttgagaaagaaa

SEQ ID NO: 192653 - DNA, 12 bp, Unknown
  misc_feature (1)..( 12): Result.006 file - promoters50/4772311
ttgacaaaaaaa

SEQ ID NO: 192654 - DNA, 12 bp, Unknown
  misc_feature (1)..( 12): Result.006 file - promoters50/4772311
tggagaaacgac

SEQ ID NO: 192655 - DNA, 14 bp, Unknown
  misc_feature (1)..( 14): Result.006 file - promoters50/4772311
acgaaaaaaataca

SEQ ID NO: 192656 - DNA, 14 bp, Unknown
  misc_feature (1)..( 14): Result.006 file - promoters50/4772311
agaagaaagatatt

SEQ ID NO: 192657 - DNA, 14 bp, Unknown
  misc_feature (1)..( 14): Result.006 file - promoters50/4772311
aatggaaaaacagg

SEQ ID NO: 192658 - DNA, 14 bp, Unknown
  misc_feature (1)..( 14): Result.006 file - promoters50/4772311
aattagtaaataaa

SEQ ID NO: 192659 - DNA, 14 bp, Unknown
  misc_feature (1)..( 14): Result.006 file - promoters50/4772311
acaagaaagagaga

SEQ ID NO: 192660 - DNA, 14 bp, Unknown
  misc_feature (1)..( 14): Result.006 file - promoters50/4772311
ttgacaaaaaaaaa

SEQ ID NO: 192661 - DNA, 14 bp, Unknown
  misc_feature (1)..( 14): Result.006 file - promoters50/4772311
aaaaattaaacaga

SEQ ID NO: 192662 - DNA, 14 bp, Unknown
  misc_feature (1)..( 14): Result.006 file - promoters50/4772311
tggagaaacgacgc

SEQ ID NO: 192663 - DNA, 9 bp, Unknown
  misc_feature (1)..( 9): Result.006 file - promoters50/4772311
tatttctat

SEQ ID NO: 192664 - DNA, 9 bp, Unknown
  misc_feature (1)..( 9): Result.006 file - promoters50/4772311
ggtttctag

SEQ ID NO: 192665 - DNA, 9 bp, Unknown
  misc_feature (1)..( 9): Result.006 file - promoters50/4772311
agtttttat

SEQ ID NO: 192666 - DNA, 9 bp, Unknown
  misc_feature (1)..( 9): Result.006 file - promoters50/4772311
cttttctaa

SEQ ID NO: 192667 - DNA, 9 bp, Unknown
  misc_feature (1)..( 9): Result.006 file - promoters50/4772311
tgttattaa

SEQ ID NO: 192668 - DNA, 9 bp, Unknown
  misc_feature (1)..( 9): Result.006 file - promoters50/4772311
tgttattcg

SEQ ID NO: 192669 - DNA, 14 bp, Unknown
  misc_feature (1)..( 14): Result.006 file - promoters50/4772311
attaaaaaggaaga

SEQ ID NO: 192670 - DNA, 14 bp, Unknown
  misc_feature (1)..( 14): Result.006 file - promoters50/4772311
tttaaaaattccac

SEQ ID NO: 192671 - DNA, 14 bp, Unknown
  misc_feature (1)..( 14): Result.006 file - promoters50/4772311
aaaaaaaaagaaga

SEQ ID NO: 192672 - DNA, 14 bp, Unknown
  misc_feature (1)..( 14): Result.006 file - promoters50/4772311
tttaaacgccgtcg

SEQ ID NO: 192673 - DNA, 14 bp, Unknown
  misc_feature (1)..( 14): Result.006 file - promoters50/4772311
ttgaaaaaaactgc

SEQ ID NO: 192674 - DNA, 14 bp, Unknown
  misc_feature (1)..( 14): Result.006 file - promoters50/4772315
accaaaaaaaagtc

SEQ ID NO: 192675 - DNA, 16 bp, Unknown
  misc_feature (1)..( 16): Result.006 file - promoters50/4772315
ttgattttactttatt

SEQ ID NO: 192676 - DNA, 16 bp, Unknown
  misc_feature (1)..( 16): Result.006 file - promoters50/4772315
tccgtttttcttataa

SEQ ID NO: 192677 - DNA, 16 bp, Unknown
  misc_feature (1)..( 16): Result.006 file - promoters50/4772315
ttcgtttttggtttaa

SEQ ID NO: 192678 - DNA, 16 bp, Unknown
  misc_feature (1)..( 16): Result.006 file - promoters50/4772315
tagaattttctggttt

SEQ ID NO: 192679 - DNA, 16 bp, Unknown
  misc_feature (1)..( 16): Result.006 file - promoters50/4772315
ttgattttactttatt

SEQ ID NO: 192680 - DNA, 16 bp, Unknown
  misc_feature (1)..( 16): Result.006 file - promoters50/4772323
taggattctctcgaaa

SEQ ID NO: 192681 - DNA, 9 bp, Unknown
  misc_feature (1)..( 9): Result.006 file - promoters50/4772323
aattaacta

SEQ ID NO: 192682 - DNA, 9 bp, Unknown
  misc_feature (1)..( 9): Result.006 file - promoters50/4772323
gtttatcta

SEQ ID NO: 192683 - DNA, 9 bp, Unknown
  misc_feature (1)..( 9): Result.006 file - promoters50/4772323
ttttgtctg

SEQ ID NO: 192684 - DNA, 9 bp, Unknown
  misc_feature (1)..( 9): Result.006 file - promoters50/4772323
ttttgttgc

SEQ ID NO: 192685 - DNA, 9 bp, Unknown
  misc_feature (1)..( 9): Result.006 file - promoters50/4772329
ttttgtatg

SEQ ID NO: 192686 - DNA, 7 bp, Unknown
  misc_feature (1)..( 7): Result.006 file - promoters50/4772329
aaaacaa

SEQ ID NO: 192687 - DNA, 7 bp, Unknown
  misc_feature (1)..( 7): Result.006 file - promoters50/4772329
aaaacat

SEQ ID NO: 192688 - DNA, 7 bp, Unknown
  misc_feature (1)..( 7): Result.006 file - promoters50/4772329
taaacat

SEQ ID NO: 192689 - DNA, 8 bp, Unknown
  misc_feature (1)..( 8): Result.006 file - promoters50/4772329
attgttta

SEQ ID NO: 192690 - DNA, 8 bp, Unknown
  misc_feature (1)..( 8): Result.006 file - promoters50/4772329
tttgttta

SEQ ID NO: 192691 - DNA, 8 bp, Unknown
  misc_feature (1)..( 8): Result.006 file - promoters50/4772329
tttggttg

SEQ ID NO: 192692 - DNA, 9 bp, Unknown
  misc_feature (1)..( 9): Result.006 file - promoters50/4772329
taacttaat

SEQ ID NO: 192693 - DNA, 9 bp, Unknown
  misc_feature (1)..( 9): Result.006 file - promoters50/4772329
taagttata

SEQ ID NO: 192694 - DNA, 9 bp, Unknown
  misc_feature (1)..( 9): Result.006 file - promoters50/4772329
ttactcaat

SEQ ID NO: 192695 - DNA, 7 bp, Unknown
  misc_feature (1)..( 7): Result.006 file - promoters50/4772329
ttatatc

SEQ ID NO: 192696 - DNA, 7 bp, Unknown
  misc_feature (1)..( 7): Result.006 file - promoters50/4772329
ttatata

SEQ ID NO: 192697 - DNA, 7 bp, Unknown
  misc_feature (1)..( 7): Result.006 file - promoters50/4772329
gtatata

SEQ ID NO: 192698 - DNA, 7 bp, Unknown
  misc_feature (1)..( 7): Result.006 file - promoters50/4772329
attattg

SEQ ID NO: 192699 - DNA, 7 bp, Unknown
  misc_feature (1)..( 7): Result.006 file - promoters50/4772329
attatta

SEQ ID NO: 192700 - DNA, 7 bp, Unknown
  misc_feature (1)..( 7): Result.006 file - promoters50/4772329
attttta

SEQ ID NO: 192701 - DNA, 8 bp, Unknown
  misc_feature (1)..( 8): Result.006 file - promoters50/4772329
aatattca

SEQ ID NO: 192702 - DNA, 8 bp, Unknown
  misc_feature (1)..( 8): Result.006 file - promoters50/4772329
tatattca

SEQ ID NO: 192703 - DNA, 8 bp, Unknown
  misc_feature (1)..( 8): Result.006 file - promoters50/4772329
aatatttt

SEQ ID NO: 192704 - DNA, 8 bp, Unknown
  misc_feature (1)..( 8): Result.006 file - promoters50/4772329
tatatttt

SEQ ID NO: 192705 - DNA, 12 bp, Unknown
  misc_feature (1)..( 12): Result.006 file - promoters50/4772329
atagtatacacg

SEQ ID NO: 192706 - DNA, 12 bp, Unknown
  misc_feature (1)..( 12): Result.006 file - promoters50/4772329
atagtttacatt

SEQ ID NO: 192707 - DNA, 12 bp, Unknown
  misc_feature (1)..( 12): Result.006 file - promoters50/4772329
tttacatacacg

SEQ ID NO: 192708 - DNA, 8 bp, Unknown
  misc_feature (1)..( 8): Result.006 file - promoters50/4772329
aaacatta

SEQ ID NO: 192709 - DNA, 8 bp, Unknown
  misc_feature (1)..( 8): Result.006 file - promoters50/4772329
aaatatta

SEQ ID NO: 192710 - DNA, 8 bp, Unknown
  misc_feature (1)..( 8): Result.006 file - promoters50/4772329
tcacatta

SEQ ID NO: 192711 - DNA, 10 bp, Unknown
  misc_feature (1)..( 10): Result.006 file - promoters50/4772329
ctttatataa

SEQ ID NO: 192712 - DNA, 10 bp, Unknown
  misc_feature (1)..( 10): Result.006 file - promoters50/4772329
gtctatataa

SEQ ID NO: 192713 - DNA, 10 bp, Unknown
  misc_feature (1)..( 10): Result.006 file - promoters50/4772329
ctttatatat

SEQ ID NO: 192714 - DNA, 10 bp, Unknown
  misc_feature (1)..( 10): Result.006 file - promoters50/4772329
gcgtatttaa

SEQ ID NO: 192715 - DNA, 8 bp, Unknown
  misc_feature (1)..( 8): Result.006 file - promoters50/4772329
tacttctc

SEQ ID NO: 192716 - DNA, 8 bp, Unknown
  misc_feature (1)..( 8): Result.006 file - promoters50/4772329
ttcttctc

SEQ ID NO: 192717 - DNA, 8 bp, Unknown
  misc_feature (1)..( 8): Result.006 file - promoters50/4772336
ttcttcta

SEQ ID NO: 192718 - DNA, 19 bp, Unknown
  misc_feature (1)..( 19): Result.006 file - promoters50/4772336
gatcatctaaaaattgaca

SEQ ID NO: 192719 - DNA, 19 bp, Unknown
  misc_feature (1)..( 19): Result.006 file - promoters50/4772336
ccaactatccaaaatgaaa

SEQ ID NO: 192720 - DNA, 19 bp, Unknown
  misc_feature (1)..( 19): Result.006 file - promoters50/4772336
aactgatttttcattaaca

SEQ ID NO: 192721 - DNA, 19 bp, Unknown
  misc_feature (1)..( 19): Result.006 file - promoters50/4772336
ttcggaacacaaaattact

SEQ ID NO: 192722 - DNA, 19 bp, Unknown
  misc_feature (1)..( 19): Result.006 file - promoters50/4772336
ataatcaatcaaataaaca

SEQ ID NO: 192723 - DNA, 19 bp, Unknown
  misc_feature (1)..( 19): Result.006 file - promoters50/4772336
atagtcaaacaaatgtttg

SEQ ID NO: 192724 - DNA, 19 bp, Unknown
  misc_feature (1)..( 19): Result.006 file - promoters50/4772336
tacacatatcatagttata

SEQ ID NO: 192725 - DNA, 11 bp, Unknown
  misc_feature (1)..( 11): Result.006 file - promoters50/4772336
ctctatataaa

SEQ ID NO: 192726 - DNA, 11 bp, Unknown
  misc_feature (1)..( 11): Result.006 file - promoters50/4772336
cattatatata

SEQ ID NO: 192727 - DNA, 11 bp, Unknown
  misc_feature (1)..( 11): Result.006 file - promoters50/4772336
tgagatataat

SEQ ID NO: 192728 - DNA, 11 bp, Unknown
  misc_feature (1)..( 11): Result.006 file - promoters50/4772336
gcctatatata

SEQ ID NO: 192729 - DNA, 11 bp, Unknown
  misc_feature (1)..( 11): Result.006 file - promoters50/4772336
tcctttatatt

SEQ ID NO: 192730 - DNA, 11 bp, Unknown
  misc_feature (1)..( 11): Result.006 file - promoters50/4772336
tagtataaata

SEQ ID NO: 192731 - DNA, 11 bp, Unknown
  misc_feature (1)..( 11): Result.006 file - promoters50/4772336
aaatataaata

SEQ ID NO: 192732 - DNA, 11 bp, Unknown
  misc_feature (1)..( 11): Result.006 file - promoters50/4772336
gtgtataaatt

SEQ ID NO: 192733 - DNA, 12 bp, Unknown
  misc_feature (1)..( 12): Result.006 file - promoters50/4772336
ccttgagtttag

SEQ ID NO: 192734 - DNA, 12 bp, Unknown
  misc_feature (1)..( 12): Result.006 file - promoters50/4772336
tgttgaattttg

SEQ ID NO: 192735 - DNA, 12 bp, Unknown
  misc_feature (1)..( 12): Result.006 file - promoters50/4772336
atttgaataatt

SEQ ID NO: 192736 - DNA, 12 bp, Unknown
  misc_feature (1)..( 12): Result.006 file - promoters50/4772336
tgagaaatttca

SEQ ID NO: 192737 - DNA, 12 bp, Unknown
  misc_feature (1)..( 12): Result.006 file - promoters50/4772336
ggtaaaatttca

SEQ ID NO: 192738 - DNA, 12 bp, Unknown
  misc_feature (1)..( 12): Result.006 file - promoters50/4772340
attttaatagac

SEQ ID NO: 192739 - DNA, 11 bp, Unknown
  misc_feature (1)..( 11): Result.006 file - promoters50/4772340
gtatataaata

SEQ ID NO: 192740 - DNA, 11 bp, Unknown
  misc_feature (1)..( 11): Result.006 file - promoters50/4772340
tgttataaaac

SEQ ID NO: 192741 - DNA, 11 bp, Unknown
  misc_feature (1)..( 11): Result.006 file - promoters50/4772340
atctataaaaa

SEQ ID NO: 192742 - DNA, 11 bp, Unknown
  misc_feature (1)..( 11): Result.006 file - promoters50/4772340
aactataaata

SEQ ID NO: 192743 - DNA, 11 bp, Unknown
  misc_feature (1)..( 11): Result.006 file - promoters50/4772340
ctatataaacc

SEQ ID NO: 192744 - DNA, 11 bp, Unknown
  misc_feature (1)..( 11): Result.006 file - promoters50/4772340
ctatatatata

SEQ ID NO: 192745 - DNA, 11 bp, Unknown
  misc_feature (1)..( 11): Result.006 file - promoters50/4772340
aattaatgttt

SEQ ID NO: 192746 - DNA, 11 bp, Unknown
  misc_feature (1)..( 11): Result.006 file - promoters50/4772340
aatcaatcttt

SEQ ID NO: 192747 - DNA, 11 bp, Unknown
  misc_feature (1)..( 11): Result.006 file - promoters50/4772340
cattaatatga

SEQ ID NO: 192748 - DNA, 11 bp, Unknown
  misc_feature (1)..( 11): Result.006 file - promoters50/4772340
tattaattgcg

SEQ ID NO: 192749 - DNA, 11 bp, Unknown
  misc_feature (1)..( 11): Result.006 file - promoters50/4772340
catttattttt

SEQ ID NO: 192750 - DNA, 11 bp, Unknown
  misc_feature (1)..( 11): Result.006 file - promoters50/4772346
gatctatcatt

SEQ ID NO: 192751 - DNA, 10 bp, Unknown
  misc_feature (1)..( 10): Result.006 file - promoters50/4772346
agatacttaa

SEQ ID NO: 192752 - DNA, 11 bp, Unknown
  misc_feature (1)..( 11): Result.006 file - promoters50/4772346
tagatacagtg

SEQ ID NO: 192753 - DNA, 11 bp, Unknown
  misc_feature (1)..( 11): Result.006 file - promoters50/4772346
ccgatccagaa

SEQ ID NO: 192754 - DNA, 11 bp, Unknown
  misc_feature (1)..( 11): Result.006 file - promoters50/4772346
cagagacatca

SEQ ID NO: 192755 - DNA, 11 bp, Unknown
  misc_feature (1)..( 11): Result.006 file - promoters50/4772346
cagcgacttca

SEQ ID NO: 192756 - DNA, 11 bp, Unknown
  misc_feature (1)..( 11): Result.006 file - promoters50/4772370
gagatatcgta

SEQ ID NO: 192757 - DNA, 12 bp, Unknown
  misc_feature (1)..( 12): Result.006 file - promoters50/4772370
atggaatagatc

SEQ ID NO: 192758 - DNA, 12 bp, Unknown
  misc_feature (1)..( 12): Result.006 file - promoters50/4772370
atgtaatgacac

SEQ ID NO: 192759 - DNA, 12 bp, Unknown
  misc_feature (1)..( 12): Result.006 file - promoters50/4772370
aagtaataacac

SEQ ID NO: 192760 - DNA, 11 bp, Unknown
  misc_feature (1)..( 11): Result.006 file - promoters50/4772370
aaaaaaaagag

SEQ ID NO: 192761 - DNA, 11 bp, Unknown
  misc_feature (1)..( 11): Result.006 file - promoters50/4772370
aaaaaagggtc

SEQ ID NO: 192762 - DNA, 12 bp, Unknown
  misc_feature (1)..( 12): Result.006 file - promoters50/4772370
aaaagaaacaaa

SEQ ID NO: 192763 - DNA, 7 bp, Unknown
  misc_feature (1)..( 7): Result.006 file - promoters50/4772370
attaaaa

SEQ ID NO: 192764 - DNA, 7 bp, Unknown
  misc_feature (1)..( 7): Result.006 file - promoters50/4772370
attaaaa

SEQ ID NO: 192765 - DNA, 8 bp, Unknown
  misc_feature (1)..( 8): Result.006 file - promoters50/4772370
attgaaaa

SEQ ID NO: 192766 - DNA, 8 bp, Unknown
  misc_feature (1)..( 8): Result.006 file - promoters50/4772370
tataaaag

SEQ ID NO: 192767 - DNA, 8 bp, Unknown
  misc_feature (1)..( 8): Result.006 file - promoters50/4772370
tataaaaa

SEQ ID NO: 192768 - DNA, 8 bp, Unknown
  misc_feature (1)..( 8): Result.006 file - promoters50/4772378
attaaaaa

SEQ ID NO: 192769 - DNA, 14 bp, Unknown
  misc_feature (1)..( 14): Result.006 file - promoters50/4772378
aggtttgagttatt

SEQ ID NO: 192770 - DNA, 14 bp, Unknown
  misc_feature (1)..( 14): Result.006 file - promoters50/4772378
gggtttgggcgagg

SEQ ID NO: 192771 - DNA, 14 bp, Unknown
  misc_feature (1)..( 14): Result.006 file - promoters50/4772378
tagttttaaggtta

SEQ ID NO: 192772 - DNA, 14 bp, Unknown
  misc_feature (1)..( 14): Result.006 file - promoters50/4772378
ttgtttgaaaagtc

SEQ ID NO: 192773 - DNA, 14 bp, Unknown
  misc_feature (1)..( 14): Result.006 file - promoters50/4772378
atatttgaatagtc

SEQ ID NO: 192774 - DNA, 14 bp, Unknown
  misc_feature (1)..( 14): Result.006 file - promoters50/4772382
acgttttagaggca

SEQ ID NO: 192775 - DNA, 9 bp, Unknown
  misc_feature (1)..( 9): Result.006 file - promoters50/4772382
atatataaa

SEQ ID NO: 192776 - DNA, 9 bp, Unknown
  misc_feature (1)..( 9): Result.006 file - promoters50/4772382
ccttataaa

SEQ ID NO: 192777 - DNA, 9 bp, Unknown
  misc_feature (1)..( 9): Result.006 file - promoters50/4772382
ttatttaag

SEQ ID NO: 192778 - DNA, 9 bp, Unknown
  misc_feature (1)..( 9): Result.006 file - promoters50/4772382
ccatataaa

SEQ ID NO: 192779 - DNA, 9 bp, Unknown
  misc_feature (1)..( 9): Result.006 file - promoters50/4772382
ccttttaaa

SEQ ID NO: 192780 - DNA, 9 bp, Unknown
  misc_feature (1)..( 9): Result.006 file - promoters50/4772382
ctatatata

SEQ ID NO: 192781 - DNA, 9 bp, Unknown
  misc_feature (1)..( 9): Result.006 file - promoters50/4772382
gtatatata

SEQ ID NO: 192782 - DNA, 10 bp, Unknown
  misc_feature (1)..( 10): Result.006 file - promoters50/4772382
caaatctaac

SEQ ID NO: 192783 - DNA, 10 bp, Unknown
  misc_feature (1)..( 10): Result.006 file - promoters50/4772382
aacatctaaa

SEQ ID NO: 192784 - DNA, 10 bp, Unknown
  misc_feature (1)..( 10): Result.006 file - promoters50/4772382
gaaatctatt

SEQ ID NO: 192785 - DNA, 10 bp, Unknown
  misc_feature (1)..( 10): Result.006 file - promoters50/4772382
gaaatcccat

SEQ ID NO: 192786 - DNA, 10 bp, Unknown
  misc_feature (1)..( 10): Result.006 file - promoters50/4772382
gtcatataat

SEQ ID NO: 192787 - DNA, 10 bp, Unknown
  misc_feature (1)..( 10): Result.006 file - promoters50/4772382
gacgtataat

SEQ ID NO: 192788 - DNA, 10 bp, Unknown
  misc_feature (1)..( 10): Result.006 file - promoters50/4772382
tatataaaga

SEQ ID NO: 192789 - DNA, 10 bp, Unknown
  misc_feature (1)..( 10): Result.006 file - promoters50/4772382
tatatatatt

SEQ ID NO: 192790 - DNA, 10 bp, Unknown
  misc_feature (1)..( 10): Result.006 file - promoters50/4772382
tatatatata

SEQ ID NO: 192791 - DNA, 10 bp, Unknown
  misc_feature (1)..( 10): Result.006 file - promoters50/4772382
tatttaagaa

SEQ ID NO: 192792 - DNA, 10 bp, Unknown
  misc_feature (1)..( 10): Result.006 file - promoters50/4772382
catataaata

SEQ ID NO: 192793 - DNA, 10 bp, Unknown
  misc_feature (1)..( 10): Result.006 file - promoters50/4772389
cttataaata

SEQ ID NO: 192794 - DNA, 11 bp, Unknown
  misc_feature (1)..( 11): Result.006 file - promoters50/4772389
gcaaagattac

SEQ ID NO: 192795 - DNA, 11 bp, Unknown
  misc_feature (1)..( 11): Result.006 file - promoters50/4772389
ttaaaaattaa

SEQ ID NO: 192796 - DNA, 11 bp, Unknown
  misc_feature (1)..( 11): Result.006 file - promoters50/4772389
gcaaaaattat

SEQ ID NO: 192797 - DNA, 11 bp, Unknown
  misc_feature (1)..( 11): Result.006 file - promoters50/4772389
aataaagttaa

SEQ ID NO: 192798 - DNA, 11 bp, Unknown
  misc_feature (1)..( 11): Result.006 file - promoters50/4772389
cgtaaaatttt

SEQ ID NO: 192799 - DNA, 11 bp, Unknown
  misc_feature (1)..( 11): Result.006 file - promoters50/4772389
tcaaaaaactt

SEQ ID NO: 192800 - DNA, 11 bp, Unknown
  misc_feature (1)..( 11): Result.006 file - promoters50/4772389
tggaaacttta

SEQ ID NO: 192801 - DNA, 10 bp, Unknown
  misc_feature (1)..( 10): Result.006 file - promoters50/4772389
aaatattaat

SEQ ID NO: 192802 - DNA, 10 bp, Unknown
  misc_feature (1)..( 10): Result.006 file - promoters50/4772389
taatatttag

SEQ ID NO: 192803 - DNA, 10 bp, Unknown
  misc_feature (1)..( 10): Result.006 file - promoters50/4772389
aaatataagt

SEQ ID NO: 192804 - DNA, 10 bp, Unknown
  misc_feature (1)..( 10): Result.006 file - promoters50/4772389
aaatatgtta

SEQ ID NO: 192805 - DNA, 10 bp, Unknown
  misc_feature (1)..( 10): Result.006 file - promoters50/4772389
gaatttttag

SEQ ID NO: 192806 - DNA, 10 bp, Unknown
  misc_feature (1)..( 10): Result.006 file - promoters50/4772389
ctttattata

SEQ ID NO: 192807 - DNA, 10 bp, Unknown
  misc_feature (1)..( 10): Result.006 file - promoters50/4772389
tattttttta

SEQ ID NO: 192808 - DNA, 12 bp, Unknown
  misc_feature (1)..( 12): Result.006 file - promoters50/4772389
taattaaattaa

SEQ ID NO: 192809 - DNA, 12 bp, Unknown
  misc_feature (1)..( 12): Result.006 file - promoters50/4772389
caataaaattaa

SEQ ID NO: 192810 - DNA, 12 bp, Unknown
  misc_feature (1)..( 12): Result.006 file - promoters50/4772389
tgattaaatatg

SEQ ID NO: 192811 - DNA, 12 bp, Unknown
  misc_feature (1)..( 12): Result.006 file - promoters50/4772389
aaataaagtaat

SEQ ID NO: 192812 - DNA, 12 bp, Unknown
  misc_feature (1)..( 12): Result.006 file - promoters50/4772389
tttttaaattag

SEQ ID NO: 192813 - DNA, 12 bp, Unknown
  misc_feature (1)..( 12): Result.006 file - promoters50/4772389
caaaaaacttta

SEQ ID NO: 192814 - DNA, 12 bp, Unknown
  misc_feature (1)..( 12): Result.006 file - promoters50/4772389
caaaaattatta

SEQ ID NO: 192815 - DNA, 12 bp, Unknown
  misc_feature (1)..( 12): Result.006 file - promoters50/4772389
ataaaaagtttt

SEQ ID NO: 192816 - DNA, 12 bp, Unknown
  misc_feature (1)..( 12): Result.006 file - promoters50/4772389
taatagagtttt

SEQ ID NO: 192817 - DNA, 12 bp, Unknown
  misc_feature (1)..( 12): Result.006 file - promoters50/4772389
acaaaaactttt

SEQ ID NO: 192818 - DNA, 12 bp, Unknown
  misc_feature (1)..( 12): Result.006 file - promoters50/4772389
gttgaaaattta

SEQ ID NO: 192819 - DNA, 12 bp, Unknown
  misc_feature (1)..( 12): Result.006 file - promoters50/4772389
acaaaaataaac

SEQ ID NO: 192820 - DNA, 12 bp, Unknown
  misc_feature (1)..( 12): Result.006 file - promoters50/4772389
acaaaaagtgaa

SEQ ID NO: 192821 - DNA, 10 bp, Unknown
  misc_feature (1)..( 10): Result.006 file - promoters50/4772389
gaaaaacaaa

SEQ ID NO: 192822 - DNA, 10 bp, Unknown
  misc_feature (1)..( 10): Result.006 file - promoters50/4772389
gctcaacaaa

SEQ ID NO: 192823 - DNA, 10 bp, Unknown
  misc_feature (1)..( 10): Result.006 file - promoters50/4772389
gaaaaagaaa

SEQ ID NO: 192824 - DNA, 10 bp, Unknown
  misc_feature (1)..( 10): Result.006 file - promoters50/4772389
ataaaggaaa

SEQ ID NO: 192825 - DNA, 10 bp, Unknown
  misc_feature (1)..( 10): Result.006 file - promoters50/4772389
aaaaaagaag

SEQ ID NO: 192826 - DNA, 10 bp, Unknown
  misc_feature (1)..( 10): Result.006 file - promoters50/4772389
taatgacaaa

SEQ ID NO: 192827 - DNA, 11 bp, Unknown
  misc_feature (1)..( 11): Result.006 file - promoters50/4772389
aaaatttatcc

SEQ ID NO: 192828 - DNA, 11 bp, Unknown
  misc_feature (1)..( 11): Result.006 file - promoters50/4772389
taaattttgag

SEQ ID NO: 192829 - DNA, 11 bp, Unknown
  misc_feature (1)..( 11): Result.006 file - promoters50/4772389
aaagtttattg

SEQ ID NO: 192830 - DNA, 11 bp, Unknown
  misc_feature (1)..( 11): Result.006 file - promoters50/4772389
aaagtttatta

SEQ ID NO: 192831 - DNA, 11 bp, Unknown
  misc_feature (1)..( 11): Result.006 file - promoters50/4772389
aaaatttttgt

SEQ ID NO: 192832 - DNA, 11 bp, Unknown
  misc_feature (1)..( 11): Result.006 file - promoters50/4772389
attctttttta

SEQ ID NO: 192833 - DNA, 12 bp, Unknown
  misc_feature (1)..( 12): Result.006 file - promoters50/4772389
ttaagaacttta

SEQ ID NO: 192834 - DNA, 12 bp, Unknown
  misc_feature (1)..( 12): Result.006 file - promoters50/4772389
aagttaactttg

SEQ ID NO: 192835 - DNA, 12 bp, Unknown
  misc_feature (1)..( 12): Result.006 file - promoters50/4772389
tgttgaattttt

SEQ ID NO: 192836 - DNA, 12 bp, Unknown
  misc_feature (1)..( 12): Result.006 file - promoters50/4772389
ctggaaacttta

SEQ ID NO: 192837 - DNA, 12 bp, Unknown
  misc_feature (1)..( 12): Result.006 file - promoters50/4772389
ttaagatcttgt

SEQ ID NO: 192838 - DNA, 12 bp, Unknown
  misc_feature (1)..( 12): Result.006 file - promoters50/4772389
tgttgagtttcg

SEQ ID NO: 192839 - DNA, 11 bp, Unknown
  misc_feature (1)..( 11): Result.006 file - promoters50/4772389
atattaataat

SEQ ID NO: 192840 - DNA, 11 bp, Unknown
  misc_feature (1)..( 11): Result.006 file - promoters50/4772389
aaagtaataat

SEQ ID NO: 192841 - DNA, 11 bp, Unknown
  misc_feature (1)..( 11): Result.006 file - promoters50/4772389
aaattaatatt

SEQ ID NO: 192842 - DNA, 11 bp, Unknown
  misc_feature (1)..( 11): Result.006 file - promoters50/4772389
aaattagagtt

SEQ ID NO: 192843 - DNA, 11 bp, Unknown
  misc_feature (1)..( 11): Result.006 file - promoters50/4772389
actttattata

SEQ ID NO: 192844 - DNA, 11 bp, Unknown
  misc_feature (1)..( 11): Result.006 file - promoters50/4772389
ggagtactaat

SEQ ID NO: 192845 - DNA, 11 bp, Unknown
  misc_feature (1)..( 11): Result.006 file - promoters50/4772389
aatttattgtt

SEQ ID NO: 192846 - DNA, 11 bp, Unknown
  misc_feature (1)..( 11): Result.006 file - promoters50/4772389
gttaaaaaata

SEQ ID NO: 192847 - DNA, 11 bp, Unknown
  misc_feature (1)..( 11): Result.006 file - promoters50/4772389
attaacaaact

SEQ ID NO: 192848 - DNA, 11 bp, Unknown
  misc_feature (1)..( 11): Result.006 file - promoters50/4772389
aagaaaatata

SEQ ID NO: 192849 - DNA, 11 bp, Unknown
  misc_feature (1)..( 11): Result.006 file - promoters50/4772389
tttaaaatcgt

SEQ ID NO: 192850 - DNA, 11 bp, Unknown
  misc_feature (1)..( 11): Result.006 file - promoters50/4772389
gttaaaccaaa

SEQ ID NO: 192851 - DNA, 11 bp, Unknown
  misc_feature (1)..( 11): Result.006 file - promoters50/4772389
aatagagaatt

SEQ ID NO: 192852 - DNA, 9 bp, Unknown
  misc_feature (1)..( 9): Result.006 file - promoters50/4772389
acaaaaaaa

SEQ ID NO: 192853 - DNA, 9 bp, Unknown
  misc_feature (1)..( 9): Result.006 file - promoters50/4772389
taaaaaaaa

SEQ ID NO: 192854 - DNA, 9 bp, Unknown
  misc_feature (1)..( 9): Result.006 file - promoters50/4772389
aaaaataaa

SEQ ID NO: 192855 - DNA, 9 bp, Unknown
  misc_feature (1)..( 9): Result.006 file - promoters50/4772389
acaaaaaag

SEQ ID NO: 192856 - DNA, 9 bp, Unknown
  misc_feature (1)..( 9): Result.006 file - promoters50/4772389
acaaataaa

SEQ ID NO: 192857 - DNA, 9 bp, Unknown
  misc_feature (1)..( 9): Result.006 file - promoters50/4772389
gtaaataat

SEQ ID NO: 192858 - DNA, 9 bp, Unknown
  misc_feature (1)..( 9): Result.006 file - promoters50/4772398
ttaaacata

SEQ ID NO: 192859 - DNA, 12 bp, Unknown
  misc_feature (1)..( 12): Result.006 file - promoters50/4772398
aagaattttttt

SEQ ID NO: 192860 - DNA, 12 bp, Unknown
  misc_feature (1)..( 12): Result.006 file - promoters50/4772398
tataattttata

SEQ ID NO: 192861 - DNA, 12 bp, Unknown
  misc_feature (1)..( 12): Result.006 file - promoters50/4772398
aagactttggct

SEQ ID NO: 192862 - DNA, 12 bp, Unknown
  misc_feature (1)..( 12): Result.006 file - promoters50/4772398
tccaatttattt

SEQ ID NO: 192863 - DNA, 12 bp, Unknown
  misc_feature (1)..( 12): Result.006 file - promoters50/4772398
cctaagtttaag

SEQ ID NO: 192864 - DNA, 12 bp, Unknown
  misc_feature (1)..( 12): Result.006 file - promoters50/4772402
taaaagtttgtt

SEQ ID NO: 192865 - DNA, 14 bp, Unknown
  misc_feature (1)..( 14): Result.006 file - promoters50/4772402
atgtataaaatcga

SEQ ID NO: 192866 - DNA, 14 bp, Unknown
  misc_feature (1)..( 14): Result.006 file - promoters50/4772402
cactataaacaaac

SEQ ID NO: 192867 - DNA, 14 bp, Unknown
  misc_feature (1)..( 14): Result.006 file - promoters50/4772402
atgtataaaaacac

SEQ ID NO: 192868 - DNA, 14 bp, Unknown
  misc_feature (1)..( 14): Result.006 file - promoters50/4772402
ctttatatacacat

SEQ ID NO: 192869 - DNA, 14 bp, Unknown
  misc_feature (1)..( 14): Result.006 file - promoters50/4772402
ttgaataaacaaac

SEQ ID NO: 192870 - DNA, 14 bp, Unknown
  misc_feature (1)..( 14): Result.006 file - promoters50/4772410
tcttataaataatc

SEQ ID NO: 192871 - DNA, 12 bp, Unknown
  misc_feature (1)..( 12): Result.006 file - promoters50/4772410
tatttttgattc

SEQ ID NO: 192872 - DNA, 12 bp, Unknown
  misc_feature (1)..( 12): Result.006 file - promoters50/4772410
cgaatttgattt

SEQ ID NO: 192873 - DNA, 12 bp, Unknown
  misc_feature (1)..( 12): Result.006 file - promoters50/4772410
cattcatgattc

SEQ ID NO: 192874 - DNA, 12 bp, Unknown
  misc_feature (1)..( 12): Result.006 file - promoters50/4772410
tatgtttgatac

SEQ ID NO: 192875 - DNA, 12 bp, Unknown
  misc_feature (1)..( 12): Result.006 file - promoters50/4772410
tacacctgattc

SEQ ID NO: 192876 - DNA, 12 bp, Unknown
  misc_feature (1)..( 12): Result.006 file - promoters50/4772410
ttgttttgaatg

SEQ ID NO: 192877 - DNA, 12 bp, Unknown
  misc_feature (1)..( 12): Result.006 file - promoters50/4772410
aatggttggttg

SEQ ID NO: 192878 - DNA, 10 bp, Unknown
  misc_feature (1)..( 10): Result.006 file - promoters50/4772410
tatttttgat

SEQ ID NO: 192879 - DNA, 10 bp, Unknown
  misc_feature (1)..( 10): Result.006 file - promoters50/4772410
tatatttgtg

SEQ ID NO: 192880 - DNA, 10 bp, Unknown
  misc_feature (1)..( 10): Result.006 file - promoters50/4772410
tatgtttgat

SEQ ID NO: 192881 - DNA, 10 bp, Unknown
  misc_feature (1)..( 10): Result.006 file - promoters50/4772410
tctgtttggt

SEQ ID NO: 192882 - DNA, 10 bp, Unknown
  misc_feature (1)..( 10): Result.006 file - promoters50/4772410
ttgttttgaa

SEQ ID NO: 192883 - DNA, 10 bp, Unknown
  misc_feature (1)..( 10): Result.006 file - promoters50/4772410
ttcatttgta

SEQ ID NO: 192884 - DNA, 10 bp, Unknown
  misc_feature (1)..( 10): Result.006 file - promoters50/4772410
catgttttcc

SEQ ID NO: 192885 - DNA, 11 bp, Unknown
  misc_feature (1)..( 11): Result.006 file - promoters50/4772410
caatacacaaa

SEQ ID NO: 192886 - DNA, 11 bp, Unknown
  misc_feature (1)..( 11): Result.006 file - promoters50/4772410
caaaacacgag

SEQ ID NO: 192887 - DNA, 11 bp, Unknown
  misc_feature (1)..( 11): Result.006 file - promoters50/4772410
ttatacgcaaa

SEQ ID NO: 192888 - DNA, 11 bp, Unknown
  misc_feature (1)..( 11): Result.006 file - promoters50/4772410
atttacacaca

SEQ ID NO: 192889 - DNA, 11 bp, Unknown
  misc_feature (1)..( 11): Result.006 file - promoters50/4772410
gaaaacaaatc

SEQ ID NO: 192890 - DNA, 11 bp, Unknown
  misc_feature (1)..( 11): Result.006 file - promoters50/4772410
taaaaccaagc

SEQ ID NO: 192891 - DNA, 8 bp, Unknown
  misc_feature (1)..( 8): Result.006 file - promoters50/4772410
aaaataaa

SEQ ID NO: 192892 - DNA, 8 bp, Unknown
  misc_feature (1)..( 8): Result.006 file - promoters50/4772410
caaataac

SEQ ID NO: 192893 - DNA, 8 bp, Unknown
  misc_feature (1)..( 8): Result.006 file - promoters50/4772410
aaaacaaa

SEQ ID NO: 192894 - DNA, 8 bp, Unknown
  misc_feature (1)..( 8): Result.006 file - promoters50/4772410
aaaataag

SEQ ID NO: 192895 - DNA, 8 bp, Unknown
  misc_feature (1)..( 8): Result.006 file - promoters50/4772410
aaaacacg

SEQ ID NO: 192896 - DNA, 8 bp, Unknown
  misc_feature (1)..( 8): Result.006 file - promoters50/4772413
aaaccaag

SEQ ID NO: 192897 - DNA, 13 bp, Unknown
  misc_feature (1)..( 13): Result.006 file - promoters50/4772413
taaaaattttgtt

SEQ ID NO: 192898 - DNA, 13 bp, Unknown
  misc_feature (1)..( 13): Result.006 file - promoters50/4772413
gaaagatttgtgg

SEQ ID NO: 192899 - DNA, 13 bp, Unknown
  misc_feature (1)..( 13): Result.006 file - promoters50/4772413
caacaattttgtt

SEQ ID NO: 192900 - DNA, 13 bp, Unknown
  misc_feature (1)..( 13): Result.006 file - promoters50/4772413
gaaggatcagtaa

SEQ ID NO: 192901 - DNA, 10 bp, Unknown
  misc_feature (1)..( 10): Result.006 file - promoters50/4772413
ttaataaatt

SEQ ID NO: 192902 - DNA, 10 bp, Unknown
  misc_feature (1)..( 10): Result.006 file - promoters50/4772413
ttattaaatt

SEQ ID NO: 192903 - DNA, 10 bp, Unknown
  misc_feature (1)..( 10): Result.006 file - promoters50/4772413
ttatgaatct

SEQ ID NO: 192904 - DNA, 10 bp, Unknown
  misc_feature (1)..( 10): Result.006 file - promoters50/4772420
aaaatcaatc

SEQ ID NO: 192905 - DNA, 9 bp, Unknown
  misc_feature (1)..( 9): Result.006 file - promoters50/4772420
ctaatgaac

SEQ ID NO: 192906 - DNA, 9 bp, Unknown
  misc_feature (1)..( 9): Result.006 file - promoters50/4772420
agaatcaac

SEQ ID NO: 192907 - DNA, 9 bp, Unknown
  misc_feature (1)..( 9): Result.006 file - promoters50/4772472
agagtcatc

SEQ ID NO: 192908 - DNA, 9 bp, Unknown
  misc_feature (1)..( 9): Result.006 file - promoters50/4772472
gctgaaaaa

SEQ ID NO: 192909 - DNA, 9 bp, Unknown
  misc_feature (1)..( 9): Result.006 file - promoters50/4772472
ttagaaaaa

SEQ ID NO: 192910 - DNA, 9 bp, Unknown
  misc_feature (1)..( 9): Result.006 file - promoters50/4772472
tatgaaaac

SEQ ID NO: 192911 - DNA, 9 bp, Unknown
  misc_feature (1)..( 9): Result.006 file - promoters50/4772472
tttacaaaa

SEQ ID NO: 192912 - DNA, 9 bp, Unknown
  misc_feature (1)..( 9): Result.006 file - promoters50/4772472
atacactta

SEQ ID NO: 192913 - DNA, 9 bp, Unknown
  misc_feature (1)..( 9): Result.006 file - promoters50/4772472
gtacacttt

SEQ ID NO: 192914 - DNA, 9 bp, Unknown
  misc_feature (1)..( 9): Result.006 file - promoters50/4772472
gtacatttt

SEQ ID NO: 192915 - DNA, 10 bp, Unknown
  misc_feature (1)..( 10): Result.006 file - promoters50/4772472
atgaagatca

SEQ ID NO: 192916 - DNA, 10 bp, Unknown
  misc_feature (1)..( 10): Result.006 file - promoters50/4772472
caaaagatct

SEQ ID NO: 192917 - DNA, 10 bp, Unknown
  misc_feature (1)..( 10): Result.006 file - promoters50/4772472
cacaagatca

SEQ ID NO: 192918 - DNA, 10 bp, Unknown
  misc_feature (1)..( 10): Result.006 file - promoters50/4772472
cactagatat

SEQ ID NO: 192919 - DNA, 9 bp, Unknown
  misc_feature (1)..( 9): Result.006 file - promoters50/4772472
aaaacaaaa

SEQ ID NO: 192920 - DNA, 9 bp, Unknown
  misc_feature (1)..( 9): Result.006 file - promoters50/4772472
gaaacaaaa

SEQ ID NO: 192921 - DNA, 10 bp, Unknown
  misc_feature (1)..( 10): Result.006 file - promoters50/4772472
aaaatcaact

SEQ ID NO: 192922 - DNA, 8 bp, Unknown
  misc_feature (1)..( 8): Result.006 file - promoters50/4772472
aaagtaaa

SEQ ID NO: 192923 - DNA, 8 bp, Unknown
  misc_feature (1)..( 8): Result.006 file - promoters50/4772472
aaactaaa

SEQ ID NO: 192924 - DNA, 8 bp, Unknown
  misc_feature (1)..( 8): Result.006 file - promoters50/4772472
aaaataac

SEQ ID NO: 192925 - DNA, 8 bp, Unknown
  misc_feature (1)..( 8): Result.006 file - promoters50/4772472
tacaagag

SEQ ID NO: 192926 - DNA, 8 bp, Unknown
  misc_feature (1)..( 8): Result.006 file - promoters50/4772472
cacaagat

SEQ ID NO: 192927 - DNA, 8 bp, Unknown
  misc_feature (1)..( 8): Result.006 file - promoters50/4772472
cactagat

SEQ ID NO: 192928 - DNA, 7 bp, Unknown
  misc_feature (1)..( 7): Result.006 file - promoters50/4772472
aaaatta

SEQ ID NO: 192929 - DNA, 7 bp, Unknown
  misc_feature (1)..( 7): Result.006 file - promoters50/4772472
caaatta

SEQ ID NO: 192930 - DNA, 7 bp, Unknown
  misc_feature (1)..( 7): Result.006 file - promoters50/4772472
caaatta

SEQ ID NO: 192931 - DNA, 9 bp, Unknown
  misc_feature (1)..( 9): Result.006 file - promoters50/4772472
attttgtag

SEQ ID NO: 192932 - DNA, 9 bp, Unknown
  misc_feature (1)..( 9): Result.006 file - promoters50/4772472
attttgtac

SEQ ID NO: 192933 - DNA, 9 bp, Unknown
  misc_feature (1)..( 9): Result.006 file - promoters50/4772472
gctttctag

SEQ ID NO: 192934 - DNA, 8 bp, Unknown
  misc_feature (1)..( 8): Result.006 file - promoters50/4772472
atcttaag

SEQ ID NO: 192935 - DNA, 8 bp, Unknown
  misc_feature (1)..( 8): Result.006 file - promoters50/4772472
atcttaca

SEQ ID NO: 192936 - DNA, 8 bp, Unknown
  misc_feature (1)..( 8): Result.006 file - promoters50/4772472
ctctaaca

SEQ ID NO: 192937 - DNA, 10 bp, Unknown
  misc_feature (1)..( 10): Result.006 file - promoters50/4772472
ttatttaaaa

SEQ ID NO: 192938 - DNA, 10 bp, Unknown
  misc_feature (1)..( 10): Result.006 file - promoters50/4772472
ttagttacag

SEQ ID NO: 192939 - DNA, 10 bp, Unknown
  misc_feature (1)..( 10): Result.006 file - promoters50/4772700
acatttaaaa

SEQ ID NO: 192940 - DNA, 15 bp, Unknown
  misc_feature (1)..( 15): Result.006 file - promoters50/4772700
gccgttcttattgtt

SEQ ID NO: 192941 - DNA, 15 bp, Unknown
  misc_feature (1)..( 15): Result.006 file - promoters50/4772700
tccattcttattttg

SEQ ID NO: 192942 - DNA, 15 bp, Unknown
  misc_feature (1)..( 15): Result.006 file - promoters50/4772700
tccactcttttccta

SEQ ID NO: 192943 - DNA, 15 bp, Unknown
  misc_feature (1)..( 15): Result.006 file - promoters50/4772700
acatcttttatttta

SEQ ID NO: 192944 - DNA, 15 bp, Unknown
  misc_feature (1)..( 15): Result.006 file - promoters50/4772700
cgttggcttctattt

SEQ ID NO: 192945 - DNA, 15 bp, Unknown
  misc_feature (1)..( 15): Result.006 file - promoters50/4772710
aattagtatattttc

SEQ ID NO: 192946 - DNA, 10 bp, Unknown
  misc_feature (1)..( 10): Result.006 file - promoters50/4772710
tattttgctt

SEQ ID NO: 192947 - DNA, 10 bp, Unknown
  misc_feature (1)..( 10): Result.006 file - promoters50/4772710
gcgttttctt

SEQ ID NO: 192948 - DNA, 10 bp, Unknown
  misc_feature (1)..( 10): Result.006 file - promoters50/4772710
ttctttgctc

SEQ ID NO: 192949 - DNA, 10 bp, Unknown
  misc_feature (1)..( 10): Result.006 file - promoters50/4772710
tatgttgcaa

SEQ ID NO: 192950 - DNA, 10 bp, Unknown
  misc_feature (1)..( 10): Result.006 file - promoters50/4772710
tatattgagg

SEQ ID NO: 192951 - DNA, 9 bp, Unknown
  misc_feature (1)..( 9): Result.006 file - promoters50/4772710
ttattttgc

SEQ ID NO: 192952 - DNA, 9 bp, Unknown
  misc_feature (1)..( 9): Result.006 file - promoters50/4772710
ttaatttat

SEQ ID NO: 192953 - DNA, 9 bp, Unknown
  misc_feature (1)..( 9): Result.006 file - promoters50/4772710
gtatattga

SEQ ID NO: 192954 - DNA, 9 bp, Unknown
  misc_feature (1)..( 9): Result.006 file - promoters50/4772710
ctatgttgc

SEQ ID NO: 192955 - DNA, 8 bp, Unknown
  misc_feature (1)..( 8): Result.006 file - promoters50/4772710
taataaaa

SEQ ID NO: 192956 - DNA, 8 bp, Unknown
  misc_feature (1)..( 8): Result.006 file - promoters50/4772710
gaatcaaa

SEQ ID NO: 192957 - DNA, 8 bp, Unknown
  misc_feature (1)..( 8): Result.006 file - promoters50/4772710
gaatcaca

SEQ ID NO: 192958 - DNA, 8 bp, Unknown
  misc_feature (1)..( 8): Result.006 file - promoters50/4772720
gaagcacc

SEQ ID NO: 192959 - DNA, 8 bp, Unknown
  misc_feature (1)..( 8): Result.006 file - promoters50/4772720
aattaaac

SEQ ID NO: 192960 - DNA, 8 bp, Unknown
  misc_feature (1)..( 8): Result.006 file - promoters50/4772720
aattaatg

SEQ ID NO: 192961 - DNA, 8 bp, Unknown
  misc_feature (1)..( 8): Result.006 file - promoters50/4772720
aattgatg

SEQ ID NO: 192962 - DNA, 7 bp, Unknown
  misc_feature (1)..( 7): Result.006 file - promoters50/4772720
gaatcag

SEQ ID NO: 192963 - DNA, 7 bp, Unknown
  misc_feature (1)..( 7): Result.006 file - promoters50/4772720
gaatcaa

SEQ ID NO: 192964 - DNA, 7 bp, Unknown
  misc_feature (1)..( 7): Result.006 file - promoters50/4772720
gaaacaa

SEQ ID NO: 192965 - DNA, 7 bp, Unknown
  misc_feature (1)..( 7): Result.006 file - promoters50/4772720
aaaacaa

SEQ ID NO: 192966 - DNA, 7 bp, Unknown
  misc_feature (1)..( 7): Result.006 file - promoters50/4772720
gaaacaa

SEQ ID NO: 192967 - DNA, 7 bp, Unknown
  misc_feature (1)..( 7): Result.006 file - promoters50/4772724
gaatcaa

SEQ ID NO: 192968 - DNA, 7 bp, Unknown
  misc_feature (1)..( 7): Result.006 file - promoters50/4772724
atgtgga

SEQ ID NO: 192969 - DNA, 7 bp, Unknown
  misc_feature (1)..( 7): Result.006 file - promoters50/4772724
atgagga

SEQ ID NO: 192970 - DNA, 7 bp, Unknown
  misc_feature (1)..( 7): Result.006 file - promoters50/4772735
atgtggt

SEQ ID NO: 192971 - DNA, 10 bp, Unknown
  misc_feature (1)..( 10): Result.006 file - promoters50/4772735
tctttgtaat

SEQ ID NO: 192972 - DNA, 10 bp, Unknown
  misc_feature (1)..( 10): Result.006 file - promoters50/4772735
tctttttaaa

SEQ ID NO: 192973 - DNA, 10 bp, Unknown
  misc_feature (1)..( 10): Result.006 file - promoters50/4772735
aaattgtaat

SEQ ID NO: 192974 - DNA, 8 bp, Unknown
  misc_feature (1)..( 8): Result.006 file - promoters50/4772735
aatcataa

SEQ ID NO: 192975 - DNA, 8 bp, Unknown
  misc_feature (1)..( 8): Result.006 file - promoters50/4772735
aatcattt

SEQ ID NO: 192976 - DNA, 8 bp, Unknown
  misc_feature (1)..( 8): Result.006 file - promoters50/4772735
catcataa

SEQ ID NO: 192977 - DNA, 9 bp, Unknown
  misc_feature (1)..( 9): Result.006 file - promoters50/4772735
attttatct

SEQ ID NO: 192978 - DNA, 9 bp, Unknown
  misc_feature (1)..( 9): Result.006 file - promoters50/4772735
tctttttct

SEQ ID NO: 192979 - DNA, 9 bp, Unknown
  misc_feature (1)..( 9): Result.006 file - promoters50/4772735
tatttatgt

SEQ ID NO: 192980 - DNA, 7 bp, Unknown
  misc_feature (1)..( 7): Result.006 file - promoters50/4772735
taaatcg

SEQ ID NO: 192981 - DNA, 7 bp, Unknown
  misc_feature (1)..( 7): Result.006 file - promoters50/4772735
taaatca

SEQ ID NO: 192982 - DNA, 7 bp, Unknown
  misc_feature (1)..( 7): Result.006 file - promoters50/4772743
taattca

SEQ ID NO: 192983 - DNA, 7 bp, Unknown
  misc_feature (1)..( 7): Result.006 file - promoters50/4772743
aattttt

SEQ ID NO: 192984 - DNA, 7 bp, Unknown
  misc_feature (1)..( 7): Result.006 file - promoters50/4772743
tattttt

SEQ ID NO: 192985 - DNA, 7 bp, Unknown
  misc_feature (1)..( 7): Result.006 file - promoters50/4772743
gattttt

SEQ ID NO: 192986 - DNA, 7 bp, Unknown
  misc_feature (1)..( 7): Result.006 file - promoters50/4772743
aatttta

SEQ ID NO: 192987 - DNA, 8 bp, Unknown
  misc_feature (1)..( 8): Result.006 file - promoters50/4772743
aaaaatcg

SEQ ID NO: 192988 - DNA, 8 bp, Unknown
  misc_feature (1)..( 8): Result.006 file - promoters50/4772743
aaaaataa

SEQ ID NO: 192989 - DNA, 9 bp, Unknown
  misc_feature (1)..( 9): Result.006 file - promoters50/4772743
aaacaatct

SEQ ID NO: 192990 - DNA, 9 bp, Unknown
  misc_feature (1)..( 9): Result.006 file - promoters50/4772751
gtaaaataa

SEQ ID NO: 192991 - DNA, 10 bp, Unknown
  misc_feature (1)..( 10): Result.006 file - promoters50/4772751
gtaacataaa

SEQ ID NO: 192992 - DNA, 10 bp, Unknown
  misc_feature (1)..( 10): Result.006 file - promoters50/4772751
ttaaaataaa

SEQ ID NO: 192993 - DNA, 10 bp, Unknown
  misc_feature (1)..( 10): Result.006 file - promoters50/4772772
ttaaaaaatt

SEQ ID NO: 192994 - DNA, 11 bp, Unknown
  misc_feature (1)..( 11): Result.006 file - promoters50/4772772
acctttataaa

SEQ ID NO: 192995 - DNA, 11 bp, Unknown
  misc_feature (1)..( 11): Result.006 file - promoters50/4772772
gcctatatata

SEQ ID NO: 192996 - DNA, 11 bp, Unknown
  misc_feature (1)..( 11): Result.006 file - promoters50/4772772
acctttataaa

SEQ ID NO: 192997 - DNA, 11 bp, Unknown
  misc_feature (1)..( 11): Result.006 file - promoters50/4772772
gtatatatact

SEQ ID NO: 192998 - DNA, 11 bp, Unknown
  misc_feature (1)..( 11): Result.006 file - promoters50/4772772
gtatatatact

SEQ ID NO: 192999 - DNA, 11 bp, Unknown
  misc_feature (1)..( 11): Result.006 file - promoters50/4772772
atatatataac

SEQ ID NO: 193000 - DNA, 8 bp, Unknown
  misc_feature (1)..( 8): Result.006 file - promoters50/4772772
tgataaaa

SEQ ID NO: 193001 - DNA, 8 bp, Unknown
  misc_feature (1)..( 8): Result.006 file - promoters50/4772772
tgacaaaa

SEQ ID NO: 193002 - DNA, 8 bp, Unknown
  misc_feature (1)..( 8): Result.006 file - promoters50/4772772
gtacaaaa

SEQ ID NO: 193003 - DNA, 8 bp, Unknown
  misc_feature (1)..( 8): Result.006 file - promoters50/4772772
acacaaaa

SEQ ID NO: 193004 - DNA, 8 bp, Unknown
  misc_feature (1)..( 8): Result.006 file - promoters50/4772772
caacaaaa

SEQ ID NO: 193005 - DNA, 8 bp, Unknown
  misc_feature (1)..( 8): Result.006 file - promoters50/4772772
taacaaat

SEQ ID NO: 193006 - DNA, 10 bp, Unknown
  misc_feature (1)..( 10): Result.006 file - promoters50/4772772
ttcttatttt

SEQ ID NO: 193007 - DNA, 10 bp, Unknown
  misc_feature (1)..( 10): Result.006 file - promoters50/4772772
cttttatttt

SEQ ID NO: 193008 - DNA, 10 bp, Unknown
  misc_feature (1)..( 10): Result.006 file - promoters50/4772772
ttcttattgt

SEQ ID NO: 193009 - DNA, 10 bp, Unknown
  misc_feature (1)..( 10): Result.006 file - promoters50/4772772
tttttatttt

SEQ ID NO: 193010 - DNA, 11 bp, Unknown
  misc_feature (1)..( 11): Result.006 file - promoters50/4772772
ggcttctattt

SEQ ID NO: 193011 - DNA, 11 bp, Unknown
  misc_feature (1)..( 11): Result.006 file - promoters50/4772772
actttattata

SEQ ID NO: 193012 - DNA, 12 bp, Unknown
  misc_feature (1)..( 12): Result.006 file - promoters50/4772772
aatgatattcgt

SEQ ID NO: 193013 - DNA, 12 bp, Unknown
  misc_feature (1)..( 12): Result.006 file - promoters50/4772772
aataatataact

SEQ ID NO: 193014 - DNA, 12 bp, Unknown
  misc_feature (1)..( 12): Result.006 file - promoters50/4772772
tttgatatatac

SEQ ID NO: 193015 - DNA, 12 bp, Unknown
  misc_feature (1)..( 12): Result.006 file - promoters50/4772772
aatgttattttt

SEQ ID NO: 193016 - DNA, 12 bp, Unknown
  misc_feature (1)..( 12): Result.006 file - promoters50/4772772
taaaatatacaa

SEQ ID NO: 193017 - DNA, 12 bp, Unknown
  misc_feature (1)..( 12): Result.006 file - promoters50/4772824
gtgaatttaact

SEQ ID NO: 193018 - DNA, 7 bp, Unknown
  misc_feature (1)..( 7): Result.006 file - promoters50/4772824
tatattc

SEQ ID NO: 193019 - DNA, 7 bp, Unknown
  misc_feature (1)..( 7): Result.006 file - promoters50/4772824
tattttc

SEQ ID NO: 193020 - DNA, 7 bp, Unknown
  misc_feature (1)..( 7): Result.006 file - promoters50/4772824
gattttc

SEQ ID NO: 193021 - DNA, 11 bp, Unknown
  misc_feature (1)..( 11): Result.006 file - promoters50/4772824
atatgaagttt

SEQ ID NO: 193022 - DNA, 11 bp, Unknown
  misc_feature (1)..( 11): Result.006 file - promoters50/4772824
ggatgatgttt

SEQ ID NO: 193023 - DNA, 11 bp, Unknown
  misc_feature (1)..( 11): Result.006 file - promoters50/4772835
ataagaaaaca

SEQ ID NO: 193024 - DNA, 8 bp, Unknown
  misc_feature (1)..( 8): Result.006 file - promoters50/4772835
ataaaaac

SEQ ID NO: 193025 - DNA, 8 bp, Unknown
  misc_feature (1)..( 8): Result.006 file - promoters50/4772835
atataaac

SEQ ID NO: 193026 - DNA, 8 bp, Unknown
  misc_feature (1)..( 8): Result.006 file - promoters50/4772843
ttaagaac

SEQ ID NO: 193027 - DNA, 12 bp, Unknown
  misc_feature (1)..( 12): Result.006 file - promoters50/4772843
tcttgtgttctt

SEQ ID NO: 193028 - DNA, 12 bp, Unknown
  misc_feature (1)..( 12): Result.006 file - promoters50/4772843
caacatgtgctt

SEQ ID NO: 193029 - DNA, 12 bp, Unknown
  misc_feature (1)..( 12): Result.006 file - promoters50/4772843
aattgtgttcta

SEQ ID NO: 193030 - DNA, 12 bp, Unknown
  misc_feature (1)..( 12): Result.006 file - promoters50/4772843
caaaatgtgctt

SEQ ID NO: 193031 - DNA, 7 bp, Unknown
  misc_feature (1)..( 7): Result.006 file - promoters50/4772843
aatcatg

SEQ ID NO: 193032 - DNA, 7 bp, Unknown
  misc_feature (1)..( 7): Result.006 file - promoters50/4772843
aatgatg

SEQ ID NO: 193033 - DNA, 7 bp, Unknown
  misc_feature (1)..( 7): Result.006 file - promoters50/4772853
aatcata

SEQ ID NO: 193034 - DNA, 8 bp, Unknown
  misc_feature (1)..( 8): Result.006 file - promoters50/4772853
aaattaat

SEQ ID NO: 193035 - DNA, 8 bp, Unknown
  misc_feature (1)..( 8): Result.006 file - promoters50/4772853
taattaag

SEQ ID NO: 193036 - DNA, 8 bp, Unknown
  misc_feature (1)..( 8): Result.006 file - promoters50/4772853
aaaataat

SEQ ID NO: 193037 - DNA, 11 bp, Unknown
  misc_feature (1)..( 11): Result.006 file - promoters50/4772853
agtcaactaat

SEQ ID NO: 193038 - DNA, 11 bp, Unknown
  misc_feature (1)..( 11): Result.006 file - promoters50/4772853
ttttaacaaat

SEQ ID NO: 193039 - DNA, 11 bp, Unknown
  misc_feature (1)..( 11): Result.006 file - promoters50/4772853
ttttcacaata

SEQ ID NO: 193040 - DNA, 10 bp, Unknown
  misc_feature (1)..( 10): Result.006 file - promoters50/4772853
taaaatgtta

SEQ ID NO: 193041 - DNA, 10 bp, Unknown
  misc_feature (1)..( 10): Result.006 file - promoters50/4772853
taaaatgttt

SEQ ID NO: 193042 - DNA, 10 bp, Unknown
  misc_feature (1)..( 10): Result.006 file - promoters50/4772853
taggatgttt

SEQ ID NO: 193043 - DNA, 13 bp, Unknown
  misc_feature (1)..( 13): Result.006 file - promoters50/4772853
tttatcgataaat

SEQ ID NO: 193044 - DNA, 13 bp, Unknown
  misc_feature (1)..( 13): Result.006 file - promoters50/4772853
ttcatcgaaaaat

SEQ ID NO: 193045 - DNA, 13 bp, Unknown
  misc_feature (1)..( 13): Result.006 file - promoters50/4772853
ttcattgaaaagc

SEQ ID NO: 193046 - DNA, 8 bp, Unknown
  misc_feature (1)..( 8): Result.006 file - promoters50/4772853
ccaacatt

SEQ ID NO: 193047 - DNA, 8 bp, Unknown
  misc_feature (1)..( 8): Result.006 file - promoters50/4772853
tcaaaatt

SEQ ID NO: 193048 - DNA, 8 bp, Unknown
  misc_feature (1)..( 8): Result.006 file - promoters50/4772853
tcaaaatc

SEQ ID NO: 193049 - DNA, 8 bp, Unknown
  misc_feature (1)..( 8): Result.006 file - promoters50/4772853
catatttt

SEQ ID NO: 193050 - DNA, 8 bp, Unknown
  misc_feature (1)..( 8): Result.006 file - promoters50/4772853
tctatttt

SEQ ID NO: 193051 - DNA, 8 bp, Unknown
  misc_feature (1)..( 8): Result.006 file - promoters50/4772853
tctattta

SEQ ID NO: 193052 - DNA, 10 bp, Unknown
  misc_feature (1)..( 10): Result.006 file - promoters50/4772853
taatttgaac

SEQ ID NO: 193053 - DNA, 10 bp, Unknown
  misc_feature (1)..( 10): Result.006 file - promoters50/4772853
taatttaaaa

SEQ ID NO: 193054 - DNA, 10 bp, Unknown
  misc_feature (1)..( 10): Result.006 file - promoters50/4772853
taattaaaaa

SEQ ID NO: 193055 - DNA, 10 bp, Unknown
  misc_feature (1)..( 10): Result.006 file - promoters50/4772853
catttaagtg

SEQ ID NO: 193056 - DNA, 10 bp, Unknown
  misc_feature (1)..( 10): Result.006 file - promoters50/4772853
aatttaaaat

SEQ ID NO: 193057 - DNA, 10 bp, Unknown
  misc_feature (1)..( 10): Result.006 file - promoters50/4772855
taattaaaaa

SEQ ID NO: 193058 - DNA, 9 bp, Unknown
  misc_feature (1)..( 9): Result.006 file - promoters50/4772855
caatatgtt

SEQ ID NO: 193059 - DNA, 9 bp, Unknown
  misc_feature (1)..( 9): Result.006 file - promoters50/4772855
caatatgtt

SEQ ID NO: 193060 - DNA, 9 bp, Unknown
  misc_feature (1)..( 9): Result.006 file - promoters50/4772855
caatataaa

SEQ ID NO: 193061 - DNA, 7 bp, Unknown
  misc_feature (1)..( 7): Result.006 file - promoters50/4772855
aaattta

SEQ ID NO: 193062 - DNA, 7 bp, Unknown
  misc_feature (1)..( 7): Result.006 file - promoters50/4772855
taattta

SEQ ID NO: 193063 - DNA, 7 bp, Unknown
  misc_feature (1)..( 7): Result.006 file - promoters50/4772855
aaatttt

SEQ ID NO: 193064 - DNA, 11 bp, Unknown
  misc_feature (1)..( 11): Result.006 file - promoters50/4772855
ctttaaataaa

SEQ ID NO: 193065 - DNA, 11 bp, Unknown
  misc_feature (1)..( 11): Result.006 file - promoters50/4772855
caaaaaataaa

SEQ ID NO: 193066 - DNA, 11 bp, Unknown
  misc_feature (1)..( 11): Result.006 file - promoters50/4772855
ttaaaaataca

SEQ ID NO: 193067 - DNA, 11 bp, Unknown
  misc_feature (1)..( 11): Result.006 file - promoters50/4772855
ttaaaaatcag

SEQ ID NO: 193068 - DNA, 8 bp, Unknown
  misc_feature (1)..( 8): Result.006 file - promoters50/4772855
cctagaaa

SEQ ID NO: 193069 - DNA, 8 bp, Unknown
  misc_feature (1)..( 8): Result.006 file - promoters50/4772855
cctataaa

SEQ ID NO: 193070 - DNA, 8 bp, Unknown
  misc_feature (1)..( 8): Result.006 file - promoters50/4772855
tttataaa

SEQ ID NO: 193071 - DNA, 9 bp, Unknown
  misc_feature (1)..( 9): Result.006 file - promoters50/4772855
tttaaataa

SEQ ID NO: 193072 - DNA, 9 bp, Unknown
  misc_feature (1)..( 9): Result.006 file - promoters50/4772855
tttaaaaat

SEQ ID NO: 193073 - DNA, 9 bp, Unknown
  misc_feature (1)..( 9): Result.006 file - promoters50/4772855
attaaaaat

SEQ ID NO: 193074 - DNA, 9 bp, Unknown
  misc_feature (1)..( 9): Result.006 file - promoters50/4772855
aattcgtgg

SEQ ID NO: 193075 - DNA, 9 bp, Unknown
  misc_feature (1)..( 9): Result.006 file - promoters50/4772855
aattcgttt

SEQ ID NO: 193076 - DNA, 9 bp, Unknown
  misc_feature (1)..( 9): Result.006 file - promoters50/4772855
gattcgttt

SEQ ID NO: 193077 - DNA, 9 bp, Unknown
  misc_feature (1)..( 9): Result.006 file - promoters50/4772855
ttttaagat

SEQ ID NO: 193078 - DNA, 9 bp, Unknown
  misc_feature (1)..( 9): Result.006 file - promoters50/4772855
atataagat

SEQ ID NO: 193079 - DNA, 9 bp, Unknown
  misc_feature (1)..( 9): Result.006 file - promoters50/4772855
atatcagaa

SEQ ID NO: 193080 - DNA, 12 bp, Unknown
  misc_feature (1)..( 12): Result.006 file - promoters50/4772855
aaaaacaaaaca

SEQ ID NO: 193081 - DNA, 12 bp, Unknown
  misc_feature (1)..( 12): Result.006 file - promoters50/4772855
aaacacaataca

SEQ ID NO: 193082 - DNA, 12 bp, Unknown
  misc_feature (1)..( 12): Result.006 file - promoters50/4772855
aaaaacaaaact

SEQ ID NO: 193083 - DNA, 7 bp, Unknown
  misc_feature (1)..( 7): Result.006 file - promoters50/4772855
aaaaata

SEQ ID NO: 193084 - DNA, 7 bp, Unknown
  misc_feature (1)..( 7): Result.006 file - promoters50/4772855
aaaaatc

SEQ ID NO: 193085 - DNA, 7 bp, Unknown
  misc_feature (1)..( 7): Result.006 file - promoters50/4772873
aaaaata

SEQ ID NO: 193086 - DNA, 6 bp, Unknown
  misc_feature (1)..( 6): Result.006 file - promoters50/4772873
aaaaga

SEQ ID NO: 193087 - DNA, 6 bp, Unknown
  misc_feature (1)..( 6): Result.006 file - promoters50/4772873
aaaaga

SEQ ID NO: 193088 - DNA, 6 bp, Unknown
  misc_feature (1)..( 6): Result.006 file - promoters50/4772873
aaaaga

SEQ ID NO: 193089 - DNA, 9 bp, Unknown
  misc_feature (1)..( 9): Result.006 file - promoters50/4772873
aaaaaaaaa

SEQ ID NO: 193090 - DNA, 9 bp, Unknown
  misc_feature (1)..( 9): Result.006 file - promoters50/4772873
aaataaaaa

SEQ ID NO: 193091 - DNA, 9 bp, Unknown
  misc_feature (1)..( 9): Result.006 file - promoters50/4772879
atataaaac

SEQ ID NO: 193092 - DNA, 10 bp, Unknown
  misc_feature (1)..( 10): Result.006 file - promoters50/4772879
tatttttttt

SEQ ID NO: 193093 - DNA, 10 bp, Unknown
  misc_feature (1)..( 10): Result.006 file - promoters50/4772879
catttttaag

SEQ ID NO: 193094 - DNA, 10 bp, Unknown
  misc_feature (1)..( 10): Result.006 file - promoters50/4772879
actttttttt

SEQ ID NO: 193095 - DNA, 10 bp, Unknown
  misc_feature (1)..( 10): Result.006 file - promoters50/4772879
gatttatttg

SEQ ID NO: 193096 - DNA, 10 bp, Unknown
  misc_feature (1)..( 10): Result.006 file - promoters50/4772879
aatttttcca

SEQ ID NO: 193097 - DNA, 10 bp, Unknown
  misc_feature (1)..( 10): Result.006 file - promoters50/4772879
aatctttaca

SEQ ID NO: 193098 - DNA, 12 bp, Unknown
  misc_feature (1)..( 12): Result.006 file - promoters50/4772879
atctcaaataac

SEQ ID NO: 193099 - DNA, 12 bp, Unknown
  misc_feature (1)..( 12): Result.006 file - promoters50/4772879
ataaaaaataaa

SEQ ID NO: 193100 - DNA, 12 bp, Unknown
  misc_feature (1)..( 12): Result.006 file - promoters50/4772879
ataataaatagg

SEQ ID NO: 193101 - DNA, 12 bp, Unknown
  misc_feature (1)..( 12): Result.006 file - promoters50/4772879
gcctaaaatata

SEQ ID NO: 193102 - DNA, 12 bp, Unknown
  misc_feature (1)..( 12): Result.006 file - promoters50/4772879
acaatgaatggc

SEQ ID NO: 193103 - DNA, 12 bp, Unknown
  misc_feature (1)..( 12): Result.006 file - promoters50/4772879
ccccaaaagaaa

SEQ ID NO: 193104 - DNA, 12 bp, Unknown
  misc_feature (1)..( 12): Result.006 file - promoters50/4772879
aatcagaataaa

SEQ ID NO: 193105 - DNA, 12 bp, Unknown
  misc_feature (1)..( 12): Result.006 file - promoters50/4772879
aattattatact

SEQ ID NO: 193106 - DNA, 9 bp, Unknown
  misc_feature (1)..( 9): Result.006 file - promoters50/4772879
tttattgat

SEQ ID NO: 193107 - DNA, 9 bp, Unknown
  misc_feature (1)..( 9): Result.006 file - promoters50/4772879
gttactgat

SEQ ID NO: 193108 - DNA, 9 bp, Unknown
  misc_feature (1)..( 9): Result.006 file - promoters50/4772879
tttgttggt

SEQ ID NO: 193109 - DNA, 9 bp, Unknown
  misc_feature (1)..( 9): Result.006 file - promoters50/4772879
tttgttggt

SEQ ID NO: 193110 - DNA, 9 bp, Unknown
  misc_feature (1)..( 9): Result.006 file - promoters50/4772879
cttaatgac

SEQ ID NO: 193111 - DNA, 9 bp, Unknown
  misc_feature (1)..( 9): Result.006 file - promoters50/4772879
aataatgaa

SEQ ID NO: 193112 - DNA, 9 bp, Unknown
  misc_feature (1)..( 9): Result.006 file - promoters50/4772879
gatttattt

SEQ ID NO: 193113 - DNA, 9 bp, Unknown
  misc_feature (1)..( 9): Result.006 file - promoters50/4772879
aatttatgt

SEQ ID NO: 193114 - DNA, 9 bp, Unknown
  misc_feature (1)..( 9): Result.006 file - promoters50/4772879
tgtttgttt

SEQ ID NO: 193115 - DNA, 9 bp, Unknown
  misc_feature (1)..( 9): Result.006 file - promoters50/4772879
tatttattt

SEQ ID NO: 193116 - DNA, 9 bp, Unknown
  misc_feature (1)..( 9): Result.006 file - promoters50/4772879
aatatatat

SEQ ID NO: 193117 - DNA, 9 bp, Unknown
  misc_feature (1)..( 9): Result.006 file - promoters50/4772879
aataaatat

SEQ ID NO: 193118 - DNA, 9 bp, Unknown
  misc_feature (1)..( 9): Result.006 file - promoters50/4772879
aatttattt

SEQ ID NO: 193119 - DNA, 9 bp, Unknown
  misc_feature (1)..( 9): Result.006 file - promoters50/4772879
gctttgttt

SEQ ID NO: 193120 - DNA, 9 bp, Unknown
  misc_feature (1)..( 9): Result.006 file - promoters50/4772879
aatatatat

SEQ ID NO: 193121 - DNA, 9 bp, Unknown
  misc_feature (1)..( 9): Result.006 file - promoters50/4772879
tatttattt

SEQ ID NO: 193122 - DNA, 9 bp, Unknown
  misc_feature (1)..( 9): Result.006 file - promoters50/4772879
catttgttt

SEQ ID NO: 193123 - DNA, 9 bp, Unknown
  misc_feature (1)..( 9): Result.006 file - promoters50/4772879
aataaatat

SEQ ID NO: 193124 - DNA, 12 bp, Unknown
  misc_feature (1)..( 12): Result.006 file - promoters50/4772879
ctgaatattaga

SEQ ID NO: 193125 - DNA, 12 bp, Unknown
  misc_feature (1)..( 12): Result.006 file - promoters50/4772879
atgaatattaga

SEQ ID NO: 193126 - DNA, 12 bp, Unknown
  misc_feature (1)..( 12): Result.006 file - promoters50/4772879
tcaaattttatt

SEQ ID NO: 193127 - DNA, 12 bp, Unknown
  misc_feature (1)..( 12): Result.006 file - promoters50/4772879
aaaaattaatga

SEQ ID NO: 193128 - DNA, 12 bp, Unknown
  misc_feature (1)..( 12): Result.006 file - promoters50/4772879
agggtttttata

SEQ ID NO: 193129 - DNA, 12 bp, Unknown
  misc_feature (1)..( 12): Result.006 file - promoters50/4772879
atgaattccggt

SEQ ID NO: 193130 - DNA, 12 bp, Unknown
  misc_feature (1)..( 12): Result.006 file - promoters50/4772879
tcatataattat

SEQ ID NO: 193131 - DNA, 12 bp, Unknown
  misc_feature (1)..( 12): Result.006 file - promoters50/4772879
atatataataaa

SEQ ID NO: 193132 - DNA, 12 bp, Unknown
  misc_feature (1)..( 12): Result.006 file - promoters50/4772879
tcaaatatggta

SEQ ID NO: 193133 - DNA, 12 bp, Unknown
  misc_feature (1)..( 12): Result.006 file - promoters50/4772879
gcataaaaaata

SEQ ID NO: 193134 - DNA, 12 bp, Unknown
  misc_feature (1)..( 12): Result.006 file - promoters50/4772879
caaaagaaaaaa

SEQ ID NO: 193135 - DNA, 12 bp, Unknown
  misc_feature (1)..( 12): Result.006 file - promoters50/4772879
taataacaaatc

SEQ ID NO: 193136 - DNA, 12 bp, Unknown
  misc_feature (1)..( 12): Result.006 file - promoters50/4772879
aattattatact

SEQ ID NO: 193137 - DNA, 11 bp, Unknown
  misc_feature (1)..( 11): Result.006 file - promoters50/4772879
taaaaagtctg

SEQ ID NO: 193138 - DNA, 11 bp, Unknown
  misc_feature (1)..( 11): Result.006 file - promoters50/4772879
gaaaaagggtt

SEQ ID NO: 193139 - DNA, 11 bp, Unknown
  misc_feature (1)..( 11): Result.006 file - promoters50/4772879
taaaaatgaag

SEQ ID NO: 193140 - DNA, 11 bp, Unknown
  misc_feature (1)..( 11): Result.006 file - promoters50/4772879
aaaaaagaaaa

SEQ ID NO: 193141 - DNA, 11 bp, Unknown
  misc_feature (1)..( 11): Result.006 file - promoters50/4772879
caaaaatcttg

SEQ ID NO: 193142 - DNA, 11 bp, Unknown
  misc_feature (1)..( 11): Result.006 file - promoters50/4772883
gttgaatgttg

SEQ ID NO: 193143 - DNA, 13 bp, Unknown
  misc_feature (1)..( 13): Result.006 file - promoters50/4772883
gtaaacaattttt

SEQ ID NO: 193144 - DNA, 13 bp, Unknown
  misc_feature (1)..( 13): Result.006 file - promoters50/4772883
aaaaacaaatcag

SEQ ID NO: 193145 - DNA, 13 bp, Unknown
  misc_feature (1)..( 13): Result.006 file - promoters50/4772883
aaaaaaaatatca

SEQ ID NO: 193146 - DNA, 13 bp, Unknown
  misc_feature (1)..( 13): Result.006 file - promoters50/4772883
attaaaaatcaaa

SEQ ID NO: 193147 - DNA, 14 bp, Unknown
  misc_feature (1)..( 14): Result.006 file - promoters50/4772883
ccaaaccaataacc

SEQ ID NO: 193148 - DNA, 14 bp, Unknown
  misc_feature (1)..( 14): Result.006 file - promoters50/4772883
aaaaaaaaattggt

SEQ ID NO: 193149 - DNA, 11 bp, Unknown
  misc_feature (1)..( 11): Result.006 file - promoters50/4772883
acaattttata

SEQ ID NO: 193150 - DNA, 11 bp, Unknown
  misc_feature (1)..( 11): Result.006 file - promoters50/4772883
tcaatttgact

SEQ ID NO: 193151 - DNA, 12 bp, Unknown
  misc_feature (1)..( 12): Result.006 file - promoters50/4772883
ctaatattaaaa

SEQ ID NO: 193152 - DNA, 12 bp, Unknown
  misc_feature (1)..( 12): Result.006 file - promoters50/4772883
aaaaaattggta

SEQ ID NO: 193153 - DNA, 12 bp, Unknown
  misc_feature (1)..( 12): Result.006 file - promoters50/4772883
ccaaattggaaa

SEQ ID NO: 193154 - DNA, 12 bp, Unknown
  misc_feature (1)..( 12): Result.006 file - promoters50/4772883
aaaatatcaaaa

SEQ ID NO: 193155 - DNA, 10 bp, Unknown
  misc_feature (1)..( 10): Result.006 file - promoters50/4772883
ttttttaaca

SEQ ID NO: 193156 - DNA, 10 bp, Unknown
  misc_feature (1)..( 10): Result.006 file - promoters50/4772883
tttattatgt

SEQ ID NO: 193157 - DNA, 10 bp, Unknown
  misc_feature (1)..( 10): Result.006 file - promoters50/4772883
tattttaaca

SEQ ID NO: 193158 - DNA, 10 bp, Unknown
  misc_feature (1)..( 10): Result.006 file - promoters50/4772883
tttgttaaaa

SEQ ID NO: 193159 - DNA, 10 bp, Unknown
  misc_feature (1)..( 10): Result.006 file - promoters50/4772883
aattttatcc

SEQ ID NO: 193160 - DNA, 10 bp, Unknown
  misc_feature (1)..( 10): Result.006 file - promoters50/4772883
cgtttgatcg

SEQ ID NO: 193161 - DNA, 10 bp, Unknown
  misc_feature (1)..( 10): Result.006 file - promoters50/4772883
caaaacactt

SEQ ID NO: 193162 - DNA, 10 bp, Unknown
  misc_feature (1)..( 10): Result.006 file - promoters50/4772883
aaaaacaaaa

SEQ ID NO: 193163 - DNA, 10 bp, Unknown
  misc_feature (1)..( 10): Result.006 file - promoters50/4772883
aaaaacttcg

SEQ ID NO: 193164 - DNA, 10 bp, Unknown
  misc_feature (1)..( 10): Result.006 file - promoters50/4772883
taaaataaaa

SEQ ID NO: 193165 - DNA, 10 bp, Unknown
  misc_feature (1)..( 10): Result.006 file - promoters50/4772883
caaaagaaat

SEQ ID NO: 193166 - DNA, 13 bp, Unknown
  misc_feature (1)..( 13): Result.006 file - promoters50/4772883
ataaacaatttta

SEQ ID NO: 193167 - DNA, 13 bp, Unknown
  misc_feature (1)..( 13): Result.006 file - promoters50/4772883
caaaacaaaacag

SEQ ID NO: 193168 - DNA, 13 bp, Unknown
  misc_feature (1)..( 13): Result.006 file - promoters50/4772883
aaaaaaaattggt

SEQ ID NO: 193169 - DNA, 13 bp, Unknown
  misc_feature (1)..( 13): Result.006 file - promoters50/4772883
aaaaacaaatcag

SEQ ID NO: 193170 - DNA, 14 bp, Unknown
  misc_feature (1)..( 14): Result.006 file - promoters50/4772883
aaaaatcaaaacga

SEQ ID NO: 193171 - DNA, 14 bp, Unknown
  misc_feature (1)..( 14): Result.006 file - promoters50/4772883
ccaaaccaataacc

SEQ ID NO: 193172 - DNA, 10 bp, Unknown
  misc_feature (1)..( 10): Result.006 file - promoters50/4772883
atactaattt

SEQ ID NO: 193173 - DNA, 10 bp, Unknown
  misc_feature (1)..( 10): Result.006 file - promoters50/4772883
ataataattt

SEQ ID NO: 193174 - DNA, 10 bp, Unknown
  misc_feature (1)..( 10): Result.006 file - promoters50/4772883
ttacaaatga

SEQ ID NO: 193175 - DNA, 10 bp, Unknown
  misc_feature (1)..( 10): Result.006 file - promoters50/4772883
caacacatgt

SEQ ID NO: 193176 - DNA, 10 bp, Unknown
  misc_feature (1)..( 10): Result.006 file - promoters50/4772887
gtaataacct

SEQ ID NO: 193177 - DNA, 10 bp, Unknown
  misc_feature (1)..( 10): Result.006 file - promoters50/4772887
ttttttatta

SEQ ID NO: 193178 - DNA, 10 bp, Unknown
  misc_feature (1)..( 10): Result.006 file - promoters50/4772887
ttttctattt

SEQ ID NO: 193179 - DNA, 10 bp, Unknown
  misc_feature (1)..( 10): Result.006 file - promoters50/4772917
atttctttta

SEQ ID NO: 193180 - DNA, 8 bp, Unknown
  misc_feature (1)..( 8): Result.006 file - promoters50/4772917
catatact

SEQ ID NO: 193181 - DNA, 8 bp, Unknown
  misc_feature (1)..( 8): Result.006 file - promoters50/4772917
cataaact

SEQ ID NO: 193182 - DNA, 8 bp, Unknown
  misc_feature (1)..( 8): Result.006 file - promoters50/4772917
aaaaatct

SEQ ID NO: 193183 - DNA, 10 bp, Unknown
  misc_feature (1)..( 10): Result.006 file - promoters50/4772917
aaactcctat

SEQ ID NO: 193184 - DNA, 10 bp, Unknown
  misc_feature (1)..( 10): Result.006 file - promoters50/4772917
tctctcttat

SEQ ID NO: 193185 - DNA, 10 bp, Unknown
  misc_feature (1)..( 10): Result.006 file - promoters50/4772925
tctctcttct

SEQ ID NO: 193186 - DNA, 9 bp, Unknown
  misc_feature (1)..( 9): Result.006 file - promoters50/4772925
atgtttttt

SEQ ID NO: 193187 - DNA, 9 bp, Unknown
  misc_feature (1)..( 9): Result.006 file - promoters50/4772925
atggttttc

SEQ ID NO: 193188 - DNA, 9 bp, Unknown
  misc_feature (1)..( 9): Result.006 file - promoters50/4772925
acatttttt

SEQ ID NO: 193189 - DNA, 14 bp, Unknown
  misc_feature (1)..( 14): Result.006 file - promoters50/4772925
cagtggtaacaaaa

SEQ ID NO: 193190 - DNA, 14 bp, Unknown
  misc_feature (1)..( 14): Result.006 file - promoters50/4772925
ttgttataaaaaaa

SEQ ID NO: 193191 - DNA, 14 bp, Unknown
  misc_feature (1)..( 14): Result.006 file - promoters50/4772925
ttgtcatagaaacg

SEQ ID NO: 193192 - DNA, 9 bp, Unknown
  misc_feature (1)..( 9): Result.006 file - promoters50/4772925
gttatatga

SEQ ID NO: 193193 - DNA, 9 bp, Unknown
  misc_feature (1)..( 9): Result.006 file - promoters50/4772925
gttatatgt

SEQ ID NO: 193194 - DNA, 9 bp, Unknown
  misc_feature (1)..( 9): Result.006 file - promoters50/4772947
aaaatatgt

SEQ ID NO: 193195 - DNA, 7 bp, Unknown
  misc_feature (1)..( 7): Result.006 file - promoters50/4772947
aaaataa

SEQ ID NO: 193196 - DNA, 7 bp, Unknown
  misc_feature (1)..( 7): Result.006 file - promoters50/4772947
aaactaa

SEQ ID NO: 193197 - DNA, 7 bp, Unknown
  misc_feature (1)..( 7): Result.006 file - promoters50/4772947
aaactat

SEQ ID NO: 193198 - DNA, 9 bp, Unknown
  misc_feature (1)..( 9): Result.006 file - promoters50/4772947
agtttttca

SEQ ID NO: 193199 - DNA, 9 bp, Unknown
  misc_feature (1)..( 9): Result.006 file - promoters50/4772947
agtttttct

SEQ ID NO: 193200 - DNA, 9 bp, Unknown
  misc_feature (1)..( 9): Result.006 file - promoters50/4772983
tatttttct

SEQ ID NO: 193201 - DNA, 9 bp, Unknown
  misc_feature (1)..( 9): Result.006 file - promoters50/4772983
tgcaaagag

SEQ ID NO: 193202 - DNA, 9 bp, Unknown
  misc_feature (1)..( 9): Result.006 file - promoters50/4772983
atcaacgag

SEQ ID NO: 193203 - DNA, 9 bp, Unknown
  misc_feature (1)..( 9): Result.006 file - promoters50/4772983
tgcgaagta

SEQ ID NO: 193204 - DNA, 12 bp, Unknown
  misc_feature (1)..( 12): Result.006 file - promoters50/4772983
gaagcctgcaag

SEQ ID NO: 193205 - DNA, 12 bp, Unknown
  misc_feature (1)..( 12): Result.006 file - promoters50/4772983
gaagcttgcgga

SEQ ID NO: 193206 - DNA, 12 bp, Unknown
  misc_feature (1)..( 12): Result.006 file - promoters50/4772991
cagtcttgtgga

SEQ ID NO: 193207 - DNA, 7 bp, Unknown
  misc_feature (1)..( 7): Result.006 file - promoters50/4772991
cttggat

SEQ ID NO: 193208 - DNA, 7 bp, Unknown
  misc_feature (1)..( 7): Result.006 file - promoters50/4772991
gttggat

SEQ ID NO: 193209 - DNA, 7 bp, Unknown
  misc_feature (1)..( 7): Result.006 file - promoters50/4772991
cttcgat

SEQ ID NO: 193210 - DNA, 7 bp, Unknown
  misc_feature (1)..( 7): Result.006 file - promoters50/4772991
gtttgat

SEQ ID NO: 193211 - DNA, 10 bp, Unknown
  misc_feature (1)..( 10): Result.006 file - promoters50/4772991
ttatcaattt

SEQ ID NO: 193212 - DNA, 10 bp, Unknown
  misc_feature (1)..( 10): Result.006 file - promoters50/4772991
ttataaattt

SEQ ID NO: 193213 - DNA, 10 bp, Unknown
  misc_feature (1)..( 10): Result.006 file - promoters50/4772991
tcctaaattc

SEQ ID NO: 193214 - DNA, 10 bp, Unknown
  misc_feature (1)..( 10): Result.006 file - promoters50/4772995
agataaatga

SEQ ID NO: 193215 - DNA, 6 bp, Unknown
  misc_feature (1)..( 6): Result.006 file - promoters50/4772995
tttgat

SEQ ID NO: 193216 - DNA, 6 bp, Unknown
  misc_feature (1)..( 6): Result.006 file - promoters50/4772995
tttgat

SEQ ID NO: 193217 - DNA, 6 bp, Unknown
  misc_feature (1)..( 6): Result.006 file - promoters50/4772995
tttgat

SEQ ID NO: 193218 - DNA, 10 bp, Unknown
  misc_feature (1)..( 10): Result.006 file - promoters50/4772995
ccatattaaa

SEQ ID NO: 193219 - DNA, 10 bp, Unknown
  misc_feature (1)..( 10): Result.006 file - promoters50/4772995
ccaaattaac

SEQ ID NO: 193220 - DNA, 10 bp, Unknown
  misc_feature (1)..( 10): Result.006 file - promoters50/4773015
atccattaac

SEQ ID NO: 193221 - DNA, 10 bp, Unknown
  misc_feature (1)..( 10): Result.006 file - promoters50/4773015
accaaaaaaa

SEQ ID NO: 193222 - DNA, 10 bp, Unknown
  misc_feature (1)..( 10): Result.006 file - promoters50/4773015
cacaaaaaaa

SEQ ID NO: 193223 - DNA, 10 bp, Unknown
  misc_feature (1)..( 10): Result.006 file - promoters50/4773035
accaaaatca

SEQ ID NO: 193224 - DNA, 12 bp, Unknown
  misc_feature (1)..( 12): Result.006 file - promoters50/4773035
tcctaaaaaaat

SEQ ID NO: 193225 - DNA, 12 bp, Unknown
  misc_feature (1)..( 12): Result.006 file - promoters50/4773035
gtgaaaaataat

SEQ ID NO: 193226 - DNA, 12 bp, Unknown
  misc_feature (1)..( 12): Result.006 file - promoters50/4773035
ttacagaaaaat

SEQ ID NO: 193227 - DNA, 12 bp, Unknown
  misc_feature (1)..( 12): Result.006 file - promoters50/4773035
ttacaaaatagg

SEQ ID NO: 193228 - DNA, 12 bp, Unknown
  misc_feature (1)..( 12): Result.006 file - promoters50/4773035
ttagaaaatcca

SEQ ID NO: 193229 - DNA, 12 bp, Unknown
  misc_feature (1)..( 12): Result.006 file - promoters50/4773035
tactaaaaccaa

SEQ ID NO: 193230 - DNA, 12 bp, Unknown
  misc_feature (1)..( 12): Result.006 file - promoters50/4773035
tagagaaattta

SEQ ID NO: 193231 - DNA, 15 bp, Unknown
  misc_feature (1)..( 15): Result.006 file - promoters50/4773035
cacacaaaattatta

SEQ ID NO: 193232 - DNA, 15 bp, Unknown
  misc_feature (1)..( 15): Result.006 file - promoters50/4773035
ttgatgaaattatta

SEQ ID NO: 193233 - DNA, 15 bp, Unknown
  misc_feature (1)..( 15): Result.006 file - promoters50/4773035
ttatcaaaattgtgg

SEQ ID NO: 193234 - DNA, 15 bp, Unknown
  misc_feature (1)..( 15): Result.006 file - promoters50/4773035
ttttgaaaatgtgtt

SEQ ID NO: 193235 - DNA, 15 bp, Unknown
  misc_feature (1)..( 15): Result.006 file - promoters50/4773035
atattaaaaagtctg

SEQ ID NO: 193236 - DNA, 15 bp, Unknown
  misc_feature (1)..( 15): Result.006 file - promoters50/4773046
atattaaagtaaacc

SEQ ID NO: 193237 - DNA, 9 bp, Unknown
  misc_feature (1)..( 9): Result.006 file - promoters50/4773046
cgatgtttt

SEQ ID NO: 193238 - DNA, 9 bp, Unknown
  misc_feature (1)..( 9): Result.006 file - promoters50/4773046
gaatgtttc

SEQ ID NO: 193239 - DNA, 10 bp, Unknown
  misc_feature (1)..( 10): Result.006 file - promoters50/4773046
acatggtttt

SEQ ID NO: 193240 - DNA, 10 bp, Unknown
  misc_feature (1)..( 10): Result.006 file - promoters50/4773046
atgttatttt

SEQ ID NO: 193241 - DNA, 11 bp, Unknown
  misc_feature (1)..( 11): Result.006 file - promoters50/4773068
attttagttta

SEQ ID NO: 193242 - DNA, 8 bp, Unknown
  misc_feature (1)..( 8): Result.006 file - promoters50/4773068
ttcttgcc

SEQ ID NO: 193243 - DNA, 8 bp, Unknown
  misc_feature (1)..( 8): Result.006 file - promoters50/4773068
ttctggcc

SEQ ID NO: 193244 - DNA, 8 bp, Unknown
  misc_feature (1)..( 8): Result.006 file - promoters50/4773068
gtcttgcg

SEQ ID NO: 193245 - DNA, 31 bp, Unknown; identical to SEQ ID NO: 72331
  misc_feature (1)..( 31): Result.006 file - promoters50/4773068

SEQ ID NO: 193246 - DNA, 31 bp, Unknown; identical to SEQ ID NO: 186078
  misc_feature (1)..( 31): Result.006 file - promoters50/4773068

SEQ ID NO: 193247 - DNA, 31 bp, Unknown; identical to SEQ ID NO: 186077
  misc_feature (1)..( 31): Result.006 file - promoters50/4773068

SEQ ID NO: 193248 - DNA, 30 bp, Unknown; identical to SEQ ID NO: 71939
  misc_feature (1)..( 30): Result.006 file - promoters50/4773068

SEQ ID NO: 193249 - DNA, 30 bp, Unknown; identical to SEQ ID NO: 184369
  misc_feature (1)..( 30): Result.006 file - promoters50/4773068

SEQ ID NO: 193250 - DNA, 30 bp, Unknown; identical to SEQ ID NO: 184367
  misc_feature (1)..( 30): Result.006 file - promoters50/4773068

SEQ ID NO: 193251 - DNA, 15 bp, Unknown
  misc_feature (1)..( 15): Result.006 file - promoters50/4773068
cgccttagctttctc

SEQ ID NO: 193252 - DNA, 15 bp, Unknown
  misc_feature (1)..( 15): Result.006 file - promoters50/4773068
cgccttagctttctc

SEQ ID NO: 193253 - DNA, 15 bp, Unknown
  misc_feature (1)..( 15): Result.006 file - promoters50/4773068
cgccttagctttctc

SEQ ID NO: 193254 - DNA, 22 bp, Unknown
  misc_feature (1)..( 22): Result.006 file - promoters50/4773068
gaccgagtcgtcctcgtctttt

SEQ ID NO: 193255 - DNA, 22 bp, Unknown
  misc_feature (1)..( 22): Result.006 file - promoters50/4773068
gaccgactcgtcctcgtctttt

SEQ ID NO: 193256 - DNA, 22 bp, Unknown
  misc_feature (1)..( 22): Result.006 file - promoters50/4773068
gacctagtcgtcctcgtctttt

SEQ ID NO: 193257 - DNA, 19 bp, Unknown
  misc_feature (1)..( 19): Result.006 file - promoters50/4773068
ttttgcttctataaatcaa

SEQ ID NO: 193258 - DNA, 19 bp, Unknown
  misc_feature (1)..( 19): Result.006 file - promoters50/4773068
ttcttcttctataaaacaa

SEQ ID NO: 193259 - DNA, 19 bp, Unknown
  misc_feature (1)..( 19): Result.006 file - promoters50/4773068
gatctttgccggaaaacaa

SEQ ID NO: 193260 - DNA, 19 bp, Unknown
  misc_feature (1)..( 19): Result.006 file - promoters50/4773068
ttcttcttctataaattaa

SEQ ID NO: 193261 - DNA, 9 bp, Unknown
  misc_feature (1)..( 9): Result.006 file - promoters50/4773068
caataaaac

SEQ ID NO: 193262 - DNA, 9 bp, Unknown
  misc_feature (1)..( 9): Result.006 file - promoters50/4773068
caaaaaaaa

SEQ ID NO: 193263 - DNA, 9 bp, Unknown
  misc_feature (1)..( 9): Result.006 file - promoters50/4773068
gaaaacaac

SEQ ID NO: 193264 - DNA, 6 bp, Unknown
  misc_feature (1)..( 6): Result.006 file - promoters50/4773068
aaaaca

SEQ ID NO: 193265 - DNA, 6 bp, Unknown
  misc_feature (1)..( 6): Result.006 file - promoters50/4773068
aaaaca

SEQ ID NO: 193266 - DNA, 6 bp, Unknown
  misc_feature (1)..( 6): Result.006 file - promoters50/4773074
aaaaca

SEQ ID NO: 193267 - DNA, 8 bp, Unknown
  misc_feature (1)..( 8): Result.006 file - promoters50/4773074
actataaa

SEQ ID NO: 193268 - DNA, 8 bp, Unknown
  misc_feature (1)..( 8): Result.006 file - promoters50/4773074
tgtataaa

SEQ ID NO: 193269 - DNA, 8 bp, Unknown
  misc_feature (1)..( 8): Result.006 file - promoters50/4773074
tatataaa

SEQ ID NO: 193270 - DNA, 8 bp, Unknown
  misc_feature (1)..( 8): Result.006 file - promoters50/4773074
actataaa

SEQ ID NO: 193271 - DNA, 8 bp, Unknown
  misc_feature (1)..( 8): Result.006 file - promoters50/4773074
tatataaa

SEQ ID NO: 193272 - DNA, 8 bp, Unknown
  misc_feature (1)..( 8): Result.006 file - promoters50/4773074
cttataaa

SEQ ID NO: 193273 - DNA, 10 bp, Unknown
  misc_feature (1)..( 10): Result.006 file - promoters50/4773074
taaaacccta

SEQ ID NO: 193274 - DNA, 10 bp, Unknown
  misc_feature (1)..( 10): Result.006 file - promoters50/4773074
caaagccctt

SEQ ID NO: 193275 - DNA, 10 bp, Unknown
  misc_feature (1)..( 10): Result.006 file - promoters50/4773074
aagaacccta

SEQ ID NO: 193276 - DNA, 10 bp, Unknown
  misc_feature (1)..( 10): Result.006 file - promoters50/4773074
caaaacctag

SEQ ID NO: 193277 - DNA, 10 bp, Unknown
  misc_feature (1)..( 10): Result.006 file - promoters50/4773074
taaaaccctc

SEQ ID NO: 193278 - DNA, 10 bp, Unknown
  misc_feature (1)..( 10): Result.006 file - promoters50/4773085
caaaacaaaa

SEQ ID NO: 193279 - DNA, 10 bp, Unknown
  misc_feature (1)..( 10): Result.006 file - promoters50/4773085
actcaggaag

SEQ ID NO: 193280 - DNA, 10 bp, Unknown
  misc_feature (1)..( 10): Result.006 file - promoters50/4773085
actaaggaaa

SEQ ID NO: 193281 - DNA, 10 bp, Unknown
  misc_feature (1)..( 10): Result.006 file - promoters50/4773085
agagaggaag

SEQ ID NO: 193282 - DNA, 10 bp, Unknown
  misc_feature (1)..( 10): Result.006 file - promoters50/4773085
aagaagaaaa

SEQ ID NO: 193283 - DNA, 10 bp, Unknown
  misc_feature (1)..( 10): Result.006 file - promoters50/4773085
cctaacgaat

SEQ ID NO: 193284 - DNA, 10 bp, Unknown
  misc_feature (1)..( 10): Result.006 file - promoters50/4773085
gctaaggaca

SEQ ID NO: 193285 - DNA, 10 bp, Unknown
  misc_feature (1)..( 10): Result.006 file - promoters50/4773085
tataagaaat

SEQ ID NO: 193286 - DNA, 10 bp, Unknown
  misc_feature (1)..( 10): Result.006 file - promoters50/4773085
ttaaaggaaa

SEQ ID NO: 193287 - DNA, 14 bp, Unknown
  misc_feature (1)..( 14): Result.006 file - promoters50/4773085
agaaacatctcttt

SEQ ID NO: 193288 - DNA, 14 bp, Unknown
  misc_feature (1)..( 14): Result.006 file - promoters50/4773085
taaaacatccatta

SEQ ID NO: 193289 - DNA, 14 bp, Unknown
  misc_feature (1)..( 14): Result.006 file - promoters50/4773085
agatacaaatccct

SEQ ID NO: 193290 - DNA, 14 bp, Unknown
  misc_feature (1)..( 14): Result.006 file - promoters50/4773085
cacgacatccattt

SEQ ID NO: 193291 - DNA, 14 bp, Unknown
  misc_feature (1)..( 14): Result.006 file - promoters50/4773085
ccaaagatagaaat

SEQ ID NO: 193292 - DNA, 14 bp, Unknown
  misc_feature (1)..( 14): Result.006 file - promoters50/4773085
gtaaaaataaagcc

SEQ ID NO: 193293 - DNA, 8 bp, Unknown
  misc_feature (1)..( 8): Result.006 file - promoters50/4773085
tatataaa

SEQ ID NO: 193294 - DNA, 8 bp, Unknown
  misc_feature (1)..( 8): Result.006 file - promoters50/4773085
tatataaa

SEQ ID NO: 193295 - DNA, 8 bp, Unknown
  misc_feature (1)..( 8): Result.006 file - promoters50/4773085
aatataat

SEQ ID NO: 193296 - DNA, 8 bp, Unknown
  misc_feature (1)..( 8): Result.006 file - promoters50/4773085
tatataat

SEQ ID NO: 193297 - DNA, 8 bp, Unknown
  misc_feature (1)..( 8): Result.006 file - promoters50/4773085
tatataaa

SEQ ID NO: 193298 - DNA, 8 bp, Unknown
  misc_feature (1)..( 8): Result.006 file - promoters50/4773085
tatatata

SEQ ID NO: 193299 - DNA, 8 bp, Unknown
  misc_feature (1)..( 8): Result.006 file - promoters50/4773085
tatatatc

SEQ ID NO: 193300 - DNA, 13 bp, Unknown
  misc_feature (1)..( 13): Result.006 file - promoters50/4773085
tctgatctctgat

SEQ ID NO: 193301 - DNA, 13 bp, Unknown
  misc_feature (1)..( 13): Result.006 file - promoters50/4773085
tctaatctctcca

SEQ ID NO: 193302 - DNA, 13 bp, Unknown
  misc_feature (1)..( 13): Result.006 file - promoters50/4773085
cctaatctatata

SEQ ID NO: 193303 - DNA, 13 bp, Unknown
  misc_feature (1)..( 13): Result.006 file - promoters50/4773085
gtcaatctaaata

SEQ ID NO: 193304 - DNA, 13 bp, Unknown
  misc_feature (1)..( 13): Result.006 file - promoters50/4773085
cctaattaattgg

SEQ ID NO: 193305 - DNA, 13 bp, Unknown
  misc_feature (1)..( 13): Result.006 file - promoters50/4773085
tctaattttgctc

SEQ ID NO: 193306 - DNA, 11 bp, Unknown
  misc_feature (1)..( 11): Result.006 file - promoters50/4773085
attaattatta

SEQ ID NO: 193307 - DNA, 11 bp, Unknown
  misc_feature (1)..( 11): Result.006 file - promoters50/4773085
acctattttta

SEQ ID NO: 193308 - DNA, 10 bp, Unknown
  misc_feature (1)..( 10): Result.006 file - promoters50/4773085
ctaaatatag

SEQ ID NO: 193309 - DNA, 12 bp, Unknown
  misc_feature (1)..( 12): Result.006 file - promoters50/4773085
ctaatctatata

SEQ ID NO: 193310 - DNA, 12 bp, Unknown
  misc_feature (1)..( 12): Result.006 file - promoters50/4773085
ctaattttgctc

SEQ ID NO: 193311 - DNA, 13 bp, Unknown
  misc_feature (1)..( 13): Result.006 file - promoters50/4773089
gtaaaaataaagc

SEQ ID NO: 193312 - DNA, 10 bp, Unknown
  misc_feature (1)..( 10): Result.006 file - promoters50/4773089
aacgataaga

SEQ ID NO: 193313 - DNA, 10 bp, Unknown
  misc_feature (1)..( 10): Result.006 file - promoters50/4773089
gacgacaagc

SEQ ID NO: 193314 - DNA, 10 bp, Unknown
  misc_feature (1)..( 10): Result.006 file - promoters50/4773089
aaaaataaga

SEQ ID NO: 193315 - DNA, 10 bp, Unknown
  misc_feature (1)..( 10): Result.006 file - promoters50/4773089
aaacataagt

SEQ ID NO: 193316 - DNA, 10 bp, Unknown
  misc_feature (1)..( 10): Result.006 file - promoters50/4773089
aaaaataaac

SEQ ID NO: 193317 - DNA, 10 bp, Unknown
  misc_feature (1)..( 10): Result.006 file - promoters50/4773089
taaaatattc

SEQ ID NO: 193318 - DNA, 8 bp, Unknown
  misc_feature (1)..( 8): Result.006 file - promoters50/4773089
taaataat

SEQ ID NO: 193319 - DNA, 8 bp, Unknown
  misc_feature (1)..( 8): Result.006 file - promoters50/4773089
taactaaa

SEQ ID NO: 193320 - DNA, 8 bp, Unknown
  misc_feature (1)..( 8): Result.006 file - promoters50/4773089
gaaaaaat

SEQ ID NO: 193321 - DNA, 8 bp, Unknown
  misc_feature (1)..( 8): Result.006 file - promoters50/4773089
taactagt

SEQ ID NO: 193322 - DNA, 8 bp, Unknown
  misc_feature (1)..( 8): Result.006 file - promoters50/4773089
taactact

SEQ ID NO: 193323 - DNA, 8 bp, Unknown
  misc_feature (1)..( 8): Result.006 file - promoters50/4773089
gaaaaaaa

SEQ ID NO: 193324 - DNA, 17 bp, Unknown
  misc_feature (1)..( 17): Result.006 file - promoters50/4773089
tttagtcatattataaa

SEQ ID NO: 193325 - DNA, 17 bp, Unknown
  misc_feature (1)..( 17): Result.006 file - promoters50/4773089
tgtaattttattataaa

SEQ ID NO: 193326 - DNA, 17 bp, Unknown
  misc_feature (1)..( 17): Result.006 file - promoters50/4773089
cttaactttatcatatt

SEQ ID NO: 193327 - DNA, 17 bp, Unknown
  misc_feature (1)..( 17): Result.006 file - promoters50/4773089
attaacttcatcaaacc

SEQ ID NO: 193328 - DNA, 17 bp, Unknown
  misc_feature (1)..( 17): Result.006 file - promoters50/4773089
cttaaatttttaataca

SEQ ID NO: 193329 - DNA, 17 bp, Unknown
  misc_feature (1)..( 17): Result.006 file - promoters50/4773089
tgtcaatttttctttca

SEQ ID NO: 193330 - DNA, 11 bp, Unknown
  misc_feature (1)..( 11): Result.006 file - promoters50/4773089
aacaatttgaa

SEQ ID NO: 193331 - DNA, 11 bp, Unknown
  misc_feature (1)..( 11): Result.006 file - promoters50/4773089
ataaatttgtc

SEQ ID NO: 193332 - DNA, 12 bp, Unknown
  misc_feature (1)..( 12): Result.006 file - promoters50/4773089
aaaatattcgaa

SEQ ID NO: 193333 - DNA, 12 bp, Unknown
  misc_feature (1)..( 12): Result.006 file - promoters50/4773089
cataagtttcaa

SEQ ID NO: 193334 - DNA, 12 bp, Unknown
  misc_feature (1)..( 12): Result.006 file - promoters50/4773089
caaaaataagat

SEQ ID NO: 193335 - DNA, 12 bp, Unknown
  misc_feature (1)..( 12): Result.006 file - promoters50/4773089
attaactttgag

SEQ ID NO: 193336 - DNA, 12 bp, Unknown
  misc_feature (1)..( 12): Result.006 file - promoters50/4773093
gaaaaataaact

SEQ ID NO: 193337 - DNA, 8 bp, Unknown
  misc_feature (1)..( 8): Result.006 file - promoters50/4773093
tttgatgt

SEQ ID NO: 193338 - DNA, 8 bp, Unknown
  misc_feature (1)..( 8): Result.006 file - promoters50/4773093
tttgatca

SEQ ID NO: 193339 - DNA, 8 bp, Unknown
  misc_feature (1)..( 8): Result.006 file - promoters50/4773093
tttgatat

SEQ ID NO: 193340 - DNA, 8 bp, Unknown
  misc_feature (1)..( 8): Result.006 file - promoters50/4773093
gttgttat

SEQ ID NO: 193341 - DNA, 8 bp, Unknown
  misc_feature (1)..( 8): Result.006 file - promoters50/4773093
ttttcatc

SEQ ID NO: 193342 - DNA, 8 bp, Unknown
  misc_feature (1)..( 8): Result.006 file - promoters50/4773093
tttttatc

SEQ ID NO: 193343 - DNA, 8 bp, Unknown
  misc_feature (1)..( 8): Result.006 file - promoters50/4773093
tttccatt

SEQ ID NO: 193344 - DNA, 8 bp, Unknown
  misc_feature (1)..( 8): Result.006 file - promoters50/4773093
tttctctg

SEQ ID NO: 193345 - DNA, 9 bp, Unknown
  misc_feature (1)..( 9): Result.006 file - promoters50/4773093
gattttttt

SEQ ID NO: 193346 - DNA, 9 bp, Unknown
  misc_feature (1)..( 9): Result.006 file - promoters50/4773093
tattttttt

SEQ ID NO: 193347 - DNA, 9 bp, Unknown
  misc_feature (1)..( 9): Result.006 file - promoters50/4773093
gattttgag

SEQ ID NO: 193348 - DNA, 7 bp, Unknown
  misc_feature (1)..( 7): Result.006 file - promoters50/4773093
tgatttt

SEQ ID NO: 193349 - DNA, 7 bp, Unknown
  misc_feature (1)..( 7): Result.006 file - promoters50/4773093
tgatttg

SEQ ID NO: 193350 - DNA, 7 bp, Unknown
  misc_feature (1)..( 7): Result.006 file - promoters50/4773093
agatttt

SEQ ID NO: 193351 - DNA, 10 bp, Unknown
  misc_feature (1)..( 10): Result.006 file - promoters50/4773093
ttcctctctc

SEQ ID NO: 193352 - DNA, 10 bp, Unknown
  misc_feature (1)..( 10): Result.006 file - promoters50/4773093
tttctctctt

SEQ ID NO: 193353 - DNA, 10 bp, Unknown
  misc_feature (1)..( 10): Result.006 file - promoters50/4773093
tttcactctt

SEQ ID NO: 193354 - DNA, 12 bp, Unknown
  misc_feature (1)..( 12): Result.006 file - promoters50/4773093
gtaactttaaat

SEQ ID NO: 193355 - DNA, 12 bp, Unknown
  misc_feature (1)..( 12): Result.006 file - promoters50/4773093
gcaacttgaaat

SEQ ID NO: 193356 - DNA, 12 bp, Unknown
  misc_feature (1)..( 12): Result.006 file - promoters50/4773101
taaacattcata

SEQ ID NO: 193357 - DNA, 8 bp, Unknown
  misc_feature (1)..( 8): Result.006 file - promoters50/4773101
gaaagttt

SEQ ID NO: 193358 - DNA, 8 bp, Unknown
  misc_feature (1)..( 8): Result.006 file - promoters50/4773101
taaaattt

SEQ ID NO: 193359 - DNA, 8 bp, Unknown
  misc_feature (1)..( 8): Result.006 file - promoters50/4773108
taaaataa

SEQ ID NO: 193360 - DNA, 11 bp, Unknown
  misc_feature (1)..( 11): Result.006 file - promoters50/4773108
cttgaatattc

SEQ ID NO: 193361 - DNA, 11 bp, Unknown
  misc_feature (1)..( 11): Result.006 file - promoters50/4773108
gttgaattttt

SEQ ID NO: 193362 - DNA, 11 bp, Unknown
  misc_feature (1)..( 11): Result.006 file - promoters50/4773108
gttgacttttt

SEQ ID NO: 193363 - DNA, 7 bp, Unknown
  misc_feature (1)..( 7): Result.006 file - promoters50/4773108
cacagtt

SEQ ID NO: 193364 - DNA, 7 bp, Unknown
  misc_feature (1)..( 7): Result.006 file - promoters50/4773108
cacggtt

SEQ ID NO: 193365 - DNA, 7 bp, Unknown
  misc_feature (1)..( 7): Result.006 file - promoters50/4773112
cacagtt

SEQ ID NO: 193366 - DNA, 9 bp, Unknown
  misc_feature (1)..( 9): Result.006 file - promoters50/4773112
ggttatttt

SEQ ID NO: 193367 - DNA, 9 bp, Unknown
  misc_feature (1)..( 9): Result.006 file - promoters50/4773112
tgttaattt

SEQ ID NO: 193368 - DNA, 9 bp, Unknown
  misc_feature (1)..( 9): Result.006 file - promoters50/4773112
tgttaaaca

SEQ ID NO: 193369 - DNA, 8 bp, Unknown
  misc_feature (1)..( 8): Result.006 file - promoters50/4773112
cattcggt

SEQ ID NO: 193370 - DNA, 8 bp, Unknown
  misc_feature (1)..( 8): Result.006 file - promoters50/4773112
cattcgga

SEQ ID NO: 193371 - DNA, 8 bp, Unknown
  misc_feature (1)..( 8): Result.006 file - promoters50/4773121
cattagga

SEQ ID NO: 193372 - DNA, 7 bp, Unknown
  misc_feature (1)..( 7): Result.006 file - promoters50/4773121
caaaaat

SEQ ID NO: 193373 - DNA, 7 bp, Unknown
  misc_feature (1)..( 7): Result.006 file - promoters50/4773121
caaaaac

SEQ ID NO: 193374 - DNA, 7 bp, Unknown
  misc_feature (1)..( 7): Result.006 file - promoters50/4773124
caacaac

SEQ ID NO: 193375 - DNA, 8 bp, Unknown
  misc_feature (1)..( 8): Result.006 file - promoters50/4773124
tgattttt

SEQ ID NO: 193376 - DNA, 8 bp, Unknown
  misc_feature (1)..( 8): Result.006 file - promoters50/4773124
tgatcttt

SEQ ID NO: 193377 - DNA, 8 bp, Unknown
  misc_feature (1)..( 8): Result.006 file - promoters50/4773124
ctatcttt

SEQ ID NO: 193378 - DNA, 8 bp, Unknown
  misc_feature (1)..( 8): Result.006 file - promoters50/4773124
ttctctag

SEQ ID NO: 193379 - DNA, 8 bp, Unknown
  misc_feature (1)..( 8): Result.006 file - promoters50/4773124
atctttag

SEQ ID NO: 193380 - DNA, 8 bp, Unknown
  misc_feature (1)..( 8): Result.006 file - promoters50/4773124
atctttca

SEQ ID NO: 193381 - DNA, 10 bp, Unknown
  misc_feature (1)..( 10): Result.006 file - promoters50/4773124
atacagaaag

SEQ ID NO: 193382 - DNA, 10 bp, Unknown
  misc_feature (1)..( 10): Result.006 file - promoters50/4773124
atatagaaat

SEQ ID NO: 193383 - DNA, 10 bp, Unknown
  misc_feature (1)..( 10): Result.006 file - promoters50/4773124
ttattgaaat

SEQ ID NO: 193384 - DNA, 8 bp, Unknown
  misc_feature (1)..( 8): Result.006 file - promoters50/4773124
aatatatt

SEQ ID NO: 193385 - DNA, 8 bp, Unknown
  misc_feature (1)..( 8): Result.006 file - promoters50/4773124
tatatatt

SEQ ID NO: 193386 - DNA, 8 bp, Unknown
  misc_feature (1)..( 8): Result.006 file - promoters50/4773124
aatatagt

SEQ ID NO: 193387 - DNA, 7 bp, Unknown
  misc_feature (1)..( 7): Result.006 file - promoters50/4773124
ttctaat

SEQ ID NO: 193388 - DNA, 7 bp, Unknown
  misc_feature (1)..( 7): Result.006 file - promoters50/4773124
ttctaag

SEQ ID NO: 193389 - DNA, 7 bp, Unknown
  misc_feature (1)..( 7): Result.006 file - promoters50/4773127
ttctaat

SEQ ID NO: 193390 - DNA, 14 bp, Unknown
  misc_feature (1)..( 14): Result.006 file - promoters50/4773127
tgttaataattcgt

SEQ ID NO: 193391 - DNA, 14 bp, Unknown
  misc_feature (1)..( 14): Result.006 file - promoters50/4773127
ctttaaaaattcac

SEQ ID NO: 193392 - DNA, 14 bp, Unknown
  misc_feature (1)..( 14): Result.006 file - promoters50/4773127
tgtgaattgtgatg

SEQ ID NO: 193393 - DNA, 14 bp, Unknown
  misc_feature (1)..( 14): Result.006 file - promoters50/4773127
aagatttaattctg

SEQ ID NO: 193394 - DNA, 14 bp, Unknown
  misc_feature (1)..( 14): Result.006 file - promoters50/4773127
acagctaaatacac

SEQ ID NO: 193395 - DNA, 14 bp, Unknown
  misc_feature (1)..( 14): Result.006 file - promoters50/4773127
atacaaaaattagc

SEQ ID NO: 193396 - DNA, 14 bp, Unknown
  misc_feature (1)..( 14): Result.006 file - promoters50/4773134
tataaatatcagcc

SEQ ID NO: 193397 - DNA, 14 bp, Unknown
  misc_feature (1)..( 14): Result.006 file - promoters50/4773134
atttaatagtcatt

SEQ ID NO: 193398 - DNA, 14 bp, Unknown
  misc_feature (1)..( 14): Result.006 file - promoters50/4773134
tactaatactcaaa

SEQ ID NO: 193399 - DNA, 14 bp, Unknown
  misc_feature (1)..( 14): Result.006 file - promoters50/4773134
atttgatagtgatt

SEQ ID NO: 193400 - DNA, 8 bp, Unknown
  misc_feature (1)..( 8): Result.006 file - promoters50/4773134
aatattga

SEQ ID NO: 193401 - DNA, 8 bp, Unknown
  misc_feature (1)..( 8): Result.006 file - promoters50/4773134
aattttgg

SEQ ID NO: 193402 - DNA, 8 bp, Unknown
  misc_feature (1)..( 8): Result.006 file - promoters50/4773134
tgttttgg

SEQ ID NO: 193403 - DNA, 9 bp, Unknown
  misc_feature (1)..( 9): Result.006 file - promoters50/4773134
tatatttga

SEQ ID NO: 193404 - DNA, 9 bp, Unknown
  misc_feature (1)..( 9): Result.006 file - promoters50/4773134
tatttttgt

SEQ ID NO: 193405 - DNA, 9 bp, Unknown
  misc_feature (1)..( 9): Result.006 file - promoters50/4773134
tatatgatt

SEQ ID NO: 193406 - DNA, 8 bp, Unknown
  misc_feature (1)..( 8): Result.006 file - promoters50/4773134
tattgttt

SEQ ID NO: 193407 - DNA, 8 bp, Unknown
  misc_feature (1)..( 8): Result.006 file - promoters50/4773134
tatttttt

SEQ ID NO: 193408 - DNA, 8 bp, Unknown
  misc_feature (1)..( 8): Result.006 file - promoters50/4773134
aatttttg

SEQ ID NO: 193409 - DNA, 8 bp, Unknown
  misc_feature (1)..( 8): Result.006 file - promoters50/4773134
cttaaaca

SEQ ID NO: 193410 - DNA, 8 bp, Unknown
  misc_feature (1)..( 8): Result.006 file - promoters50/4773134
attacaca

SEQ ID NO: 193411 - DNA, 8 bp, Unknown
  misc_feature (1)..( 8): Result.006 file - promoters50/4773142
attacaat

SEQ ID NO: 193412 - DNA, 9 bp, Unknown
  misc_feature (1)..( 9): Result.006 file - promoters50/4773142
ggttataaa

SEQ ID NO: 193413 - DNA, 9 bp, Unknown
  misc_feature (1)..( 9): Result.006 file - promoters50/4773142
ggttgtaaa

SEQ ID NO: 193414 - DNA, 9 bp, Unknown
  misc_feature (1)..( 9): Result.006 file - promoters50/4773142
ttttataac

SEQ ID NO: 193415 - DNA, 15 bp, Unknown
  misc_feature (1)..( 15): Result.006 file - promoters50/4773142
aaatacaaaatccag

SEQ ID NO: 193416 - DNA, 15 bp, Unknown
  misc_feature (1)..( 15): Result.006 file - promoters50/4773142
aaacacataatgttt

SEQ ID NO: 193417 - DNA, 15 bp, Unknown
  misc_feature (1)..( 15): Result.006 file - promoters50/4773182
gttccaataattttt

SEQ ID NO: 193418 - DNA, 11 bp, Unknown
  misc_feature (1)..( 11): Result.006 file - promoters50/4773182
aattttaaatt

SEQ ID NO: 193419 - DNA, 11 bp, Unknown
  misc_feature (1)..( 11): Result.006 file - promoters50/4773182
aatattacatc

SEQ ID NO: 193420 - DNA, 11 bp, Unknown
  misc_feature (1)..( 11): Result.006 file - promoters50/4773182
aattctaaaat

SEQ ID NO: 193421 - DNA, 11 bp, Unknown
  misc_feature (1)..( 11): Result.006 file - promoters50/4773182
ggtttcaaaat

SEQ ID NO: 193422 - DNA, 11 bp, Unknown
  misc_feature (1)..( 11): Result.006 file - promoters50/4773182
attttcaacac

SEQ ID NO: 193423 - DNA, 11 bp, Unknown
  misc_feature (1)..( 11): Result.006 file - promoters50/4773182
atctttaaaaa

SEQ ID NO: 193424 - DNA, 13 bp, Unknown
  misc_feature (1)..( 13): Result.006 file - promoters50/4773182
tttaaattacaaa

SEQ ID NO: 193425 - DNA, 13 bp, Unknown
  misc_feature (1)..( 13): Result.006 file - promoters50/4773182
attaaattattcc

SEQ ID NO: 193426 - DNA, 13 bp, Unknown
  misc_feature (1)..( 13): Result.006 file - promoters50/4773182
tatgaattctaaa

SEQ ID NO: 193427 - DNA, 13 bp, Unknown
  misc_feature (1)..( 13): Result.006 file - promoters50/4773182
tttcaaaatcact

SEQ ID NO: 193428 - DNA, 13 bp, Unknown
  misc_feature (1)..( 13): Result.006 file - promoters50/4773182
tttcaacacgaat

SEQ ID NO: 193429 - DNA, 13 bp, Unknown
  misc_feature (1)..( 13): Result.006 file - promoters50/4773185
tttaaaaacaaaa

SEQ ID NO: 193430 - DNA, 10 bp, Unknown
  misc_feature (1)..( 10): Result.006 file - promoters50/4773185
tatatttaat

SEQ ID NO: 193431 - DNA, 10 bp, Unknown
  misc_feature (1)..( 10): Result.006 file - promoters50/4773185
aataattata

SEQ ID NO: 193432 - DNA, 10 bp, Unknown
  misc_feature (1)..( 10): Result.006 file - promoters50/4773185
catattttta

SEQ ID NO: 193433 - DNA, 10 bp, Unknown
  misc_feature (1)..( 10): Result.006 file - promoters50/4773185
tgtatttaga

SEQ ID NO: 193434 - DNA, 10 bp, Unknown
  misc_feature (1)..( 10): Result.006 file - promoters50/4773185
attattgaga

SEQ ID NO: 193435 - DNA, 10 bp, Unknown
  misc_feature (1)..( 10): Result.006 file - promoters50/4773185
accaatcata

SEQ ID NO: 193436 - DNA, 10 bp, Unknown
  misc_feature (1)..( 10): Result.006 file - promoters50/4773185
aataatctca

SEQ ID NO: 193437 - DNA, 10 bp, Unknown
  misc_feature (1)..( 10): Result.006 file - promoters50/4773185
aatactttat

SEQ ID NO: 193438 - DNA, 9 bp, Unknown
  misc_feature (1)..( 9): Result.006 file - promoters50/4773185
aatcagaaa

SEQ ID NO: 193439 - DNA, 9 bp, Unknown
  misc_feature (1)..( 9): Result.006 file - promoters50/4773185
aatcataaa

SEQ ID NO: 193440 - DNA, 9 bp, Unknown
  misc_feature (1)..( 9): Result.006 file - promoters50/4773185
aattatata

SEQ ID NO: 193441 - DNA, 9 bp, Unknown
  misc_feature (1)..( 9): Result.006 file - promoters50/4773185
tattttata

SEQ ID NO: 193442 - DNA, 9 bp, Unknown
  misc_feature (1)..( 9): Result.006 file - promoters50/4773185
aataataaa

SEQ ID NO: 193443 - DNA, 9 bp, Unknown
  misc_feature (1)..( 9): Result.006 file - promoters50/4773185
catcatagt

SEQ ID NO: 193444 - DNA, 9 bp, Unknown
  misc_feature (1)..( 9): Result.006 file - promoters50/4773185
tatttttat

SEQ ID NO: 193445 - DNA, 14 bp, Unknown
  misc_feature (1)..( 14): Result.006 file - promoters50/4773185
cagttttgaattca

SEQ ID NO: 193446 - DNA, 14 bp, Unknown
  misc_feature (1)..( 14): Result.006 file - promoters50/4773185
attattttaatttt

SEQ ID NO: 193447 - DNA, 14 bp, Unknown
  misc_feature (1)..( 14): Result.006 file - promoters50/4773185
tggttcctaatttg

SEQ ID NO: 193448 - DNA, 14 bp, Unknown
  misc_feature (1)..( 14): Result.006 file - promoters50/4773185
cacaacctaatttc

SEQ ID NO: 193449 - DNA, 14 bp, Unknown
  misc_feature (1)..( 14): Result.006 file - promoters50/4773185
caattcgtaattat

SEQ ID NO: 193450 - DNA, 14 bp, Unknown
  misc_feature (1)..( 14): Result.006 file - promoters50/4773185
tacaacttatttta

SEQ ID NO: 193451 - DNA, 14 bp, Unknown
  misc_feature (1)..( 14): Result.006 file - promoters50/4773185
atttttttaaaaat

SEQ ID NO: 193452 - DNA, 12 bp, Unknown
  misc_feature (1)..( 12): Result.006 file - promoters50/4773185
aaataattggtt

SEQ ID NO: 193453 - DNA, 12 bp, Unknown
  misc_feature (1)..( 12): Result.006 file - promoters50/4773185
taatcattatct

SEQ ID NO: 193454 - DNA, 12 bp, Unknown
  misc_feature (1)..( 12): Result.006 file - promoters50/4773185
aaattattttaa

SEQ ID NO: 193455 - DNA, 12 bp, Unknown
  misc_feature (1)..( 12): Result.006 file - promoters50/4773185
aacttattttat

SEQ ID NO: 193456 - DNA, 12 bp, Unknown
  misc_feature (1)..( 12): Result.006 file - promoters50/4773185
agatttttttaa

SEQ ID NO: 193457 - DNA, 12 bp, Unknown
  misc_feature (1)..( 12): Result.006 file - promoters50/4773185
taattattcaca

SEQ ID NO: 193458 - DNA, 15 bp, Unknown
  misc_feature (1)..( 15): Result.006 file - promoters50/4773185
tacatattgagttaa

SEQ ID NO: 193459 - DNA, 15 bp, Unknown
  misc_feature (1)..( 15): Result.006 file - promoters50/4773185
acaaaaatgaattaa

SEQ ID NO: 193460 - DNA, 15 bp, Unknown
  misc_feature (1)..( 15): Result.006 file - promoters50/4773185
caacacttgaatttt

SEQ ID NO: 193461 - DNA, 15 bp, Unknown
  misc_feature (1)..( 15): Result.006 file - promoters50/4773185
acaaaattgaatcta

SEQ ID NO: 193462 - DNA, 15 bp, Unknown
  misc_feature (1)..( 15): Result.006 file - promoters50/4773185
acaaaagcacttcgc

SEQ ID NO: 193463 - DNA, 15 bp, Unknown
  misc_feature (1)..( 15): Result.006 file - promoters50/4773185
tagtgacaaaattaa

SEQ ID NO: 193464 - DNA, 11 bp, Unknown
  misc_feature (1)..( 11): Result.006 file - promoters50/4773185
gatttctaata

SEQ ID NO: 193465 - DNA, 11 bp, Unknown
  misc_feature (1)..( 11): Result.006 file - promoters50/4773185
attttataata

SEQ ID NO: 193466 - DNA, 11 bp, Unknown
  misc_feature (1)..( 11): Result.006 file - promoters50/4773185
tttttataaat

SEQ ID NO: 193467 - DNA, 11 bp, Unknown
  misc_feature (1)..( 11): Result.006 file - promoters50/4773185
attttataggt

SEQ ID NO: 193468 - DNA, 11 bp, Unknown
  misc_feature (1)..( 11): Result.006 file - promoters50/4773185
tttttttaaca

SEQ ID NO: 193469 - DNA, 11 bp, Unknown
  misc_feature (1)..( 11): Result.006 file - promoters50/4773205
atcaaataata

SEQ ID NO: 193470 - DNA, 8 bp, Unknown
  misc_feature (1)..( 8): Result.006 file - promoters50/4773205
gatggtta

SEQ ID NO: 193471 - DNA, 8 bp, Unknown
  misc_feature (1)..( 8): Result.006 file - promoters50/4773205
aatggttc

SEQ ID NO: 193472 - DNA, 8 bp, Unknown
  misc_feature (1)..( 8): Result.006 file - promoters50/4773205
gattgtta

SEQ ID NO: 193473 - DNA, 8 bp, Unknown
  misc_feature (1)..( 8): Result.006 file - promoters50/4773205
taaaaaga

SEQ ID NO: 193474 - DNA, 8 bp, Unknown
  misc_feature (1)..( 8): Result.006 file - promoters50/4773205
taaaaatt

SEQ ID NO: 193475 - DNA, 8 bp, Unknown
  misc_feature (1)..( 8): Result.006 file - promoters50/4773205
taaacaga

SEQ ID NO: 193476 - DNA, 8 bp, Unknown
  misc_feature (1)..( 8): Result.006 file - promoters50/4773205
ttctttct

SEQ ID NO: 193477 - DNA, 8 bp, Unknown
  misc_feature (1)..( 8): Result.006 file - promoters50/4773205
ttctctct

SEQ ID NO: 193478 - DNA, 8 bp, Unknown
  misc_feature (1)..( 8): Result.006 file - promoters50/4773205
ctctctct

SEQ ID NO: 193479 - DNA, 11 bp, Unknown
  misc_feature (1)..( 11): Result.006 file - promoters50/4773205
ataaataatta

SEQ ID NO: 193480 - DNA, 11 bp, Unknown
  misc_feature (1)..( 11): Result.006 file - promoters50/4773205
gtagatattta

SEQ ID NO: 193481 - DNA, 11 bp, Unknown
  misc_feature (1)..( 11): Result.006 file - promoters50/4773205
aatgataatac

SEQ ID NO: 193482 - DNA, 10 bp, Unknown
  misc_feature (1)..( 10): Result.006 file - promoters50/4773205
aaaacaattt

SEQ ID NO: 193483 - DNA, 10 bp, Unknown
  misc_feature (1)..( 10): Result.006 file - promoters50/4773205
aaaacagttt

SEQ ID NO: 193484 - DNA, 10 bp, Unknown
  misc_feature (1)..( 10): Result.006 file - promoters50/4773205
aaaacaacaa

SEQ ID NO: 193485 - DNA, 7 bp, Unknown
  misc_feature (1)..( 7): Result.006 file - promoters50/4773205
gatcact

SEQ ID NO: 193486 - DNA, 7 bp, Unknown
  misc_feature (1)..( 7): Result.006 file - promoters50/4773205
gatgact

SEQ ID NO: 193487 - DNA, 7 bp, Unknown
  misc_feature (1)..( 7): Result.006 file - promoters50/4773225
gataact

SEQ ID NO: 193488 - DNA, 9 bp, Unknown
  misc_feature (1)..( 9): Result.006 file - promoters50/4773225
atttagaca

SEQ ID NO: 193489 - DNA, 9 bp, Unknown
  misc_feature (1)..( 9): Result.006 file - promoters50/4773225
atttagctt

SEQ ID NO: 193490 - DNA, 9 bp, Unknown
  misc_feature (1)..( 9): Result.006 file - promoters50/4773225
ttttatctt

SEQ ID NO: 193491 - DNA, 7 bp, Unknown
  misc_feature (1)..( 7): Result.006 file - promoters50/4773225
ctgaaaa

SEQ ID NO: 193492 - DNA, 7 bp, Unknown
  misc_feature (1)..( 7): Result.006 file - promoters50/4773225
atgaaaa

SEQ ID NO: 193493 - DNA, 7 bp, Unknown
  misc_feature (1)..( 7): Result.006 file - promoters50/4773225
ctgaaag

SEQ ID NO: 193494 - DNA, 9 bp, Unknown
  misc_feature (1)..( 9): Result.006 file - promoters50/4773225
aaacaataa

SEQ ID NO: 193495 - DNA, 9 bp, Unknown
  misc_feature (1)..( 9): Result.006 file - promoters50/4773225
aaaaaataa

SEQ ID NO: 193496 - DNA, 9 bp, Unknown
  misc_feature (1)..( 9): Result.006 file - promoters50/4773249
aaagaatat

SEQ ID NO: 193497 - DNA, 8 bp, Unknown
  misc_feature (1)..( 8): Result.006 file - promoters50/4773249
tgtcaatg

SEQ ID NO: 193498 - DNA, 8 bp, Unknown
  misc_feature (1)..( 8): Result.006 file - promoters50/4773249
tttcaatg

SEQ ID NO: 193499 - DNA, 8 bp, Unknown
  misc_feature (1)..( 8): Result.006 file - promoters50/4773299
tttcaata

SEQ ID NO: 193500 - DNA, 8 bp, Unknown
  misc_feature (1)..( 8): Result.006 file - promoters50/4773299
ttctgctt

SEQ ID NO: 193501 - DNA, 8 bp, Unknown
  misc_feature (1)..( 8): Result.006 file - promoters50/4773299
ctcttctt

SEQ ID NO: 193502 - DNA, 8 bp, Unknown
  misc_feature (1)..( 8): Result.006 file - promoters50/4773299
atcttctt

SEQ ID NO: 193503 - DNA, 8 bp, Unknown
  misc_feature (1)..( 8): Result.006 file - promoters50/4773299
atcttcta

SEQ ID NO: 193504 - DNA, 16 bp, Unknown
  misc_feature (1)..( 16): Result.006 file - promoters50/4773299
aagaagctaaccttga

SEQ ID NO: 193505 - DNA, 16 bp, Unknown
  misc_feature (1)..( 16): Result.006 file - promoters50/4773299
gtatgattaagcttgt

SEQ ID NO: 193506 - DNA, 16 bp, Unknown
  misc_feature (1)..( 16): Result.006 file - promoters50/4773299
ctgacaaggaccttga

SEQ ID NO: 193507 - DNA, 16 bp, Unknown
  misc_feature (1)..( 16): Result.006 file - promoters50/4773323
gtatggttatgctacg

SEQ ID NO: 193508 - DNA, 7 bp, Unknown
  misc_feature (1)..( 7): Result.006 file - promoters50/4773323
tttaatt

SEQ ID NO: 193509 - DNA, 7 bp, Unknown
  misc_feature (1)..( 7): Result.006 file - promoters50/4773323
tttaata

SEQ ID NO: 193510 - DNA, 7 bp, Unknown
  misc_feature (1)..( 7): Result.006 file - promoters50/4773323
attaata

SEQ ID NO: 193511 - DNA, 7 bp, Unknown
  misc_feature (1)..( 7): Result.006 file - promoters50/4773323
atttata

SEQ ID NO: 193512 - DNA, 7 bp, Unknown
  misc_feature (1)..( 7): Result.006 file - promoters50/4773323
attaata

SEQ ID NO: 193513 - DNA, 7 bp, Unknown
  misc_feature (1)..( 7): Result.006 file - promoters50/4773331
tttaata

SEQ ID NO: 193514 - DNA, 9 bp, Unknown
  misc_feature (1)..( 9): Result.006 file - promoters50/4773331
ctctcaaat

SEQ ID NO: 193515 - DNA, 9 bp, Unknown
  misc_feature (1)..( 9): Result.006 file - promoters50/4773331
taatcaaat

SEQ ID NO: 193516 - DNA, 9 bp, Unknown
  misc_feature (1)..( 9): Result.006 file - promoters50/4773331
taatgaaac

SEQ ID NO: 193517 - DNA, 9 bp, Unknown
  misc_feature (1)..( 9): Result.006 file - promoters50/4773331
gattcaaat

SEQ ID NO: 193518 - DNA, 9 bp, Unknown
  misc_feature (1)..( 9): Result.006 file - promoters50/4773331
caataaaag

SEQ ID NO: 193519 - DNA, 9 bp, Unknown
  misc_feature (1)..( 9): Result.006 file - promoters50/4773331
aaatgaagc

SEQ ID NO: 193520 - DNA, 9 bp, Unknown
  misc_feature (1)..( 9): Result.006 file - promoters50/4773331
taataaagt

SEQ ID NO: 193521 - DNA, 18 bp, Unknown
  misc_feature (1)..( 18): Result.006 file - promoters50/4773331
acagagacaaaacaatga

SEQ ID NO: 193522 - DNA, 18 bp, Unknown
  misc_feature (1)..( 18): Result.006 file - promoters50/4773331
ctcaagagaaaatttgat

SEQ ID NO: 193523 - DNA, 18 bp, Unknown
  misc_feature (1)..( 18): Result.006 file - promoters50/4773331
atctccacaaaacatcct

SEQ ID NO: 193524 - DNA, 18 bp, Unknown
  misc_feature (1)..( 18): Result.006 file - promoters50/4773331
acagggacagtcgaagtt

SEQ ID NO: 193525 - DNA, 18 bp, Unknown
  misc_feature (1)..( 18): Result.006 file - promoters50/4773331
aagctaagaacattggat

SEQ ID NO: 193526 - DNA, 18 bp, Unknown
  misc_feature (1)..( 18): Result.006 file - promoters50/4773331
gcatagagaatacaatcc

SEQ ID NO: 193527 - DNA, 18 bp, Unknown
  misc_feature (1)..( 18): Result.006 file - promoters50/4773331
agtcatagaaaaattaaa

SEQ ID NO: 193528 - DNA, 9 bp, Unknown
  misc_feature (1)..( 9): Result.006 file - promoters50/4773331
caaaggaag

SEQ ID NO: 193529 - DNA, 9 bp, Unknown
  misc_feature (1)..( 9): Result.006 file - promoters50/4773331
gaaacgaac

SEQ ID NO: 193530 - DNA, 9 bp, Unknown
  misc_feature (1)..( 9): Result.006 file - promoters50/4773331
gaaatgaag

SEQ ID NO: 193531 - DNA, 9 bp, Unknown
  misc_feature (1)..( 9): Result.006 file - promoters50/4773331
aggaggaag

SEQ ID NO: 193532 - DNA, 9 bp, Unknown
  misc_feature (1)..( 9): Result.006 file - promoters50/4773331
ttaataaag

SEQ ID NO: 193533 - DNA, 9 bp, Unknown
  misc_feature (1)..( 9): Result.006 file - promoters50/4773351
gaaatggcc

SEQ ID NO: 193534 - DNA, 8 bp, Unknown
  misc_feature (1)..( 8): Result.006 file - promoters50/4773351
acaaagag

SEQ ID NO: 193535 - DNA, 8 bp, Unknown
  misc_feature (1)..( 8): Result.006 file - promoters50/4773351
ataaagag

SEQ ID NO: 193536 - DNA, 8 bp, Unknown
  misc_feature (1)..( 8): Result.006 file - promoters50/4773355
ataaagaa

SEQ ID NO: 193537 - DNA, 11 bp, Unknown
  misc_feature (1)..( 11): Result.006 file - promoters50/4773355
ctaatttgaac

SEQ ID NO: 193538 - DNA, 11 bp, Unknown
  misc_feature (1)..( 11): Result.006 file - promoters50/4773355
ttacttttaac

SEQ ID NO: 193539 - DNA, 11 bp, Unknown
  misc_feature (1)..( 11): Result.006 file - promoters50/4773355
ttacttttatt

SEQ ID NO: 193540 - DNA, 11 bp, Unknown
  misc_feature (1)..( 11): Result.006 file - promoters50/4773355
gatcttttaat

SEQ ID NO: 193541 - DNA, 11 bp, Unknown
  misc_feature (1)..( 11): Result.006 file - promoters50/4773355
tgggttttaca

SEQ ID NO: 193542 - DNA, 11 bp, Unknown
  misc_feature (1)..( 11): Result.006 file - promoters50/4773384
cgacttttcac

SEQ ID NO: 193543 - DNA, 9 bp, Unknown
  misc_feature (1)..( 9): Result.006 file - promoters50/4773384
cgtaaaaga

SEQ ID NO: 193544 - DNA, 9 bp, Unknown
  misc_feature (1)..( 9): Result.006 file - promoters50/4773384
agaaaaaga

SEQ ID NO: 193545 - DNA, 9 bp, Unknown
  misc_feature (1)..( 9): Result.006 file - promoters50/4773384
agataaagt

SEQ ID NO: 193546 - DNA, 8 bp, Unknown
  misc_feature (1)..( 8): Result.006 file - promoters50/4773384
aaattata

SEQ ID NO: 193547 - DNA, 8 bp, Unknown
  misc_feature (1)..( 8): Result.006 file - promoters50/4773384
aaataata

SEQ ID NO: 193548 - DNA, 8 bp, Unknown
  misc_feature (1)..( 8): Result.006 file - promoters50/4773384
aaaaaata

SEQ ID NO: 193549 - DNA, 9 bp, Unknown
  misc_feature (1)..( 9): Result.006 file - promoters50/4773384
taatttatt

SEQ ID NO: 193550 - DNA, 9 bp, Unknown
  misc_feature (1)..( 9): Result.006 file - promoters50/4773384
taatttaga

SEQ ID NO: 193551 - DNA, 9 bp, Unknown
  misc_feature (1)..( 9): Result.006 file - promoters50/4773384
taatatatt

SEQ ID NO: 193552 - DNA, 7 bp, Unknown
  misc_feature (1)..( 7): Result.006 file - promoters50/4773384
tttcaat

SEQ ID NO: 193553 - DNA, 7 bp, Unknown
  misc_feature (1)..( 7): Result.006 file - promoters50/4773384
tttcaaa

SEQ ID NO: 193554 - DNA, 7 bp, Unknown
  misc_feature (1)..( 7): Result.006 file - promoters50/4773384
tttaaat

SEQ ID NO: 193555 - DNA, 8 bp, Unknown
  misc_feature (1)..( 8): Result.006 file - promoters50/4773384
acacattt

SEQ ID NO: 193556 - DNA, 8 bp, Unknown
  misc_feature (1)..( 8): Result.006 file - promoters50/4773384
acatatta

SEQ ID NO: 193557 - DNA, 8 bp, Unknown
  misc_feature (1)..( 8): Result.006 file - promoters50/4773384
gcatatta

SEQ ID NO: 193558 - DNA, 7 bp, Unknown
  misc_feature (1)..( 7): Result.006 file - promoters50/4773384
caagaaa

SEQ ID NO: 193559 - DNA, 7 bp, Unknown
  misc_feature (1)..( 7): Result.006 file - promoters50/4773384
taagaaa

SEQ ID NO: 193560 - DNA, 7 bp, Unknown
  misc_feature (1)..( 7): Result.006 file - promoters50/4773384
taacaaa

SEQ ID NO: 193561 - DNA, 7 bp, Unknown
  misc_feature (1)..( 7): Result.006 file - promoters50/4773384
catctta

SEQ ID NO: 193562 - DNA, 7 bp, Unknown
  misc_feature (1)..( 7): Result.006 file - promoters50/4773384
catatta

SEQ ID NO: 193563 - DNA, 7 bp, Unknown
  misc_feature (1)..( 7): Result.006 file - promoters50/4773384
catatta

SEQ ID NO: 193564 - DNA, 8 bp, Unknown
  misc_feature (1)..( 8): Result.006 file - promoters50/4773384
caacgaaa

SEQ ID NO: 193565 - DNA, 8 bp, Unknown
  misc_feature (1)..( 8): Result.006 file - promoters50/4773384
gaacaaaa

SEQ ID NO: 193566 - DNA, 8 bp, Unknown
  misc_feature (1)..( 8): Result.006 file - promoters50/4773384
gaaaaaaa

SEQ ID NO: 193567 - DNA, 7 bp, Unknown
  misc_feature (1)..( 7): Result.006 file - promoters50/4773384
attatta

SEQ ID NO: 193568 - DNA, 7 bp, Unknown
  misc_feature (1)..( 7): Result.006 file - promoters50/4773384
tttatta

SEQ ID NO: 193569 - DNA, 7 bp, Unknown
  misc_feature (1)..( 7): Result.006 file - promoters50/4773384
tttattt

SEQ ID NO: 193570 - DNA, 8 bp, Unknown
  misc_feature (1)..( 8): Result.006 file - promoters50/4773384
agaaaaat

SEQ ID NO: 193571 - DNA, 8 bp, Unknown
  misc_feature (1)..( 8): Result.006 file - promoters50/4773384
agaaaaaa

SEQ ID NO: 193572 - DNA, 9 bp, Unknown
  misc_feature (1)..( 9): Result.006 file - promoters50/4773392
ggaacaaaa

SEQ ID NO: 193573 - DNA, 14 bp, Unknown
  misc_feature (1)..( 14): Result.006 file - promoters50/4773392
ttggtaaaatattt

SEQ ID NO: 193574 - DNA, 14 bp, Unknown
  misc_feature (1)..( 14): Result.006 file - promoters50/4773392
aaacaaaaataaat

SEQ ID NO: 193575 - DNA, 14 bp, Unknown
  misc_feature (1)..( 14): Result.006 file - promoters50/4773400
taaacaaaaaaaaa

SEQ ID NO: 193576 - DNA, 10 bp, Unknown
  misc_feature (1)..( 10): Result.006 file - promoters50/4773400
gttttaaaac

SEQ ID NO: 193577 - DNA, 10 bp, Unknown
  misc_feature (1)..( 10): Result.006 file - promoters50/4773400
gaagtaaaac

SEQ ID NO: 193578 - DNA, 10 bp, Unknown
  misc_feature (1)..( 10): Result.006 file - promoters50/4773400
gaaataaaat

SEQ ID NO: 193579 - DNA, 7 bp, Unknown
  misc_feature (1)..( 7): Result.006 file - promoters50/4773400
tatatgc

SEQ ID NO: 193580 - DNA, 7 bp, Unknown
  misc_feature (1)..( 7): Result.006 file - promoters50/4773400
tatttgc

SEQ ID NO: 193581 - DNA, 7 bp, Unknown
  misc_feature (1)..( 7): Result.006 file - promoters50/4773793
ttttttt

SEQ ID NO: 193582 - DNA, 8 bp, Unknown
  misc_feature (1)..( 8): Result.006 file - promoters50/4773793
tataggat

SEQ ID NO: 193583 - DNA, 8 bp, Unknown
  misc_feature (1)..( 8): Result.006 file - promoters50/4773793
aataagat

SEQ ID NO: 193584 - DNA, 8 bp, Unknown
  misc_feature (1)..( 8): Result.006 file - promoters50/4773795
aataagtt

SEQ ID NO: 193585 - DNA, 10 bp, Unknown
  misc_feature (1)..( 10): Result.006 file - promoters50/4773795
ttttaatttt

SEQ ID NO: 193586 - DNA, 10 bp, Unknown
  misc_feature (1)..( 10): Result.006 file - promoters50/4773795
atttgatttt

SEQ ID NO: 193587 - DNA, 11 bp, Unknown
  misc_feature (1)..( 11): Result.006 file - promoters50/4773819
attataatatt

SEQ ID NO: 193588 - DNA, 11 bp, Unknown
  misc_feature (1)..( 11): Result.006 file - promoters50/4773819
aagataattaa

SEQ ID NO: 193589 - DNA, 11 bp, Unknown
  misc_feature (1)..( 11): Result.006 file - promoters50/4773819
aaggtaatctc

SEQ ID NO: 193590 - DNA, 11 bp, Unknown
  misc_feature (1)..( 11): Result.006 file - promoters50/4773819
cagagaatttt

SEQ ID NO: 193591 - DNA, 11 bp, Unknown
  misc_feature (1)..( 11): Result.006 file - promoters50/4773819
tagatatttaa

SEQ ID NO: 193592 - DNA, 9 bp, Unknown
  misc_feature (1)..( 9): Result.006 file - promoters50/4773819
gatttttct

SEQ ID NO: 193593 - DNA, 11 bp, Unknown
  misc_feature (1)..( 11): Result.006 file - promoters50/4773819
atacaatttaa

SEQ ID NO: 193594 - DNA, 11 bp, Unknown
  misc_feature (1)..( 11): Result.006 file - promoters50/4773819
tagacattgat

SEQ ID NO: 193595 - DNA, 13 bp, Unknown
  misc_feature (1)..( 13): Result.006 file - promoters50/4773819
ttggtgaaagagt

SEQ ID NO: 193596 - DNA, 13 bp, Unknown
  misc_feature (1)..( 13): Result.006 file - promoters50/4773819
cttgaaaaagaga

SEQ ID NO: 193597 - DNA, 13 bp, Unknown
  misc_feature (1)..( 13): Result.006 file - promoters50/4773819
ttgatgaatgagg

SEQ ID NO: 193598 - DNA, 13 bp, Unknown
  misc_feature (1)..( 13): Result.006 file - promoters50/4773819
gggtataaaaaga

SEQ ID NO: 193599 - DNA, 13 bp, Unknown
  misc_feature (1)..( 13): Result.006 file - promoters50/4773819
tatatcaaaattt

SEQ ID NO: 193600 - DNA, 13 bp, Unknown
  misc_feature (1)..( 13): Result.006 file - promoters50/4773819
tgtctcaaaatgt

SEQ ID NO: 193601 - DNA, 13 bp, Unknown
  misc_feature (1)..( 13): Result.006 file - promoters50/4773819
agtatctaaacgc

SEQ ID NO: 193602 - DNA, 9 bp, Unknown
  misc_feature (1)..( 9): Result.006 file - promoters50/4773819
gattctttg

SEQ ID NO: 193603 - DNA, 9 bp, Unknown
  misc_feature (1)..( 9): Result.006 file - promoters50/4773819
tcttctttt

SEQ ID NO: 193604 - DNA, 9 bp, Unknown
  misc_feature (1)..( 9): Result.006 file - promoters50/4773819
gatgctttt

SEQ ID NO: 193605 - DNA, 10 bp, Unknown
  misc_feature (1)..( 10): Result.006 file - promoters50/4773819
ggttcatttc

SEQ ID NO: 193606 - DNA, 10 bp, Unknown
  misc_feature (1)..( 10): Result.006 file - promoters50/4773819
tatgatttag

SEQ ID NO: 193607 - DNA, 10 bp, Unknown
  misc_feature (1)..( 10): Result.006 file - promoters50/4773823
gatatagaaa

SEQ ID NO: 193608 - DNA, 10 bp, Unknown
  misc_feature (1)..( 10): Result.006 file - promoters50/4773823
taaaaaccag

SEQ ID NO: 193609 - DNA, 10 bp, Unknown
  misc_feature (1)..( 10): Result.006 file - promoters50/4773823
taaaaacgaa

SEQ ID NO: 193610 - DNA, 10 bp, Unknown
  misc_feature (1)..( 10): Result.006 file - promoters50/4773823
taaaaacaat

SEQ ID NO: 193611 - DNA, 10 bp, Unknown
  misc_feature (1)..( 10): Result.006 file - promoters50/4773823
taaaaattaa

SEQ ID NO: 193612 - DNA, 10 bp, Unknown
  misc_feature (1)..( 10): Result.006 file - promoters50/4773823
aaaaaaaaat

SEQ ID NO: 193613 - DNA, 10 bp, Unknown
  misc_feature (1)..( 10): Result.006 file - promoters50/4773836
atcaaaccaa

SEQ ID NO: 193614 - DNA, 9 bp, Unknown
  misc_feature (1)..( 9): Result.006 file - promoters50/4773836
atttatcgc

SEQ ID NO: 193615 - DNA, 9 bp, Unknown
  misc_feature (1)..( 9): Result.006 file - promoters50/4773836
atttatcat

SEQ ID NO: 193616 - DNA, 9 bp, Unknown
  misc_feature (1)..( 9): Result.006 file - promoters50/4773836
ttttatcat

SEQ ID NO: 193617 - DNA, 9 bp, Unknown
  misc_feature (1)..( 9): Result.006 file - promoters50/4773836
gtcaaatcc

SEQ ID NO: 193618 - DNA, 9 bp, Unknown
  misc_feature (1)..( 9): Result.006 file - promoters50/4773836
gtcaaaaaa

SEQ ID NO: 193619 - DNA, 9 bp, Unknown
  misc_feature (1)..( 9): Result.006 file - promoters50/4773846
ctcaaaaaa

SEQ ID NO: 193620 - DNA, 10 bp, Unknown
  misc_feature (1)..( 10): Result.006 file - promoters50/4773846
tattaaaaaa

SEQ ID NO: 193621 - DNA, 10 bp, Unknown
  misc_feature (1)..( 10): Result.006 file - promoters50/4773846
tattaaaaaa

SEQ ID NO: 193622 - DNA, 10 bp, Unknown
  misc_feature (1)..( 10): Result.006 file - promoters50/4773846
tatgaaattc

SEQ ID NO: 193623 - DNA, 10 bp, Unknown
  misc_feature (1)..( 10): Result.006 file - promoters50/4773846
gatgaaaaaa

SEQ ID NO: 193624 - DNA, 9 bp, Unknown
  misc_feature (1)..( 9): Result.006 file - promoters50/4773846
atatatttt

SEQ ID NO: 193625 - DNA, 9 bp, Unknown
  misc_feature (1)..( 9): Result.006 file - promoters50/4773846
ttatattgt

SEQ ID NO: 193626 - DNA, 9 bp, Unknown
  misc_feature (1)..( 9): Result.006 file - promoters50/4773846
ttatctttt

SEQ ID NO: 193627 - DNA, 9 bp, Unknown
  misc_feature (1)..( 9): Result.006 file - promoters50/4773846
atatatttt

SEQ ID NO: 193628 - DNA, 8 bp, Unknown
  misc_feature (1)..( 8): Result.006 file - promoters50/4773846
aatacaac

SEQ ID NO: 193629 - DNA, 8 bp, Unknown
  misc_feature (1)..( 8): Result.006 file - promoters50/4773846
tatagaac

SEQ ID NO: 193630 - DNA, 8 bp, Unknown
  misc_feature (1)..( 8): Result.006 file - promoters50/4773846
aattcaaa

SEQ ID NO: 193631 - DNA, 8 bp, Unknown
  misc_feature (1)..( 8): Result.006 file - promoters50/4773846
aattaaaa

SEQ ID NO: 193632 - DNA, 9 bp, Unknown
  misc_feature (1)..( 9): Result.006 file - promoters50/4773846
atttgatct

SEQ ID NO: 193633 - DNA, 9 bp, Unknown
  misc_feature (1)..( 9): Result.006 file - promoters50/4773846
attttatct

SEQ ID NO: 193634 - DNA, 9 bp, Unknown
  misc_feature (1)..( 9): Result.006 file - promoters50/4773846
tttttataa

SEQ ID NO: 193635 - DNA, 9 bp, Unknown
  misc_feature (1)..( 9): Result.006 file - promoters50/4773846
attttaggt

SEQ ID NO: 193636 - DNA, 7 bp, Unknown
  misc_feature (1)..( 7): Result.006 file - promoters50/4773846
acagcaa

SEQ ID NO: 193637 - DNA, 7 bp, Unknown
  misc_feature (1)..( 7): Result.006 file - promoters50/4773846
tcagcaa

SEQ ID NO: 193638 - DNA, 7 bp, Unknown
  misc_feature (1)..( 7): Result.006 file - promoters50/4773846
acagcat

SEQ ID NO: 193639 - DNA, 8 bp, Unknown
  misc_feature (1)..( 8): Result.006 file - promoters50/4773846
aatcaaat

SEQ ID NO: 193640 - DNA, 8 bp, Unknown
  misc_feature (1)..( 8): Result.006 file - promoters50/4773846
aattaaaa

SEQ ID NO: 193641 - DNA, 8 bp, Unknown
  misc_feature (1)..( 8): Result.006 file - promoters50/4773846
cattaaaa

SEQ ID NO: 193642 - DNA, 13 bp, Unknown
  misc_feature (1)..( 13): Result.006 file - promoters50/4773846
atttgatacttta

SEQ ID NO: 193643 - DNA, 13 bp, Unknown
  misc_feature (1)..( 13): Result.006 file - promoters50/4773846
attagataatttt

SEQ ID NO: 193644 - DNA, 13 bp, Unknown
  misc_feature (1)..( 13): Result.006 file - promoters50/4773846
agtgtatacatta

SEQ ID NO: 193645 - DNA, 8 bp, Unknown
  misc_feature (1)..( 8): Result.006 file - promoters50/4773846
attcaaag

SEQ ID NO: 193646 - DNA, 8 bp, Unknown
  misc_feature (1)..( 8): Result.006 file - promoters50/4773846
attcaaat

SEQ ID NO: 193647 - DNA, 8 bp, Unknown
  misc_feature (1)..( 8): Result.006 file - promoters50/4773846
tctcaaat

SEQ ID NO: 193648 - DNA, 9 bp, Unknown
  misc_feature (1)..( 9): Result.006 file - promoters50/4773846
aaattcaag

SEQ ID NO: 193649 - DNA, 9 bp, Unknown
  misc_feature (1)..( 9): Result.006 file - promoters50/4773846
aaattcaaa

SEQ ID NO: 193650 - DNA, 9 bp, Unknown
  misc_feature (1)..( 9): Result.006 file - promoters50/4773846
ttattaaaa

SEQ ID NO: 193651 - DNA, 9 bp, Unknown
  misc_feature (1)..( 9): Result.006 file - promoters50/4773846
ttgatttat

SEQ ID NO: 193652 - DNA, 9 bp, Unknown
  misc_feature (1)..( 9): Result.006 file - promoters50/4773846
aatatttat

SEQ ID NO: 193653 - DNA, 9 bp, Unknown
  misc_feature (1)..( 9): Result.006 file - promoters50/4773846
aataattat

SEQ ID NO: 193654 - DNA, 7 bp, Unknown
  misc_feature (1)..( 7): Result.006 file - promoters50/4773846
aaaaata

SEQ ID NO: 193655 - DNA, 7 bp, Unknown
  misc_feature (1)..( 7): Result.006 file - promoters50/4773846
aaagata

SEQ ID NO: 193656 - DNA, 7 bp, Unknown
  misc_feature (1)..( 7): Result.006 file - promoters50/4773846
aaagatg

SEQ ID NO: 193657 - DNA, 7 bp, Unknown
  misc_feature (1)..( 7): Result.006 file - promoters50/4773846
catctat

SEQ ID NO: 193658 - DNA, 7 bp, Unknown
  misc_feature (1)..( 7): Result.006 file - promoters50/4773846
tatctat

SEQ ID NO: 193659 - DNA, 7 bp, Unknown
  misc_feature (1)..( 7): Result.006 file - promoters50/4773846
tatatat

SEQ ID NO: 193660 - DNA, 8 bp, Unknown
  misc_feature (1)..( 8): Result.006 file - promoters50/4773846
taaatata

SEQ ID NO: 193661 - DNA, 8 bp, Unknown
  misc_feature (1)..( 8): Result.006 file - promoters50/4773846
taactata

SEQ ID NO: 193662 - DNA, 8 bp, Unknown
  misc_feature (1)..( 8): Result.006 file - promoters50/4773846
acactata

SEQ ID NO: 193663 - DNA, 10 bp, Unknown
  misc_feature (1)..( 10): Result.006 file - promoters50/4773846
atgcatgatg

SEQ ID NO: 193664 - DNA, 10 bp, Unknown
  misc_feature (1)..( 10): Result.006 file - promoters50/4773846
atgcatgtaa

SEQ ID NO: 193665 - DNA, 10 bp, Unknown
  misc_feature (1)..( 10): Result.006 file - promoters50/4773846
ttgcatttaa

SEQ ID NO: 193666 - DNA, 8 bp, Unknown
  misc_feature (1)..( 8): Result.006 file - promoters50/4773846
tgtaatat

SEQ ID NO: 193667 - DNA, 8 bp, Unknown
  misc_feature (1)..( 8): Result.006 file - promoters50/4773846
actaatat

SEQ ID NO: 193668 - DNA, 9 bp, Unknown
  misc_feature (1)..( 9): Result.006 file - promoters50/4773846
aataattat

SEQ ID NO: 193669 - DNA, 7 bp, Unknown
  misc_feature (1)..( 7): Result.006 file - promoters50/4773846
aattaag

SEQ ID NO: 193670 - DNA, 7 bp, Unknown
  misc_feature (1)..( 7): Result.006 file - promoters50/4773846
aattaaa

SEQ ID NO: 193671 - DNA, 8 bp, Unknown
  misc_feature (1)..( 8): Result.006 file - promoters50/4801635
aattcaaa

SEQ ID NO: 193672 - DNA, 12 bp, Unknown
  misc_feature (1)..( 12): Result.006 file - promoters50/4801635
aactgaaatttt

SEQ ID NO: 193673 - DNA, 12 bp, Unknown
  misc_feature (1)..( 12): Result.006 file - promoters50/4801635
aactcaaataac

SEQ ID NO: 193674 - DNA, 12 bp, Unknown
  misc_feature (1)..( 12): Result.006 file - promoters50/4801635
tgttgaattttt

SEQ ID NO: 193675 - DNA, 13 bp, Unknown
  misc_feature (1)..( 13): Result.006 file - promoters50/4801635
attttaggaaact

SEQ ID NO: 193676 - DNA, 13 bp, Unknown
  misc_feature (1)..( 13): Result.006 file - promoters50/4801635
caactagaaaact

SEQ ID NO: 193677 - DNA, 13 bp, Unknown
  misc_feature (1)..( 13): Result.006 file - promoters50/4801635
caactagaagaaa

SEQ ID NO: 193678 - DNA, 7 bp, Unknown
  misc_feature (1)..( 7): Result.006 file - promoters50/4801635
tgtattt

SEQ ID NO: 193679 - DNA, 7 bp, Unknown
  misc_feature (1)..( 7): Result.006 file - promoters50/4801635
tgttttt

SEQ ID NO: 193680 - DNA, 7 bp, Unknown
  misc_feature (1)..( 7): Result.006 file - promoters50/4801635
tgtattc

SEQ ID NO: 193681 - DNA, 9 bp, Unknown
  misc_feature (1)..( 9): Result.006 file - promoters50/4801635
tttgaaaca

SEQ ID NO: 193682 - DNA, 9 bp, Unknown
  misc_feature (1)..( 9): Result.006 file - promoters50/4801635
tttgcaaca

SEQ ID NO: 193683 - DNA, 9 bp, Unknown
  misc_feature (1)..( 9): Result.006 file - promoters50/4801635
tttgaaagg

SEQ ID NO: 193684 - DNA, 9 bp, Unknown
  misc_feature (1)..( 9): Result.006 file - promoters50/4801635
ttaagaact

SEQ ID NO: 193685 - DNA, 9 bp, Unknown
  misc_feature (1)..( 9): Result.006 file - promoters50/4801635
ttaagaaaa

SEQ ID NO: 193686 - DNA, 9 bp, Unknown
  misc_feature (1)..( 9): Result.006 file - promoters50/4801635
ttaacaaaa

SEQ ID NO: 193687 - DNA, 10 bp, Unknown
  misc_feature (1)..( 10): Result.006 file - promoters50/4801635
acaactgaaa

SEQ ID NO: 193688 - DNA, 10 bp, Unknown
  misc_feature (1)..( 10): Result.006 file - promoters50/4801635
acaactagaa

SEQ ID NO: 193689 - DNA, 10 bp, Unknown
  misc_feature (1)..( 10): Result.006 file - promoters50/4801635
tcaactagaa

SEQ ID NO: 193690 - DNA, 13 bp, Unknown
  misc_feature (1)..( 13): Result.006 file - promoters50/4801635
actttgacattat

SEQ ID NO: 193691 - DNA, 13 bp, Unknown
  misc_feature (1)..( 13): Result.006 file - promoters50/4801635
ataaaaccattat

SEQ ID NO: 193692 - DNA, 13 bp, Unknown
  misc_feature (1)..( 13): Result.006 file - promoters50/4801635
ataacaccgttaa

SEQ ID NO: 193693 - DNA, 13 bp, Unknown
  misc_feature (1)..( 13): Result.006 file - promoters50/4801635
gggtcacggttgt

SEQ ID NO: 193694 - DNA, 14 bp, Unknown
  misc_feature (1)..( 14): Result.006 file - promoters50/4801635
ctttttctcttctt

SEQ ID NO: 193695 - DNA, 14 bp, Unknown
  misc_feature (1)..( 14): Result.006 file - promoters50/4801635
ctttgtctcgtctt

SEQ ID NO: 193696 - DNA, 14 bp, Unknown
  misc_feature (1)..( 14): Result.006 file - promoters50/4801635
gatctcatcttcta

SEQ ID NO: 193697 - DNA, 6 bp, Unknown
  misc_feature (1)..( 6): Result.006 file - promoters50/4801635
aaaata

SEQ ID NO: 193698 - DNA, 6 bp, Unknown
  misc_feature (1)..( 6): Result.006 file - promoters50/4801635
aaaata

SEQ ID NO: 193699 - DNA, 6 bp, Unknown
  misc_feature (1)..( 6): Result.006 file - promoters50/4801635
aaaata

SEQ ID NO: 193700 - DNA, 13 bp, Unknown
  misc_feature (1)..( 13): Result.006 file - promoters50/4801635
atttttagttcac

SEQ ID NO: 193701 - DNA, 13 bp, Unknown
  misc_feature (1)..( 13): Result.006 file - promoters50/4801635
atttttttttttt

SEQ ID NO: 193702 - DNA, 13 bp, Unknown
  misc_feature (1)..( 13): Result.006 file - promoters50/4802537
ttttgtaggtcac

SEQ ID NO: 193703 - DNA, 10 bp, Unknown
  misc_feature (1)..( 10): Result.006 file - promoters50/4802537
tatataaagt

SEQ ID NO: 193704 - DNA, 10 bp, Unknown
  misc_feature (1)..( 10): Result.006 file - promoters50/4802537
tatttaaaca

SEQ ID NO: 193705 - DNA, 10 bp, Unknown
  misc_feature (1)..( 10): Result.006 file - promoters50/4802537
atattaaata

SEQ ID NO: 193706 - DNA, 10 bp, Unknown
  misc_feature (1)..( 10): Result.006 file - promoters50/4802537
gctataaaag

SEQ ID NO: 193707 - DNA, 10 bp, Unknown
  misc_feature (1)..( 10): Result.006 file - promoters50/4802537
gtaataaaga

SEQ ID NO: 193708 - DNA, 10 bp, Unknown
  misc_feature (1)..( 10): Result.006 file - promoters50/4803329
tttataaaaa

SEQ ID NO: 193709 - DNA, 10 bp, Unknown
  misc_feature (1)..( 10): Result.006 file - promoters50/4803329
taaagacaaa

SEQ ID NO: 193710 - DNA, 10 bp, Unknown
  misc_feature (1)..( 10): Result.006 file - promoters50/4803329
aaaaaacaca

SEQ ID NO: 193711 - DNA, 10 bp, Unknown
  misc_feature (1)..( 10): Result.006 file - promoters50/4803329
taaagatgat

SEQ ID NO: 193712 - DNA, 10 bp, Unknown
  misc_feature (1)..( 10): Result.006 file - promoters50/4803329
caaaaaatta

SEQ ID NO: 193713 - DNA, 10 bp, Unknown
  misc_feature (1)..( 10): Result.006 file - promoters50/4803329
taaaataaca

SEQ ID NO: 193714 - DNA, 10 bp, Unknown
  misc_feature (1)..( 10): Result.006 file - promoters50/4803329
taaaataaaa

SEQ ID NO: 193715 - DNA, 10 bp, Unknown
  misc_feature (1)..( 10): Result.006 file - promoters50/4803329
caaacatgag

SEQ ID NO: 193716 - DNA, 10 bp, Unknown
  misc_feature (1)..( 10): Result.006 file - promoters50/4803329
caaacagttt

SEQ ID NO: 193717 - DNA, 10 bp, Unknown
  misc_feature (1)..( 10): Result.006 file - promoters50/4803329
aaaaaatggt

SEQ ID NO: 193718 - DNA, 10 bp, Unknown
  misc_feature (1)..( 10): Result.006 file - promoters50/4803329
taaagagttt

SEQ ID NO: 193719 - DNA, 10 bp, Unknown
  misc_feature (1)..( 10): Result.006 file - promoters50/4803329
taaaaaaaaa

SEQ ID NO: 193720 - DNA, 10 bp, Unknown
  misc_feature (1)..( 10): Result.006 file - promoters50/4803329
gaaagaatca

SEQ ID NO: 193721 - DNA, 12 bp, Unknown
  misc_feature (1)..( 12): Result.006 file - promoters50/4803329
gaagacaaacca

SEQ ID NO: 193722 - DNA, 12 bp, Unknown
  misc_feature (1)..( 12): Result.006 file - promoters50/4803329
ttctacaaactg

SEQ ID NO: 193723 - DNA, 12 bp, Unknown
  misc_feature (1)..( 12): Result.006 file - promoters50/4803329
gaagataaagaa

SEQ ID NO: 193724 - DNA, 12 bp, Unknown
  misc_feature (1)..( 12): Result.006 file - promoters50/4803329
acgactaaaaaa

SEQ ID NO: 193725 - DNA, 12 bp, Unknown
  misc_feature (1)..( 12): Result.006 file - promoters50/4803329
cataacaaaaaa

SEQ ID NO: 193726 - DNA, 12 bp, Unknown
  misc_feature (1)..( 12): Result.006 file - promoters50/4803329
atctataaatag

SEQ ID NO: 193727 - DNA, 12 bp, Unknown
  misc_feature (1)..( 12): Result.006 file - promoters50/4803451
gtggataaaatt

SEQ ID NO: 193728 - DNA, 8 bp, Unknown
  misc_feature (1)..( 8): Result.006 file - promoters50/4803451
tttataaa

SEQ ID NO: 193729 - DNA, 8 bp, Unknown
  misc_feature (1)..( 8): Result.006 file - promoters50/4803451
cttataaa

SEQ ID NO: 193730 - DNA, 8 bp, Unknown
  misc_feature (1)..( 8): Result.006 file - promoters50/4803451
cttataac

SEQ ID NO: 193731 - DNA, 8 bp, Unknown
  misc_feature (1)..( 8): Result.006 file - promoters50/4803451
tatacatt

SEQ ID NO: 193732 - DNA, 8 bp, Unknown
  misc_feature (1)..( 8): Result.006 file - promoters50/4803451
tataaatt

SEQ ID NO: 193733 - DNA, 8 bp, Unknown
  misc_feature (1)..( 8): Result.006 file - promoters50/4806023
tataaatc

SEQ ID NO: 193734 - DNA, 10 bp, Unknown
  misc_feature (1)..( 10): Result.006 file - promoters50/4806023
atcttgaata

SEQ ID NO: 193735 - DNA, 10 bp, Unknown
  misc_feature (1)..( 10): Result.006 file - promoters50/4806023
atcttgattt

SEQ ID NO: 193736 - DNA, 10 bp, Unknown
  misc_feature (1)..( 10): Result.006 file - promoters50/4806023
ctctttattt

SEQ ID NO: 193737 - DNA, 7 bp, Unknown
  misc_feature (1)..( 7): Result.006 file - promoters50/4806023
gaccgtt

SEQ ID NO: 193738 - DNA, 7 bp, Unknown
  misc_feature (1)..( 7): Result.006 file - promoters50/4806023
gaccgtg

SEQ ID NO: 193739 - DNA, 7 bp, Unknown
  misc_feature (1)..( 7): Result.006 file - promoters50/4806023
aaccgtt

SEQ ID NO: 193740 - DNA, 9 bp, Unknown
  misc_feature (1)..( 9): Result.006 file - promoters50/4806023
cagtttttg

SEQ ID NO: 193741 - DNA, 9 bp, Unknown
  misc_feature (1)..( 9): Result.006 file - promoters50/4806023
cagctttag

SEQ ID NO: 193742 - DNA, 9 bp, Unknown
  misc_feature (1)..( 9): Result.006 file - promoters50/4806023
aagctgtag

SEQ ID NO: 193743 - DNA, 6 bp, Unknown
  misc_feature (1)..( 6): Result.006 file - promoters50/4806023
ggccca

SEQ ID NO: 193744 - DNA, 6 bp, Unknown
  misc_feature (1)..( 6): Result.006 file - promoters50/4806023
ggccca

SEQ ID NO: 193745 - DNA, 6 bp, Unknown
  misc_feature (1)..( 6): Result.006 file - promoters50/4807018
ggccca

SEQ ID NO: 193746 - DNA, 13 bp, Unknown
  misc_feature (1)..( 13): Result.006 file - promoters50/4807018
tgaacattttttc

SEQ ID NO: 193747 - DNA, 13 bp, Unknown
  misc_feature (1)..( 13): Result.006 file - promoters50/4807018
tgaaaatttatac

SEQ ID NO: 193748 - DNA, 13 bp, Unknown
  misc_feature (1)..( 13): Result.006 file - promoters50/4807018
aagaaatttattc

SEQ ID NO: 193749 - DNA, 13 bp, Unknown
  misc_feature (1)..( 13): Result.006 file - promoters50/4807018
caataatttacat

SEQ ID NO: 193750 - DNA, 13 bp, Unknown
  misc_feature (1)..( 13): Result.006 file - promoters50/4807018
gtataattttata

SEQ ID NO: 193751 - DNA, 13 bp, Unknown
  misc_feature (1)..( 13): Result.006 file - promoters50/4807026
gttgatttttttc

SEQ ID NO: 193752 - DNA, 12 bp, Unknown
  misc_feature (1)..( 12): Result.006 file - promoters50/4807026
ggtcaaaaattc

SEQ ID NO: 193753 - DNA, 12 bp, Unknown
  misc_feature (1)..( 12): Result.006 file - promoters50/4807026
agctaaaatttc

SEQ ID NO: 193754 - DNA, 12 bp, Unknown
  misc_feature (1)..( 12): Result.006 file - promoters50/4807026
tgacaaaaaaag

SEQ ID NO: 193755 - DNA, 12 bp, Unknown
  misc_feature (1)..( 12): Result.006 file - promoters50/4807026
tttaaaaattaa

SEQ ID NO: 193756 - DNA, 12 bp, Unknown
  misc_feature (1)..( 12): Result.006 file - promoters50/4807026
tttcaaaatggt

SEQ ID NO: 193757 - DNA, 12 bp, Unknown
  misc_feature (1)..( 12): Result.006 file - promoters50/4807026
acccaaaattga

SEQ ID NO: 193758 - DNA, 15 bp, Unknown
  misc_feature (1)..( 15): Result.006 file - promoters50/4807026
aaaaaaaaacttata

SEQ ID NO: 193759 - DNA, 15 bp, Unknown
  misc_feature (1)..( 15): Result.006 file - promoters50/4807026
agcctcaaacatata

SEQ ID NO: 193760 - DNA, 15 bp, Unknown
  misc_feature (1)..( 15): Result.006 file - promoters50/4807026
aacaataaaattaat

SEQ ID NO: 193761 - DNA, 15 bp, Unknown
  misc_feature (1)..( 15): Result.006 file - promoters50/4807026
gcggccaaacctttt

SEQ ID NO: 193762 - DNA, 15 bp, Unknown
  misc_feature (1)..( 15): Result.006 file - promoters50/4807026
tgattaaaacattat

SEQ ID NO: 193763 - DNA, 15 bp, Unknown
  misc_feature (1)..( 15): Result.006 file - promoters50/4807026
aaaaagaaagatatc

SEQ ID NO: 193764 - DNA, 15 bp, Unknown
  misc_feature (1)..( 15): Result.006 file - promoters50/4807026
aaatagaaatatagg

SEQ ID NO: 193765 - DNA, 10 bp, Unknown
  misc_feature (1)..( 10): Result.006 file - promoters50/4807026
tgtaaaaata

SEQ ID NO: 193766 - DNA, 10 bp, Unknown
  misc_feature (1)..( 10): Result.006 file - promoters50/4807026
tgtgaaatag

SEQ ID NO: 193767 - DNA, 10 bp, Unknown
  misc_feature (1)..( 10): Result.006 file - promoters50/4807026
tttaaaaatt

SEQ ID NO: 193768 - DNA, 10 bp, Unknown
  misc_feature (1)..( 10): Result.006 file - promoters50/4807026
agctaaaatt

SEQ ID NO: 193769 - DNA, 10 bp, Unknown
  misc_feature (1)..( 10): Result.006 file - promoters50/4807026
agtgaattag

SEQ ID NO: 193770 - DNA, 10 bp, Unknown
  misc_feature (1)..( 10): Result.006 file - promoters50/4807026
ttggaattaa

SEQ ID NO: 193771 - DNA, 10 bp, Unknown
  misc_feature (1)..( 10): Result.006 file - promoters50/4807026
cccaaaattg

SEQ ID NO: 193772 - DNA, 11 bp, Unknown
  misc_feature (1)..( 11): Result.006 file - promoters50/4807026
tgtaaaaataa

SEQ ID NO: 193773 - DNA, 11 bp, Unknown
  misc_feature (1)..( 11): Result.006 file - promoters50/4807026
tagaaatatag

SEQ ID NO: 193774 - DNA, 11 bp, Unknown
  misc_feature (1)..( 11): Result.006 file - promoters50/4807026
tttaaaaatta

SEQ ID NO: 193775 - DNA, 11 bp, Unknown
  misc_feature (1)..( 11): Result.006 file - promoters50/4807026
gacaaaaaaag

SEQ ID NO: 193776 - DNA, 11 bp, Unknown
  misc_feature (1)..( 11): Result.006 file - promoters50/4807026
agctaaaattt

SEQ ID NO: 193777 - DNA, 11 bp, Unknown
  misc_feature (1)..( 11): Result.006 file - promoters50/4807026
tttcaaaatgg

SEQ ID NO: 193778 - DNA, 11 bp, Unknown
  misc_feature (1)..( 11): Result.006 file - promoters50/4807026
acccaaaattg

SEQ ID NO: 193779 - DNA, 10 bp, Unknown
  misc_feature (1)..( 10): Result.006 file - promoters50/4807026
ttaaattaaa

SEQ ID NO: 193780 - DNA, 10 bp, Unknown
  misc_feature (1)..( 10): Result.006 file - promoters50/4807026
ctcaatcaaa

SEQ ID NO: 193781 - DNA, 10 bp, Unknown
  misc_feature (1)..( 10): Result.006 file - promoters50/4807026
tttaataaac

SEQ ID NO: 193782 - DNA, 10 bp, Unknown
  misc_feature (1)..( 10): Result.006 file - promoters50/4807026
cctaattaac

SEQ ID NO: 193783 - DNA, 10 bp, Unknown
  misc_feature (1)..( 10): Result.006 file - promoters50/4807026
caaaatcaaa

SEQ ID NO: 193784 - DNA, 10 bp, Unknown
  misc_feature (1)..( 10): Result.006 file - promoters50/4807026
tttaattttc

SEQ ID NO: 193785 - DNA, 9 bp, Unknown
  misc_feature (1)..( 9): Result.006 file - promoters50/4807026
aataaatga

SEQ ID NO: 193786 - DNA, 9 bp, Unknown
  misc_feature (1)..( 9): Result.006 file - promoters50/4807026
tttaaatgt

SEQ ID NO: 193787 - DNA, 9 bp, Unknown
  misc_feature (1)..( 9): Result.006 file - promoters50/4807026
aattaatct

SEQ ID NO: 193788 - DNA, 9 bp, Unknown
  misc_feature (1)..( 9): Result.006 file - promoters50/4807026
ttttaatat

SEQ ID NO: 193789 - DNA, 9 bp, Unknown
  misc_feature (1)..( 9): Result.006 file - promoters50/4807026
aattaatat

SEQ ID NO: 193790 - DNA, 9 bp, Unknown
  misc_feature (1)..( 9): Result.006 file - promoters50/4807054
ttttattct

SEQ ID NO: 193791 - DNA, 9 bp, Unknown
  misc_feature (1)..( 9): Result.006 file - promoters50/4807054
ttttaagaa

SEQ ID NO: 193792 - DNA, 9 bp, Unknown
  misc_feature (1)..( 9): Result.006 file - promoters50/4807054
gtttatgaa

SEQ ID NO: 193793 - DNA, 9 bp, Unknown
  misc_feature (1)..( 9): Result.006 file - promoters50/4807054
atttattaa

SEQ ID NO: 193794 - DNA, 9 bp, Unknown
  misc_feature (1)..( 9): Result.006 file - promoters50/4807054
ttttaataa

SEQ ID NO: 193795 - DNA, 9 bp, Unknown
  misc_feature (1)..( 9): Result.006 file - promoters50/4807054
atttgttat

SEQ ID NO: 193796 - DNA, 9 bp, Unknown
  misc_feature (1)..( 9): Result.006 file - promoters50/4807258
gcttgttac

SEQ ID NO: 193797 - DNA, 9 bp, Unknown
  misc_feature (1)..( 9): Result.006 file - promoters50/4807258
tcttgtttc

SEQ ID NO: 193798 - DNA, 9 bp, Unknown
  misc_feature (1)..( 9): Result.006 file - promoters50/4807258
tctcgttgt

SEQ ID NO: 193799 - DNA, 9 bp, Unknown
  misc_feature (1)..( 9): Result.006 file - promoters50/4807258
acttttttg

SEQ ID NO: 193800 - DNA, 9 bp, Unknown
  misc_feature (1)..( 9): Result.006 file - promoters50/4807258
gtttgttta

SEQ ID NO: 193801 - DNA, 9 bp, Unknown
  misc_feature (1)..( 9): Result.006 file - promoters50/4807258
aattttttg

SEQ ID NO: 193802 - DNA, 9 bp, Unknown
  misc_feature (1)..( 9): Result.006 file - promoters50/4807258
actttttgt

SEQ ID NO: 193803 - DNA, 10 bp, Unknown
  misc_feature (1)..( 10): Result.006 file - promoters50/4807258
gtttcgttcc

SEQ ID NO: 193804 - DNA, 10 bp, Unknown
  misc_feature (1)..( 10): Result.006 file - promoters50/4807258
tttttgttgt

SEQ ID NO: 193805 - DNA, 10 bp, Unknown
  misc_feature (1)..( 10): Result.006 file - promoters50/4807258
tttttgtgtt

SEQ ID NO: 193806 - DNA, 11 bp, Unknown
  misc_feature (1)..( 11): Result.006 file - promoters50/4807258
attgttgttct

SEQ ID NO: 193807 - DNA, 11 bp, Unknown
  misc_feature (1)..( 11): Result.006 file - promoters50/4807258
ttttttgagct

SEQ ID NO: 193808 - DNA, 11 bp, Unknown
  misc_feature (1)..( 11): Result.006 file - promoters50/4807258
cggtttgttta

SEQ ID NO: 193809 - DNA, 11 bp, Unknown
  misc_feature (1)..( 11): Result.006 file - promoters50/4807258
tctatttaata

SEQ ID NO: 193810 - DNA, 11 bp, Unknown
  misc_feature (1)..( 11): Result.006 file - promoters50/4807258
actatttgata

SEQ ID NO: 193811 - DNA, 11 bp, Unknown
  misc_feature (1)..( 11): Result.006 file - promoters50/4807258
acggtttaatc

SEQ ID NO: 193812 - DNA, 11 bp, Unknown
  misc_feature (1)..( 11): Result.006 file - promoters50/4807258
caaatttaatt

SEQ ID NO: 193813 - DNA, 11 bp, Unknown
  misc_feature (1)..( 11): Result.006 file - promoters50/4807258
tctatttcaat

SEQ ID NO: 193814 - DNA, 11 bp, Unknown
  misc_feature (1)..( 11): Result.006 file - promoters50/4807258
acaatctaatt

SEQ ID NO: 193815 - DNA, 11 bp, Unknown
  misc_feature (1)..( 11): Result.006 file - promoters50/4809022
actttttgtgt

SEQ ID NO: 193816 - DNA, 7 bp, Unknown
  misc_feature (1)..( 7): Result.006 file - promoters50/4809022
ttaacat

SEQ ID NO: 193817 - DNA, 7 bp, Unknown
  misc_feature (1)..( 7): Result.006 file - promoters50/4809022
ttaccat

SEQ ID NO: 193818 - DNA, 7 bp, Unknown
  misc_feature (1)..( 7): Result.006 file - promoters50/4809022
ttaccaa

SEQ ID NO: 193819 - DNA, 6 bp, Unknown
  misc_feature (1)..( 6): Result.006 file - promoters50/4809022
aaaaat

SEQ ID NO: 193820 - DNA, 6 bp, Unknown
  misc_feature (1)..( 6): Result.006 file - promoters50/4809022
aaaaat

SEQ ID NO: 193821 - DNA, 6 bp, Unknown
  misc_feature (1)..( 6): Result.006 file - promoters50/4809022
aaaaat

SEQ ID NO: 193822 - DNA, 8 bp, Unknown
  misc_feature (1)..( 8): Result.006 file - promoters50/4809022
atcatata

SEQ ID NO: 193823 - DNA, 8 bp, Unknown
  misc_feature (1)..( 8): Result.006 file - promoters50/4809022
gtcaaata

SEQ ID NO: 193824 - DNA, 8 bp, Unknown
  misc_feature (1)..( 8): Result.006 file - promoters50/4809022
ataaaaag

SEQ ID NO: 193825 - DNA, 9 bp, Unknown
  misc_feature (1)..( 9): Result.006 file - promoters50/4809022
tatataata

SEQ ID NO: 193826 - DNA, 9 bp, Unknown
  misc_feature (1)..( 9): Result.006 file - promoters50/4809022
tatctaata

SEQ ID NO: 193827 - DNA, 9 bp, Unknown
  misc_feature (1)..( 9): Result.006 file - promoters50/4809022
taaaaaaat

SEQ ID NO: 193828 - DNA, 11 bp, Unknown
  misc_feature (1)..( 11): Result.006 file - promoters50/4809022
ataatttgatg

SEQ ID NO: 193829 - DNA, 11 bp, Unknown
  misc_feature (1)..( 11): Result.006 file - promoters50/4809022
aaactttgatt

SEQ ID NO: 193830 - DNA, 11 bp, Unknown
  misc_feature (1)..( 11): Result.006 file - promoters50/4809801
aaacttttatt

SEQ ID NO: 193831 - DNA, 8 bp, Unknown
  misc_feature (1)..( 8): Result.006 file - promoters50/4809801
attgccat

SEQ ID NO: 193832 - DNA, 8 bp, Unknown
  misc_feature (1)..( 8): Result.006 file - promoters50/4809801
attgcctc

SEQ ID NO: 193833 - DNA, 8 bp, Unknown
  misc_feature (1)..( 8): Result.006 file - promoters50/4809801
atttccat

SEQ ID NO: 193834 - DNA, 9 bp, Unknown
  misc_feature (1)..( 9): Result.006 file - promoters50/4809801
caaaatgta

SEQ ID NO: 193835 - DNA, 9 bp, Unknown
  misc_feature (1)..( 9): Result.006 file - promoters50/4809801
caaaatgaa

SEQ ID NO: 193836 - DNA, 9 bp, Unknown
  misc_feature (1)..( 9): Result.006 file - promoters50/4809801
tcaaatgaa

SEQ ID NO: 193837 - DNA, 7 bp, Unknown
  misc_feature (1)..( 7): Result.006 file - promoters50/4809801
cttttgc

SEQ ID NO: 193838 - DNA, 7 bp, Unknown
  misc_feature (1)..( 7): Result.006 file - promoters50/4809801
tttttgc

SEQ ID NO: 193839 - DNA, 8 bp, Unknown
  misc_feature (1)..( 8): Result.006 file - promoters50/4809801
gttattgt

SEQ ID NO: 193840 - DNA, 7 bp, Unknown
  misc_feature (1)..( 7): Result.006 file - promoters50/4809801
agatctc

SEQ ID NO: 193841 - DNA, 7 bp, Unknown
  misc_feature (1)..( 7): Result.006 file - promoters50/4809801
agatctt

SEQ ID NO: 193842 - DNA, 7 bp, Unknown
  misc_feature (1)..( 7): Result.006 file - promoters50/4810509
agatctc

SEQ ID NO: 193843 - DNA, 12 bp, Unknown
  misc_feature (1)..( 12): Result.006 file - promoters50/4810509
gtaaatttgtca

SEQ ID NO: 193844 - DNA, 12 bp, Unknown
  misc_feature (1)..( 12): Result.006 file - promoters50/4810509
agaaatttttca

SEQ ID NO: 193845 - DNA, 12 bp, Unknown
  misc_feature (1)..( 12): Result.006 file - promoters50/4811341
agaagtttgaga

SEQ ID NO: 193846 - DNA, 9 bp, Unknown
  misc_feature (1)..( 9): Result.006 file - promoters50/4811341
atgtaccgg

SEQ ID NO: 193847 - DNA, 9 bp, Unknown
  misc_feature (1)..( 9): Result.006 file - promoters50/4811341
atgtacata

SEQ ID NO: 193848 - DNA, 9 bp, Unknown
  misc_feature (1)..( 9): Result.006 file - promoters50/4811854
ttgttcata

SEQ ID NO: 193849 - DNA, 8 bp, Unknown
  misc_feature (1)..( 8): Result.006 file - promoters50/4811854
tctatatt

SEQ ID NO: 193850 - DNA, 8 bp, Unknown
  misc_feature (1)..( 8): Result.006 file - promoters50/4811854
tctctatc

SEQ ID NO: 193851 - DNA, 8 bp, Unknown
  misc_feature (1)..( 8): Result.006 file - promoters50/4811854
tctaaatt

SEQ ID NO: 193852 - DNA, 8 bp, Unknown
  misc_feature (1)..( 8): Result.006 file - promoters50/4811854
atttcatt

SEQ ID NO: 193853 - DNA, 8 bp, Unknown
  misc_feature (1)..( 8): Result.006 file - promoters50/4811854
atttcatt

SEQ ID NO: 193854 - DNA, 8 bp, Unknown
  misc_feature (1)..( 8): Result.006 file - promoters50/4811854
ttttaatt

SEQ ID NO: 193855 - DNA, 8 bp, Unknown
  misc_feature (1)..( 8): Result.006 file - promoters50/4811854
atttcaca

SEQ ID NO: 193856 - DNA, 13 bp, Unknown
  misc_feature (1)..( 13): Result.006 file - promoters50/4811854
tttaaaccgaaat

SEQ ID NO: 193857 - DNA, 13 bp, Unknown
  misc_feature (1)..( 13): Result.006 file - promoters50/4811854
tttaaaatctaat

SEQ ID NO: 193858 - DNA, 13 bp, Unknown
  misc_feature (1)..( 13): Result.006 file - promoters50/4811854
attatacctattt

SEQ ID NO: 193859 - DNA, 13 bp, Unknown
  misc_feature (1)..( 13): Result.006 file - promoters50/4811854
tttatacatattt

SEQ ID NO: 193860 - DNA, 11 bp, Unknown
  misc_feature (1)..( 11): Result.006 file - promoters50/4811854
attaatttttg

SEQ ID NO: 193861 - DNA, 11 bp, Unknown
  misc_feature (1)..( 11): Result.006 file - promoters50/4811854
tataatttaaa

SEQ ID NO: 193862 - DNA, 11 bp, Unknown
  misc_feature (1)..( 11): Result.006 file - promoters50/4811854
cataatttttg

SEQ ID NO: 193863 - DNA, 11 bp, Unknown
  misc_feature (1)..( 11): Result.006 file - promoters50/4811854
attaatattta

SEQ ID NO: 193864 - DNA, 9 bp, Unknown
  misc_feature (1)..( 9): Result.006 file - promoters50/4811854
aaaagttag

SEQ ID NO: 193865 - DNA, 9 bp, Unknown
  misc_feature (1)..( 9): Result.006 file - promoters50/4811854
aaaagttaa

SEQ ID NO: 193866 - DNA, 9 bp, Unknown
  misc_feature (1)..( 9): Result.006 file - promoters50/4811854
aaaagttaa

SEQ ID NO: 193867 - DNA, 12 bp, Unknown
  misc_feature (1)..( 12): Result.006 file - promoters50/4811854
gcttacatacat

SEQ ID NO: 193868 - DNA, 12 bp, Unknown
  misc_feature (1)..( 12): Result.006 file - promoters50/4811854
ttatacatattt

SEQ ID NO: 193869 - DNA, 12 bp, Unknown
  misc_feature (1)..( 12): Result.006 file - promoters50/4811854
ttatacctattt

SEQ ID NO: 193870 - DNA, 9 bp, Unknown
  misc_feature (1)..( 9): Result.006 file - promoters50/4811854
attatttta

SEQ ID NO: 193871 - DNA, 9 bp, Unknown
  misc_feature (1)..( 9): Result.006 file - promoters50/4811854
attatatta

SEQ ID NO: 193872 - DNA, 9 bp, Unknown
  misc_feature (1)..( 9): Result.006 file - promoters50/4811975
attatatat

SEQ ID NO: 193873 - DNA, 8 bp, Unknown
  misc_feature (1)..( 8): Result.006 file - promoters50/4811975
attctttt

SEQ ID NO: 193874 - DNA, 8 bp, Unknown
  misc_feature (1)..( 8): Result.006 file - promoters50/4811975
attttttt

SEQ ID NO: 193875 - DNA, 8 bp, Unknown
  misc_feature (1)..( 8): Result.006 file - promoters50/4811975
attttttt

SEQ ID NO: 193876 - DNA, 7 bp, Unknown
  misc_feature (1)..( 7): Result.006 file - promoters50/4811975
cttgaat

SEQ ID NO: 193877 - DNA, 7 bp, Unknown
  misc_feature (1)..( 7): Result.006 file - promoters50/4811975
cttgaaa

SEQ ID NO: 193878 - DNA, 7 bp, Unknown
  misc_feature (1)..( 7): Result.006 file - promoters50/4815093
gttgaaa

SEQ ID NO: 193879 - DNA, 9 bp, Unknown
  misc_feature (1)..( 9): Result.006 file - promoters50/4815093
gttgtagcg

SEQ ID NO: 193880 - DNA, 9 bp, Unknown
  misc_feature (1)..( 9): Result.006 file - promoters50/4815093
gttgtacaa

SEQ ID NO: 193881 - DNA, 9 bp, Unknown
  misc_feature (1)..( 9): Result.006 file - promoters50/4815135
attgaacaa

SEQ ID NO: 193882 - DNA, 8 bp, Unknown
  misc_feature (1)..( 8): Result.006 file - promoters50/4815135
cacggaaa

SEQ ID NO: 193883 - DNA, 8 bp, Unknown
  misc_feature (1)..( 8): Result.006 file - promoters50/4815135
gacgaaaa

SEQ ID NO: 193884 - DNA, 8 bp, Unknown
  misc_feature (1)..( 8): Result.006 file - promoters50/4815135
gaagaaag

SEQ ID NO: 193885 - DNA, 8 bp, Unknown
  misc_feature (1)..( 8): Result.006 file - promoters50/4815135
accaaaaa

SEQ ID NO: 193886 - DNA, 8 bp, Unknown
  misc_feature (1)..( 8): Result.006 file - promoters50/4815135
accagaaa

SEQ ID NO: 193887 - DNA, 8 bp, Unknown
  misc_feature (1)..( 8): Result.006 file - promoters50/4815135
tccaaaaa

SEQ ID NO: 193888 - DNA, 7 bp, Unknown
  misc_feature (1)..( 7): Result.006 file - promoters50/4815135
acacaaa

SEQ ID NO: 193889 - DNA, 7 bp, Unknown
  misc_feature (1)..( 7): Result.006 file - promoters50/4815135
ccacaaa

SEQ ID NO: 193890 - DNA, 7 bp, Unknown
  misc_feature (1)..( 7): Result.006 file - promoters50/4815135
ccacaac

SEQ ID NO: 193891 - DNA, 9 bp, Unknown
  misc_feature (1)..( 9): Result.006 file - promoters50/4815135
caatttgtt

SEQ ID NO: 193892 - DNA, 9 bp, Unknown
  misc_feature (1)..( 9): Result.006 file - promoters50/4815135
aaatttgtt

SEQ ID NO: 193893 - DNA, 10 bp, Unknown
  misc_feature (1)..( 10): Result.006 file - promoters50/4815135
caagtttttt

SEQ ID NO: 193894 - DNA, 12 bp, Unknown
  misc_feature (1)..( 12): Result.006 file - promoters50/4815135
tctgttgtcttc

SEQ ID NO: 193895 - DNA, 12 bp, Unknown
  misc_feature (1)..( 12): Result.006 file - promoters50/4815135
tttgttgtattc

SEQ ID NO: 193896 - DNA, 12 bp, Unknown
  misc_feature (1)..( 12): Result.006 file - promoters50/4816112
ttttttgctgaa

SEQ ID NO: 193897 - DNA, 9 bp, Unknown
  misc_feature (1)..( 9): Result.006 file - promoters50/4816112
tttgatttt

SEQ ID NO: 193898 - DNA, 9 bp, Unknown
  misc_feature (1)..( 9): Result.006 file - promoters50/4816112
tttgatttt

SEQ ID NO: 193899 - DNA, 9 bp, Unknown
  misc_feature (1)..( 9): Result.006 file - promoters50/4816112
attgattca

SEQ ID NO: 193900 - DNA, 9 bp, Unknown
  misc_feature (1)..( 9): Result.006 file - promoters50/4816112
ttttgattt

SEQ ID NO: 193901 - DNA, 9 bp, Unknown
  misc_feature (1)..( 9): Result.006 file - promoters50/4816112
ttttcattt

SEQ ID NO: 193902 - DNA, 9 bp, Unknown
  misc_feature (1)..( 9): Result.006 file - promoters50/4854186
aattgattc

SEQ ID NO: 193903 - DNA, 12 bp, Unknown
  misc_feature (1)..( 12): Result.006 file - promoters50/4854186
aacgaagaggaa

SEQ ID NO: 193904 - DNA, 12 bp, Unknown
  misc_feature (1)..( 12): Result.006 file - promoters50/4854186
tgggaagagaat

SEQ ID NO: 193905 - DNA, 12 bp, Unknown
  misc_feature (1)..( 12): Result.006 file - promoters50/4854186
ggtgaagaagaa

SEQ ID NO: 193906 - DNA, 12 bp, Unknown
  misc_feature (1)..( 12): Result.006 file - promoters50/4854186
aaccaagattaa

SEQ ID NO: 193907 - DNA, 12 bp, Unknown
  misc_feature (1)..( 12): Result.006 file - promoters50/4854186
atcaaagaatac

SEQ ID NO: 193908 - DNA, 12 bp, Unknown
  misc_feature (1)..( 12): Result.006 file - promoters50/4854186
attgaaaaatca

SEQ ID NO: 193909 - DNA, 8 bp, Unknown
  misc_feature (1)..( 8): Result.006 file - promoters50/4854186
aataaacg

SEQ ID NO: 193910 - DNA, 8 bp, Unknown
  misc_feature (1)..( 8): Result.006 file - promoters50/4854186
aataaagg

SEQ ID NO: 193911 - DNA, 8 bp, Unknown
  misc_feature (1)..( 8): Result.006 file - promoters50/4854186
aaaaaaaa

SEQ ID NO: 193912 - DNA, 8 bp, Unknown
  misc_feature (1)..( 8): Result.006 file - promoters50/4854186
aaagaata

SEQ ID NO: 193913 - DNA, 8 bp, Unknown
  misc_feature (1)..( 8): Result.006 file - promoters50/4854186
gaagaatt

SEQ ID NO: 193914 - DNA, 8 bp, Unknown
  misc_feature (1)..( 8): Result.006 file - promoters50/4854186
gaaaaatc

SEQ ID NO: 193915 - DNA, 13 bp, Unknown
  misc_feature (1)..( 13): Result.006 file - promoters50/4854186
tttaaattattat

SEQ ID NO: 193916 - DNA, 13 bp, Unknown
  misc_feature (1)..( 13): Result.006 file - promoters50/4854186
gttaaaatataca

SEQ ID NO: 193917 - DNA, 13 bp, Unknown
  misc_feature (1)..( 13): Result.006 file - promoters50/4854186
attaaaataaagg

SEQ ID NO: 193918 - DNA, 13 bp, Unknown
  misc_feature (1)..( 13): Result.006 file - promoters50/4854186
attgaaaaatcat

SEQ ID NO: 193919 - DNA, 13 bp, Unknown
  misc_feature (1)..( 13): Result.006 file - promoters50/4854186
caaagaatacaca

SEQ ID NO: 193920 - DNA, 13 bp, Unknown
  misc_feature (1)..( 13): Result.006 file - promoters50/4854186
aatgaaatcatgt

SEQ ID NO: 193921 - DNA, 16 bp, Unknown
  misc_feature (1)..( 16): Result.006 file - promoters50/4854186
aagtcagtaaaagttt

SEQ ID NO: 193922 - DNA, 16 bp, Unknown
  misc_feature (1)..( 16): Result.006 file - promoters50/4854186
tagtcactaaaaaggt

SEQ ID NO: 193923 - DNA, 16 bp, Unknown
  misc_feature (1)..( 16): Result.006 file - promoters50/4854186
cattgactaaaagaaa

SEQ ID NO: 193924 - DNA, 16 bp, Unknown
  misc_feature (1)..( 16): Result.006 file - promoters50/4854186
tagtgactcattgcca

SEQ ID NO: 193925 - DNA, 16 bp, Unknown
  misc_feature (1)..( 16): Result.006 file - promoters50/4854186
ttaagaataaaaagac

SEQ ID NO: 193926 - DNA, 16 bp, Unknown
  misc_feature (1)..( 16): Result.006 file - promoters50/4899797
ggattacgaaaaaaaa

SEQ ID NO: 193927 - DNA, 9 bp, Unknown
  misc_feature (1)..( 9): Result.006 file - promoters50/4899797
tatgtttgc

SEQ ID NO: 193928 - DNA, 9 bp, Unknown
  misc_feature (1)..( 9): Result.006 file - promoters50/4899797
tatttttgc

SEQ ID NO: 193929 - DNA, 9 bp, Unknown
  misc_feature (1)..( 9): Result.006 file - promoters50/4899797
tagttttgc

SEQ ID NO: 193930 - DNA, 8 bp, Unknown
  misc_feature (1)..( 8): Result.006 file - promoters50/4899797
taataaat

SEQ ID NO: 193931 - DNA, 8 bp, Unknown
  misc_feature (1)..( 8): Result.006 file - promoters50/4899797
gaataaag

SEQ ID NO: 193932 - DNA, 8 bp, Unknown
  misc_feature (1)..( 8): Result.006 file - promoters50/4899822
taaaaaat

SEQ ID NO: 193933 - DNA, 12 bp, Unknown
  misc_feature (1)..( 12): Result.006 file - promoters50/4899822
gtaaataaaaag

SEQ ID NO: 193934 - DNA, 12 bp, Unknown
  misc_feature (1)..( 12): Result.006 file - promoters50/4899822
cataatcaaatt

SEQ ID NO: 193935 - DNA, 12 bp, Unknown
  misc_feature (1)..( 12): Result.006 file - promoters50/4899822
accaaacaaaac

SEQ ID NO: 193936 - DNA, 12 bp, Unknown
  misc_feature (1)..( 12): Result.006 file - promoters50/4899822
aattatataaag

SEQ ID NO: 193937 - DNA, 12 bp, Unknown
  misc_feature (1)..( 12): Result.006 file - promoters50/4899822
tgtaaagaaaag

SEQ ID NO: 193938 - DNA, 12 bp, Unknown
  misc_feature (1)..( 12): Result.006 file - promoters50/4899822
agaaatcaatgg

SEQ ID NO: 193939 - DNA, 9 bp, Unknown
  misc_feature (1)..( 9): Result.006 file - promoters50/4899822
ctattttcc

SEQ ID NO: 193940 - DNA, 9 bp, Unknown
  misc_feature (1)..( 9): Result.006 file - promoters50/4899822
atattttca

SEQ ID NO: 193941 - DNA, 9 bp, Unknown
  misc_feature (1)..( 9): Result.006 file - promoters50/4899822
ttattttat

SEQ ID NO: 193942 - DNA, 9 bp, Unknown
  misc_feature (1)..( 9): Result.006 file - promoters50/4899822
gtatttttg

SEQ ID NO: 193943 - DNA, 9 bp, Unknown
  misc_feature (1)..( 9): Result.006 file - promoters50/4899822
ttaatttca

SEQ ID NO: 193944 - DNA, 9 bp, Unknown
  misc_feature (1)..( 9): Result.006 file - promoters50/4899830
caaatttca

SEQ ID NO: 193945 - DNA, 10 bp, Unknown
  misc_feature (1)..( 10): Result.006 file - promoters50/4899830
actatataac

SEQ ID NO: 193946 - DNA, 10 bp, Unknown
  misc_feature (1)..( 10): Result.006 file - promoters50/4899830
catatatact

SEQ ID NO: 193947 - DNA, 10 bp, Unknown
  misc_feature (1)..( 10): Result.006 file - promoters50/4899830
ggtatatata

SEQ ID NO: 193948 - DNA, 10 bp, Unknown
  misc_feature (1)..( 10): Result.006 file - promoters50/4899830
actataaaac

SEQ ID NO: 193949 - DNA, 10 bp, Unknown
  misc_feature (1)..( 10): Result.006 file - promoters50/4899830
actatttaaa

SEQ ID NO: 193950 - DNA, 10 bp, Unknown
  misc_feature (1)..( 10): Result.006 file - promoters50/4899830
cttatttatg

SEQ ID NO: 193951 - DNA, 12 bp, Unknown
  misc_feature (1)..( 12): Result.006 file - promoters50/4899830
ttgttaaattaa

SEQ ID NO: 193952 - DNA, 12 bp, Unknown
  misc_feature (1)..( 12): Result.006 file - promoters50/4899830
tcgtaaaactaa

SEQ ID NO: 193953 - DNA, 12 bp, Unknown
  misc_feature (1)..( 12): Result.006 file - promoters50/4899830
aactaaaattag

SEQ ID NO: 193954 - DNA, 12 bp, Unknown
  misc_feature (1)..( 12): Result.006 file - promoters50/4899830
gtaataatttac

SEQ ID NO: 193955 - DNA, 13 bp, Unknown
  misc_feature (1)..( 13): Result.006 file - promoters50/4899830
gaaaaaaagttat

SEQ ID NO: 193956 - DNA, 13 bp, Unknown
  misc_feature (1)..( 13): Result.006 file - promoters50/4899830
gaagaaaaattac

SEQ ID NO: 193957 - DNA, 13 bp, Unknown
  misc_feature (1)..( 13): Result.006 file - promoters50/4899830
tgtgaaaaaaaaa

SEQ ID NO: 193958 - DNA, 14 bp, Unknown
  misc_feature (1)..( 14): Result.006 file - promoters50/4899830
taatattaattttt

SEQ ID NO: 193959 - DNA, 14 bp, Unknown
  misc_feature (1)..( 14): Result.006 file - promoters50/4899830
agttataaatcgtt

SEQ ID NO: 193960 - DNA, 14 bp, Unknown
  misc_feature (1)..( 14): Result.006 file - promoters50/4899830
gtaactaaaattag

SEQ ID NO: 193961 - DNA, 14 bp, Unknown
  misc_feature (1)..( 14): Result.006 file - promoters50/4899830
ataatttactttgg

SEQ ID NO: 193962 - DNA, 14 bp, Unknown
  misc_feature (1)..( 14): Result.006 file - promoters50/4899830
ttggcttaatgttt

SEQ ID NO: 193963 - DNA, 14 bp, Unknown
  misc_feature (1)..( 14): Result.006 file - promoters50/4899830
gagaaaaaaagtta

SEQ ID NO: 193964 - DNA, 14 bp, Unknown
  misc_feature (1)..( 14): Result.006 file - promoters50/4899830
gaagaaaaattacg

SEQ ID NO: 193965 - DNA, 14 bp, Unknown
  misc_feature (1)..( 14): Result.006 file - promoters50/4899830
tgtgaaaaaaaaag

SEQ ID NO: 193966 - DNA, 13 bp, Unknown
  misc_feature (1)..( 13): Result.006 file - promoters50/4899830
ctatttaaattaa

SEQ ID NO: 193967 - DNA, 13 bp, Unknown
  misc_feature (1)..( 13): Result.006 file - promoters50/4899830
ttttgtaaatttt

SEQ ID NO: 193968 - DNA, 13 bp, Unknown
  misc_feature (1)..( 13): Result.006 file - promoters50/4899830
caagcaaaagtaa

SEQ ID NO: 193969 - DNA, 13 bp, Unknown
  misc_feature (1)..( 13): Result.006 file - promoters50/4899830
tagagtaaaccaa

SEQ ID NO: 193970 - DNA, 13 bp, Unknown
  misc_feature (1)..( 13): Result.006 file - promoters50/4899830
aaaaataaactag

SEQ ID NO: 193971 - DNA, 13 bp, Unknown
  misc_feature (1)..( 13): Result.006 file - promoters50/4899830
tttgctaaaaatc

SEQ ID NO: 193972 - DNA, 13 bp, Unknown
  misc_feature (1)..( 13): Result.006 file - promoters50/4899830
cgatgtaaaaatt

SEQ ID NO: 193973 - DNA, 13 bp, Unknown
  misc_feature (1)..( 13): Result.006 file - promoters50/4899830
gaaaaaaagttat

SEQ ID NO: 193974 - DNA, 13 bp, Unknown
  misc_feature (1)..( 13): Result.006 file - promoters50/4899830
acgccttagttat

SEQ ID NO: 193975 - DNA, 13 bp, Unknown
  misc_feature (1)..( 13): Result.006 file - promoters50/4899830
taactaaaattag

SEQ ID NO: 193976 - DNA, 13 bp, Unknown
  misc_feature (1)..( 13): Result.006 file - promoters50/4899830
gaagaaaaattac

SEQ ID NO: 193977 - DNA, 13 bp, Unknown
  misc_feature (1)..( 13): Result.006 file - promoters50/4899830
aaagaaaggtcat

SEQ ID NO: 193978 - DNA, 13 bp, Unknown
  misc_feature (1)..( 13): Result.006 file - promoters50/4899830
tgtgaaaaaaaaa

SEQ ID NO: 193979 - DNA, 9 bp, Unknown
  misc_feature (1)..( 9): Result.006 file - promoters50/4899830
ttctttagg

SEQ ID NO: 193980 - DNA, 9 bp, Unknown
  misc_feature (1)..( 9): Result.006 file - promoters50/4899830
ttcttttgt

SEQ ID NO: 193981 - DNA, 9 bp, Unknown
  misc_feature (1)..( 9): Result.006 file - promoters50/4899830
atctttagg

SEQ ID NO: 193982 - DNA, 10 bp, Unknown
  misc_feature (1)..( 10): Result.006 file - promoters50/4899830
ttcgtttaac

SEQ ID NO: 193983 - DNA, 10 bp, Unknown
  misc_feature (1)..( 10): Result.006 file - promoters50/4899830
tatgtttctt

SEQ ID NO: 193984 - DNA, 10 bp, Unknown
  misc_feature (1)..( 10): Result.006 file - promoters50/4899858
gatgtttgat

SEQ ID NO: 193985 - DNA, 7 bp, Unknown
  misc_feature (1)..( 7): Result.006 file - promoters50/4899858
tttttga

SEQ ID NO: 193986 - DNA, 7 bp, Unknown
  misc_feature (1)..( 7): Result.006 file - promoters50/4899858
tttttgg

SEQ ID NO: 193987 - DNA, 7 bp, Unknown
  misc_feature (1)..( 7): Result.006 file - promoters50/4899858
gttttgg

SEQ ID NO: 193988 - DNA, 10 bp, Unknown
  misc_feature (1)..( 10): Result.006 file - promoters50/4899858
gcaaagaaca

SEQ ID NO: 193989 - DNA, 10 bp, Unknown
  misc_feature (1)..( 10): Result.006 file - promoters50/4899858
gcaaagaaag

SEQ ID NO: 193990 - DNA, 10 bp, Unknown
  misc_feature (1)..( 10): Result.006 file - promoters50/4899858
acaatgaaca

SEQ ID NO: 193991 - DNA, 8 bp, Unknown
  misc_feature (1)..( 8): Result.006 file - promoters50/4899858
ttttcaat

SEQ ID NO: 193992 - DNA, 8 bp, Unknown
  misc_feature (1)..( 8): Result.006 file - promoters50/4899858
ttttcagc

SEQ ID NO: 193993 - DNA, 8 bp, Unknown
  misc_feature (1)..( 8): Result.006 file - promoters50/4899858
ttttgaat

SEQ ID NO: 193994 - DNA, 11 bp, Unknown
  misc_feature (1)..( 11): Result.006 file - promoters50/4899858
acctctcaatt

SEQ ID NO: 193995 - DNA, 11 bp, Unknown
  misc_feature (1)..( 11): Result.006 file - promoters50/4899858
tttactccatt

SEQ ID NO: 193996 - DNA, 11 bp, Unknown
  misc_feature (1)..( 11): Result.006 file - promoters50/4899880
accactcaatg

SEQ ID NO: 193997 - DNA, 8 bp, Unknown
  misc_feature (1)..( 8): Result.006 file - promoters50/4899880
atttttag

SEQ ID NO: 193998 - DNA, 8 bp, Unknown
  misc_feature (1)..( 8): Result.006 file - promoters50/4899880
atttgtag

SEQ ID NO: 193999 - DNA, 8 bp, Unknown
  misc_feature (1)..( 8): Result.006 file - promoters50/4899880
attattag

SEQ ID NO: 194000 - DNA, 6 bp, Unknown
  misc_feature (1)..( 6): Result.006 file - promoters50/4899880
tttgta

SEQ ID NO: 194001 - DNA, 6 bp, Unknown
  misc_feature (1)..( 6): Result.006 file - promoters50/4899880
tttgta

SEQ ID NO: 194002 - DNA, 6 bp, Unknown
  misc_feature (1)..( 6): Result.006 file - promoters50/4899880
tttgta

SEQ ID NO: 194003 - DNA, 6 bp, Unknown
  misc_feature (1)..( 6): Result.006 file - promoters50/4899880
taaaat

SEQ ID NO: 194004 - DNA, 6 bp, Unknown
  misc_feature (1)..( 6): Result.006 file - promoters50/4899880
taaaat

SEQ ID NO: 194005 - DNA, 6 bp, Unknown
  misc_feature (1)..( 6): Result.006 file - promoters50/4899880
taaaat

SEQ ID NO: 194006 - DNA, 7 bp, Unknown
  misc_feature (1)..( 7): Result.006 file - promoters50/4899880
ttaatat

SEQ ID NO: 194007 - DNA, 7 bp, Unknown
  misc_feature (1)..( 7): Result.006 file - promoters50/4899880
ttaataa

SEQ ID NO: 194008 - DNA, 7 bp, Unknown
  misc_feature (1)..( 7): Result.006 file - promoters50/4899880
ttagtat

SEQ ID NO: 194009 - DNA, 7 bp, Unknown
  misc_feature (1)..( 7): Result.006 file - promoters50/4899880
aattcct

SEQ ID NO: 194010 - DNA, 7 bp, Unknown
  misc_feature (1)..( 7): Result.006 file - promoters50/4899880
aattcca

SEQ ID NO: 194011 - DNA, 7 bp, Unknown
  misc_feature (1)..( 7): Result.006 file - promoters50/4899880
aatgcca

SEQ ID NO: 194012 - DNA, 8 bp, Unknown
  misc_feature (1)..( 8): Result.006 file - promoters50/4899880
ctttggaa

SEQ ID NO: 194013 - DNA, 8 bp, Unknown
  misc_feature (1)..( 8): Result.006 file - promoters50/4899880
ctttggaa

SEQ ID NO: 194014 - DNA, 8 bp, Unknown
  misc_feature (1)..( 8): Result.006 file - promoters50/4899880
gtttggag

SEQ ID NO: 194015 - DNA, 8 bp, Unknown
  misc_feature (1)..( 8): Result.006 file - promoters50/4899880
cctaggag

SEQ ID NO: 194016 - DNA, 8 bp, Unknown
  misc_feature (1)..( 8): Result.006 file - promoters50/4899880
actacgag

SEQ ID NO: 194017 - DNA, 8 bp, Unknown
  misc_feature (1)..( 8): Result.006 file - promoters50/4899993
actacgac

SEQ ID NO: 194018 - DNA, 10 bp, Unknown
  misc_feature (1)..( 10): Result.006 file - promoters50/4899993
atgaaagagt

SEQ ID NO: 194019 - DNA, 10 bp, Unknown
  misc_feature (1)..( 10): Result.006 file - promoters50/4899993
atggaagaag

SEQ ID NO: 194020 - DNA, 10 bp, Unknown
  misc_feature (1)..( 10): Result.006 file - promoters50/4899993
cgtaaacagt

SEQ ID NO: 194021 - DNA, 9 bp, Unknown
  misc_feature (1)..( 9): Result.006 file - promoters50/4899993
ccgtcaaaa

SEQ ID NO: 194022 - DNA, 9 bp, Unknown
  misc_feature (1)..( 9): Result.006 file - promoters50/4899993
aggtcaaat

SEQ ID NO: 194023 - DNA, 9 bp, Unknown
  misc_feature (1)..( 9): Result.006 file - promoters50/4900035
ccgtcaaaa

SEQ ID NO: 194024 - DNA, 9 bp, Unknown
  misc_feature (1)..( 9): Result.006 file - promoters50/4900035
ttttacaat

SEQ ID NO: 194025 - DNA, 9 bp, Unknown
  misc_feature (1)..( 9): Result.006 file - promoters50/4900035
cattacaaa

SEQ ID NO: 194026 - DNA, 9 bp, Unknown
  misc_feature (1)..( 9): Result.006 file - promoters50/4900035
atttaaaat

SEQ ID NO: 194027 - DNA, 9 bp, Unknown
  misc_feature (1)..( 9): Result.006 file - promoters50/4900035
acataaaat

SEQ ID NO: 194028 - DNA, 9 bp, Unknown
  misc_feature (1)..( 9): Result.006 file - promoters50/4900035
atatacaaa

SEQ ID NO: 194029 - DNA, 9 bp, Unknown
  misc_feature (1)..( 9): Result.006 file - promoters50/4900121
cataacatt

SEQ ID NO: 194030 - DNA, 9 bp, Unknown
  misc_feature (1)..( 9): Result.006 file - promoters50/4900121
aaagagtta

SEQ ID NO: 194031 - DNA, 9 bp, Unknown
  misc_feature (1)..( 9): Result.006 file - promoters50/4900121
aaagtgtta

SEQ ID NO: 194032 - DNA, 9 bp, Unknown
  misc_feature (1)..( 9): Result.006 file - promoters50/4900121
aaatagatt

SEQ ID NO: 194033 - DNA, 9 bp, Unknown
  misc_feature (1)..( 9): Result.006 file - promoters50/4900121
aaatggatc

SEQ ID NO: 194034 - DNA, 7 bp, Unknown
  misc_feature (1)..( 7): Result.006 file - promoters50/4900121
aaaaaga

SEQ ID NO: 194035 - DNA, 7 bp, Unknown
  misc_feature (1)..( 7): Result.006 file - promoters50/4900121
aaaaagt

SEQ ID NO: 194036 - DNA, 8 bp, Unknown
  misc_feature (1)..( 8): Result.006 file - promoters50/4900121
aaacaaat

SEQ ID NO: 194037 - DNA, 8 bp, Unknown
  misc_feature (1)..( 8): Result.006 file - promoters50/4900121
taaataga

SEQ ID NO: 194038 - DNA, 8 bp, Unknown
  misc_feature (1)..( 8): Result.006 file - promoters50/4900121
atttattt

SEQ ID NO: 194039 - DNA, 8 bp, Unknown
  misc_feature (1)..( 8): Result.006 file - promoters50/4900121
tttttttt

SEQ ID NO: 194040 - DNA, 8 bp, Unknown
  misc_feature (1)..( 8): Result.006 file - promoters50/4900121
aattattt

SEQ ID NO: 194041 - DNA, 8 bp, Unknown
  misc_feature (1)..( 8): Result.006 file - promoters50/4900121
atttatat

SEQ ID NO: 194042 - DNA, 8 bp, Unknown
  misc_feature (1)..( 8): Result.006 file - promoters50/4900121
aataatta

SEQ ID NO: 194043 - DNA, 11 bp, Unknown
  misc_feature (1)..( 11): Result.006 file - promoters50/4900121
ttatttatgat

SEQ ID NO: 194044 - DNA, 11 bp, Unknown
  misc_feature (1)..( 11): Result.006 file - promoters50/4900121
atatttaggat

SEQ ID NO: 194045 - DNA, 11 bp, Unknown
  misc_feature (1)..( 11): Result.006 file - promoters50/4900121
agatttatatt

SEQ ID NO: 194046 - DNA, 11 bp, Unknown
  misc_feature (1)..( 11): Result.006 file - promoters50/4900121
atatttgataa

SEQ ID NO: 194047 - DNA, 9 bp, Unknown
  misc_feature (1)..( 9): Result.006 file - promoters50/4900121
tgttttgta

SEQ ID NO: 194048 - DNA, 9 bp, Unknown
  misc_feature (1)..( 9): Result.006 file - promoters50/4900121
tgttttctt

SEQ ID NO: 194049 - DNA, 9 bp, Unknown
  misc_feature (1)..( 9): Result.006 file - promoters50/4900121
cgtttagta

SEQ ID NO: 194050 - DNA, 9 bp, Unknown
  misc_feature (1)..( 9): Result.006 file - promoters50/4900121
tgtttttat

SEQ ID NO: 194051 - DNA, 9 bp, Unknown
  misc_feature (1)..( 9): Result.006 file - promoters50/4900121
tttttattt

SEQ ID NO: 194052 - DNA, 9 bp, Unknown
  misc_feature (1)..( 9): Result.006 file - promoters50/4900121
tttatatta

SEQ ID NO: 194053 - DNA, 9 bp, Unknown
  misc_feature (1)..( 9): Result.006 file - promoters50/4900121
agtatattt

SEQ ID NO: 194054 - DNA, 9 bp, Unknown
  misc_feature (1)..( 9): Result.006 file - promoters50/4900121
tgaatattt

SEQ ID NO: 194055 - DNA, 10 bp, Unknown
  misc_feature (1)..( 10): Result.006 file - promoters50/4900121
gaatcttctt

SEQ ID NO: 194056 - DNA, 10 bp, Unknown
  misc_feature (1)..( 10): Result.006 file - promoters50/4900121
ttaccttctt

SEQ ID NO: 194057 - DNA, 10 bp, Unknown
  misc_feature (1)..( 10): Result.006 file - promoters50/4900121
aaatcttctg

SEQ ID NO: 194058 - DNA, 10 bp, Unknown
  misc_feature (1)..( 10): Result.006 file - promoters50/4900121
aaaccttgtg

SEQ ID NO: 194059 - DNA, 8 bp, Unknown
  misc_feature (1)..( 8): Result.006 file - promoters50/4900121
atttgtat

SEQ ID NO: 194060 - DNA, 8 bp, Unknown
  misc_feature (1)..( 8): Result.006 file - promoters50/4900121
ttttgtac

SEQ ID NO: 194061 - DNA, 8 bp, Unknown
  misc_feature (1)..( 8): Result.006 file - promoters50/4900121
atttatat

SEQ ID NO: 194062 - DNA, 8 bp, Unknown
  misc_feature (1)..( 8): Result.006 file - promoters50/4900121
ttttttac

SEQ ID NO: 194063 - DNA, 9 bp, Unknown
  misc_feature (1)..( 9): Result.006 file - promoters50/4900121
gaaacaact

SEQ ID NO: 194064 - DNA, 9 bp, Unknown
  misc_feature (1)..( 9): Result.006 file - promoters50/4900121
caaaaaacc

SEQ ID NO: 194065 - DNA, 9 bp, Unknown
  misc_feature (1)..( 9): Result.006 file - promoters50/4900121
caaaaaata

SEQ ID NO: 194066 - DNA, 9 bp, Unknown
  misc_feature (1)..( 9): Result.006 file - promoters50/4900213
taaaatata

SEQ ID NO: 194067 - DNA, 8 bp, Unknown
  misc_feature (1)..( 8): Result.006 file - promoters50/4900213
acttaagt

SEQ ID NO: 194068 - DNA, 8 bp, Unknown
  misc_feature (1)..( 8): Result.006 file - promoters50/4900213
actaaaga

SEQ ID NO: 194069 - DNA, 8 bp, Unknown
  misc_feature (1)..( 8): Result.006 file - promoters50/4900213
tctttagt

SEQ ID NO: 194070 - DNA, 8 bp, Unknown
  misc_feature (1)..( 8): Result.006 file - promoters50/4900213
tgagtaat

SEQ ID NO: 194071 - DNA, 8 bp, Unknown
  misc_feature (1)..( 8): Result.006 file - promoters50/4900213
tgattaaa

SEQ ID NO: 194072 - DNA, 8 bp, Unknown
  misc_feature (1)..( 8): Result.006 file - promoters50/4900213
ttattaaa

SEQ ID NO: 194073 - DNA, 7 bp, Unknown
  misc_feature (1)..( 7): Result.006 file - promoters50/4900213
aaaattt

SEQ ID NO: 194074 - DNA, 7 bp, Unknown
  misc_feature (1)..( 7): Result.006 file - promoters50/4900213
taaattt

SEQ ID NO: 194075 - DNA, 7 bp, Unknown
  misc_feature (1)..( 7): Result.006 file - promoters50/4900213
taacttt

SEQ ID NO: 194076 - DNA, 8 bp, Unknown
  misc_feature (1)..( 8): Result.006 file - promoters50/4900213
accaaagt

SEQ ID NO: 194077 - DNA, 8 bp, Unknown
  misc_feature (1)..( 8): Result.006 file - promoters50/4900213
accaaaaa

SEQ ID NO: 194078 - DNA, 8 bp, Unknown
  misc_feature (1)..( 8): Result.006 file - promoters50/4900353
tccaaaaa

SEQ ID NO: 194079 - DNA, 9 bp, Unknown
  misc_feature (1)..( 9): Result.006 file - promoters50/4900353
aatacttta

SEQ ID NO: 194080 - DNA, 9 bp, Unknown
  misc_feature (1)..( 9): Result.006 file - promoters50/4900353
catattttt

SEQ ID NO: 194081 - DNA, 9 bp, Unknown
  misc_feature (1)..( 9): Result.006 file - promoters50/4900353
accattttt

SEQ ID NO: 194082 - DNA, 9 bp, Unknown
  misc_feature (1)..( 9): Result.006 file - promoters50/4900353
tttattttt

SEQ ID NO: 194083 - DNA, 9 bp, Unknown
  misc_feature (1)..( 9): Result.006 file - promoters50/4900353
accatttta

SEQ ID NO: 194084 - DNA, 9 bp, Unknown
  misc_feature (1)..( 9): Result.006 file - promoters50/4900353
tcaattttt

SEQ ID NO: 194085 - DNA, 11 bp, Unknown
  misc_feature (1)..( 11): Result.006 file - promoters50/4900353
taagataggaa

SEQ ID NO: 194086 - DNA, 11 bp, Unknown
  misc_feature (1)..( 11): Result.006 file - promoters50/4900353
taatatatatt

SEQ ID NO: 194087 - DNA, 11 bp, Unknown
  misc_feature (1)..( 11): Result.006 file - promoters50/4900353
tgatataaatt

SEQ ID NO: 194088 - DNA, 11 bp, Unknown
  misc_feature (1)..( 11): Result.006 file - promoters50/4900353
atttataaatg

SEQ ID NO: 194089 - DNA, 11 bp, Unknown
  misc_feature (1)..( 11): Result.006 file - promoters50/4900353
aaatttatttt

SEQ ID NO: 194090 - DNA, 11 bp, Unknown
  misc_feature (1)..( 11): Result.006 file - promoters50/4900353
gaatttatgta

SEQ ID NO: 194091 - DNA, 15 bp, Unknown
  misc_feature (1)..( 15): Result.006 file - promoters50/4900353
aattatttttgtaaa

SEQ ID NO: 194092 - DNA, 15 bp, Unknown
  misc_feature (1)..( 15): Result.006 file - promoters50/4900353
actgatttttaataa

SEQ ID NO: 194093 - DNA, 15 bp, Unknown
  misc_feature (1)..( 15): Result.006 file - promoters50/4900353
atagatatttaattt

SEQ ID NO: 194094 - DNA, 15 bp, Unknown
  misc_feature (1)..( 15): Result.006 file - promoters50/4900353
agtcattcttatcaa

SEQ ID NO: 194095 - DNA, 15 bp, Unknown
  misc_feature (1)..( 15): Result.006 file - promoters50/4900353
ttgtgttcttagttc

SEQ ID NO: 194096 - DNA, 15 bp, Unknown
  misc_feature (1)..( 15): Result.006 file - promoters50/4900353
tctacttcttattgg

SEQ ID NO: 194097 - DNA, 15 bp, Unknown
  misc_feature (1)..( 15): Result.006 file - promoters50/4900353
agagattgcaatgga

SEQ ID NO: 194098 - DNA, 13 bp, Unknown
  misc_feature (1)..( 13): Result.006 file - promoters50/4900353
aaaagttataaga

SEQ ID NO: 194099 - DNA, 13 bp, Unknown
  misc_feature (1)..( 13): Result.006 file - promoters50/4900353
aaaatttataaat

SEQ ID NO: 194100 - DNA, 13 bp, Unknown
  misc_feature (1)..( 13): Result.006 file - promoters50/4900353
aaaatttattttt

SEQ ID NO: 194101 - DNA, 13 bp, Unknown
  misc_feature (1)..( 13): Result.006 file - promoters50/4900353
ctctgatataaat

SEQ ID NO: 194102 - DNA, 13 bp, Unknown
  misc_feature (1)..( 13): Result.006 file - promoters50/4900353
ctaatatatattc

SEQ ID NO: 194103 - DNA, 13 bp, Unknown
  misc_feature (1)..( 13): Result.006 file - promoters50/4900353
ggaatttatgtat

SEQ ID NO: 194104 - DNA, 15 bp, Unknown
  misc_feature (1)..( 15): Result.006 file - promoters50/4900353
aggtataattatttt

SEQ ID NO: 194105 - DNA, 15 bp, Unknown
  misc_feature (1)..( 15): Result.006 file - promoters50/4900353
tcttatgatttgctt

SEQ ID NO: 194106 - DNA, 15 bp, Unknown
  misc_feature (1)..( 15): Result.006 file - promoters50/4900353
atatttaatttgtgt

SEQ ID NO: 194107 - DNA, 15 bp, Unknown
  misc_feature (1)..( 15): Result.006 file - promoters50/4900353
agatatgttttgggg

SEQ ID NO: 194108 - DNA, 15 bp, Unknown
  misc_feature (1)..( 15): Result.006 file - promoters50/4900353
ccaaaagttttgtca

SEQ ID NO: 194109 - DNA, 15 bp, Unknown
  misc_feature (1)..( 15): Result.006 file - promoters50/4900353
aaaactgatttttaa

SEQ ID NO: 194110 - DNA, 15 bp, Unknown
  misc_feature (1)..( 15): Result.006 file - promoters50/4900417
cagtcgaagttgtgt

SEQ ID NO: 194111 - DNA, 11 bp, Unknown
  misc_feature (1)..( 11): Result.006 file - promoters50/4900417
aattttaaaga

SEQ ID NO: 194112 - DNA, 11 bp, Unknown
  misc_feature (1)..( 11): Result.006 file - promoters50/4900417
ttttttaaaaa

SEQ ID NO: 194113 - DNA, 11 bp, Unknown
  misc_feature (1)..( 11): Result.006 file - promoters50/4900417
aatgttagggg

SEQ ID NO: 194114 - DNA, 11 bp, Unknown
  misc_feature (1)..( 11): Result.006 file - promoters50/4900417
ttttttaatta

SEQ ID NO: 194115 - DNA, 11 bp, Unknown
  misc_feature (1)..( 11): Result.006 file - promoters50/4900417
gcttttactta

SEQ ID NO: 194116 - DNA, 11 bp, Unknown
  misc_feature (1)..( 11): Result.006 file - promoters50/4900417
ttacttaatgt

SEQ ID NO: 194117 - DNA, 10 bp, Unknown
  misc_feature (1)..( 10): Result.006 file - promoters50/4900417
ttgtgaaaat

SEQ ID NO: 194118 - DNA, 10 bp, Unknown
  misc_feature (1)..( 10): Result.006 file - promoters50/4900417
ttgagaaaag

SEQ ID NO: 194119 - DNA, 10 bp, Unknown
  misc_feature (1)..( 10): Result.006 file - promoters50/4900417
tcaagaaaat

SEQ ID NO: 194120 - DNA, 10 bp, Unknown
  misc_feature (1)..( 10): Result.006 file - promoters50/4900417
tagagataag

SEQ ID NO: 194121 - DNA, 10 bp, Unknown
  misc_feature (1)..( 10): Result.006 file - promoters50/4900417
aggagagaat

SEQ ID NO: 194122 - DNA, 10 bp, Unknown
  misc_feature (1)..( 10): Result.006 file - promoters50/4900417
atgagagatg

SEQ ID NO: 194123 - DNA, 11 bp, Unknown
  misc_feature (1)..( 11): Result.006 file - promoters50/4900417
ataatataaga

SEQ ID NO: 194124 - DNA, 11 bp, Unknown
  misc_feature (1)..( 11): Result.006 file - promoters50/4900417
agaatgtaaat

SEQ ID NO: 194125 - DNA, 11 bp, Unknown
  misc_feature (1)..( 11): Result.006 file - promoters50/4900417
tgaatatagat

SEQ ID NO: 194126 - DNA, 11 bp, Unknown
  misc_feature (1)..( 11): Result.006 file - promoters50/4900417
tctatatgaga

SEQ ID NO: 194127 - DNA, 11 bp, Unknown
  misc_feature (1)..( 11): Result.006 file - promoters50/4900417
ataagatacgc

SEQ ID NO: 194128 - DNA, 11 bp, Unknown
  misc_feature (1)..( 11): Result.006 file - promoters50/4900417
ttgagaaaagg

SEQ ID NO: 194129 - DNA, 9 bp, Unknown
  misc_feature (1)..( 9): Result.006 file - promoters50/4900417
tataagaaa

SEQ ID NO: 194130 - DNA, 9 bp, Unknown
  misc_feature (1)..( 9): Result.006 file - promoters50/4900417
tgtaagaat

SEQ ID NO: 194131 - DNA, 9 bp, Unknown
  misc_feature (1)..( 9): Result.006 file - promoters50/4900417
gataaaaga

SEQ ID NO: 194132 - DNA, 9 bp, Unknown
  misc_feature (1)..( 9): Result.006 file - promoters50/4900417
tatatgaga

SEQ ID NO: 194133 - DNA, 9 bp, Unknown
  misc_feature (1)..( 9): Result.006 file - promoters50/4900417
gataagata

SEQ ID NO: 194134 - DNA, 9 bp, Unknown
  misc_feature (1)..( 9): Result.006 file - promoters50/4900417
gagaaaagg

SEQ ID NO: 194135 - DNA, 11 bp, Unknown
  misc_feature (1)..( 11): Result.006 file - promoters50/4900417
tttttcatttt

SEQ ID NO: 194136 - DNA, 11 bp, Unknown
  misc_feature (1)..( 11): Result.006 file - promoters50/4900417
aatttgatttc

SEQ ID NO: 194137 - DNA, 12 bp, Unknown
  misc_feature (1)..( 12): Result.006 file - promoters50/4900417
tttgacatattt

SEQ ID NO: 194138 - DNA, 12 bp, Unknown
  misc_feature (1)..( 12): Result.006 file - promoters50/4900417
attttcaaattt

SEQ ID NO: 194139 - DNA, 12 bp, Unknown
  misc_feature (1)..( 12): Result.006 file - promoters50/4900417
atgttcgttttc

SEQ ID NO: 194140 - DNA, 12 bp, Unknown
  misc_feature (1)..( 12): Result.006 file - promoters50/4900417
aatttgaaatcg

SEQ ID NO: 194141 - DNA, 9 bp, Unknown
  misc_feature (1)..( 9): Result.006 file - promoters50/4900417
ttatttttt

SEQ ID NO: 194142 - DNA, 9 bp, Unknown
  misc_feature (1)..( 9): Result.006 file - promoters50/4900417
atatctttc

SEQ ID NO: 194143 - DNA, 9 bp, Unknown
  misc_feature (1)..( 9): Result.006 file - promoters50/4900417
ttttcttta

SEQ ID NO: 194144 - DNA, 9 bp, Unknown
  misc_feature (1)..( 9): Result.006 file - promoters50/4900417
aattcttta

SEQ ID NO: 194145 - DNA, 9 bp, Unknown
  misc_feature (1)..( 9): Result.006 file - promoters50/4900417
ttttctcat

SEQ ID NO: 194146 - DNA, 9 bp, Unknown
  misc_feature (1)..( 9): Result.006 file - promoters50/4900589
gcatttttc

SEQ ID NO: 194147 - DNA, 11 bp, Unknown
  misc_feature (1)..( 11): Result.006 file - promoters50/4900589
gtataaattga

SEQ ID NO: 194148 - DNA, 11 bp, Unknown
  misc_feature (1)..( 11): Result.006 file - promoters50/4900589
gtaaaaatatc

SEQ ID NO: 194149 - DNA, 11 bp, Unknown
  misc_feature (1)..( 11): Result.006 file - promoters50/4900589
taataaattga

SEQ ID NO: 194150 - DNA, 9 bp, Unknown
  misc_feature (1)..( 9): Result.006 file - promoters50/4900589
caaaaagag

SEQ ID NO: 194151 - DNA, 9 bp, Unknown
  misc_feature (1)..( 9): Result.006 file - promoters50/4900589
caaagagag

SEQ ID NO: 194152 - DNA, 9 bp, Unknown
  misc_feature (1)..( 9): Result.006 file - promoters50/4900589
caaaaacca

SEQ ID NO: 194153 - DNA, 9 bp, Unknown
  misc_feature (1)..( 9): Result.006 file - promoters50/4900589
attgttttt

SEQ ID NO: 194154 - DNA, 9 bp, Unknown
  misc_feature (1)..( 9): Result.006 file - promoters50/4900589
tttgtttta

SEQ ID NO: 194155 - DNA, 9 bp, Unknown
  misc_feature (1)..( 9): Result.006 file - promoters50/4900589
tcggttttt

SEQ ID NO: 194156 - DNA, 9 bp, Unknown
  misc_feature (1)..( 9): Result.006 file - promoters50/4900589
tttcttttt

SEQ ID NO: 194157 - DNA, 9 bp, Unknown
  misc_feature (1)..( 9): Result.006 file - promoters50/4900589
tgaagcaaa

SEQ ID NO: 194158 - DNA, 9 bp, Unknown
  misc_feature (1)..( 9): Result.006 file - promoters50/4900589
tgaaacaaa

SEQ ID NO: 194159 - DNA, 9 bp, Unknown
  misc_feature (1)..( 9): Result.006 file - promoters50/4900589
atacataaa

SEQ ID NO: 194160 - DNA, 9 bp, Unknown
  misc_feature (1)..( 9): Result.006 file - promoters50/4900589
tatttattt

SEQ ID NO: 194161 - DNA, 9 bp, Unknown
  misc_feature (1)..( 9): Result.006 file - promoters50/4900589
tatttattt

SEQ ID NO: 194162 - DNA, 9 bp, Unknown
  misc_feature (1)..( 9): Result.006 file - promoters50/4900589
tatttacat

SEQ ID NO: 194163 - DNA, 8 bp, Unknown
  misc_feature (1)..( 8): Result.006 file - promoters50/4900589
gtaaatca

SEQ ID NO: 194164 - DNA, 8 bp, Unknown
  misc_feature (1)..( 8): Result.006 file - promoters50/4900589
gtagatcc

SEQ ID NO: 194165 - DNA, 8 bp, Unknown
  misc_feature (1)..( 8): Result.006 file - promoters50/4900589
tcaaatca

SEQ ID NO: 194166 - DNA, 8 bp, Unknown
  misc_feature (1)..( 8): Result.006 file - promoters50/4900589
ttagatcg

SEQ ID NO: 194167 - DNA, 8 bp, Unknown
  misc_feature (1)..( 8): Result.006 file - promoters50/4900589
tttgtttg

SEQ ID NO: 194168 - DNA, 8 bp, Unknown
  misc_feature (1)..( 8): Result.006 file - promoters50/4900589
tttctttt

SEQ ID NO: 194169 - DNA, 8 bp, Unknown
  misc_feature (1)..( 8): Result.006 file - promoters50/4900589
tttgtttt

SEQ ID NO: 194170 - DNA, 13 bp, Unknown
  misc_feature (1)..( 13): Result.006 file - promoters50/4900589
aatccaaaatttg

SEQ ID NO: 194171 - DNA, 13 bp, Unknown
  misc_feature (1)..( 13): Result.006 file - promoters50/4900589
tatctaaattttg

SEQ ID NO: 194172 - DNA, 13 bp, Unknown
  misc_feature (1)..( 13): Result.006 file - promoters50/4900589
aattcaaaaaaaa

SEQ ID NO: 194173 - DNA, 13 bp, Unknown
  misc_feature (1)..( 13): Result.006 file - promoters50/4900589
gcctacaattttg

SEQ ID NO: 194174 - DNA, 10 bp, Unknown
  misc_feature (1)..( 10): Result.006 file - promoters50/4900589
aaaatcaaaa

SEQ ID NO: 194175 - DNA, 10 bp, Unknown
  misc_feature (1)..( 10): Result.006 file - promoters50/4900589
aaaaccaaac

SEQ ID NO: 194176 - DNA, 10 bp, Unknown
  misc_feature (1)..( 10): Result.006 file - promoters50/4900589
tcgtccaaac

SEQ ID NO: 194177 - DNA, 9 bp, Unknown
  misc_feature (1)..( 9): Result.006 file - promoters50/4900589
caaatagta

SEQ ID NO: 194178 - DNA, 9 bp, Unknown
  misc_feature (1)..( 9): Result.006 file - promoters50/4900589
caaaaagtg

SEQ ID NO: 194179 - DNA, 9 bp, Unknown
  misc_feature (1)..( 9): Result.006 file - promoters50/4900589
ttcaaagtg

SEQ ID NO: 194180 - DNA, 8 bp, Unknown
  misc_feature (1)..( 8): Result.006 file - promoters50/4900589
tgggtttt

SEQ ID NO: 194181 - DNA, 8 bp, Unknown
  misc_feature (1)..( 8): Result.006 file - promoters50/4900589
tggatttc

SEQ ID NO: 194182 - DNA, 8 bp, Unknown
  misc_feature (1)..( 8): Result.006 file - promoters50/4900589
tcggtttt

SEQ ID NO: 194183 - DNA, 8 bp, Unknown
  misc_feature (1)..( 8): Result.006 file - promoters50/4900589
ttttaatt

SEQ ID NO: 194184 - DNA, 8 bp, Unknown
  misc_feature (1)..( 8): Result.006 file - promoters50/4900589
ttttaatt

SEQ ID NO: 194185 - DNA, 8 bp, Unknown
  misc_feature (1)..( 8): Result.006 file - promoters50/4900643
gcttaatt

SEQ ID NO: 194186 - DNA, 8 bp, Unknown
  misc_feature (1)..( 8): Result.006 file - promoters50/4900643
tgtgggtt

SEQ ID NO: 194187 - DNA, 8 bp, Unknown
  misc_feature (1)..( 8): Result.006 file - promoters50/4900643
tgtcggtt

SEQ ID NO: 194188 - DNA, 8 bp, Unknown
  misc_feature (1)..( 8): Result.006 file - promoters50/4900643
attgggtt

SEQ ID NO: 194189 - DNA, 9 bp, Unknown
  misc_feature (1)..( 9): Result.006 file - promoters50/4900643
tttcttttc

SEQ ID NO: 194190 - DNA, 9 bp, Unknown
  misc_feature (1)..( 9): Result.006 file - promoters50/4900643
tttatttac

SEQ ID NO: 194191 - DNA, 9 bp, Unknown
  misc_feature (1)..( 9): Result.006 file - promoters50/4900800
catatttac

SEQ ID NO: 194192 - DNA, 9 bp, Unknown
  misc_feature (1)..( 9): Result.006 file - promoters50/4900800
caagaaaga

SEQ ID NO: 194193 - DNA, 9 bp, Unknown
  misc_feature (1)..( 9): Result.006 file - promoters50/4900800
aaagaaaaa

SEQ ID NO: 194194 - DNA, 9 bp, Unknown
  misc_feature (1)..( 9): Result.006 file - promoters50/4900800
caataaaat

SEQ ID NO: 194195 - DNA, 9 bp, Unknown
  misc_feature (1)..( 9): Result.006 file - promoters50/4900800
ggagacaga

SEQ ID NO: 194196 - DNA, 9 bp, Unknown
  misc_feature (1)..( 9): Result.006 file - promoters50/4900800
gaagaaagg

SEQ ID NO: 194197 - DNA, 13 bp, Unknown
  misc_feature (1)..( 13): Result.006 file - promoters50/4900800
aatttcatgaaga

SEQ ID NO: 194198 - DNA, 13 bp, Unknown
  misc_feature (1)..( 13): Result.006 file - promoters50/4900800
aatctcacgaaca

SEQ ID NO: 194199 - DNA, 13 bp, Unknown
  misc_feature (1)..( 13): Result.006 file - promoters50/4900800
agaaggatgaaga

SEQ ID NO: 194200 - DNA, 13 bp, Unknown
  misc_feature (1)..( 13): Result.006 file - promoters50/4900800
aaatgaacgcaca

SEQ ID NO: 194201 - DNA, 13 bp, Unknown
  misc_feature (1)..( 13): Result.006 file - promoters50/4900939
gacgggaggaaga

SEQ ID NO: 194202 - DNA, 13 bp, Unknown
  misc_feature (1)..( 13): Result.006 file - promoters50/4900939
ctaaacaaataat

SEQ ID NO: 194203 - DNA, 13 bp, Unknown
  misc_feature (1)..( 13): Result.006 file - promoters50/4900939
aaaaataaaaagt

SEQ ID NO: 194204 - DNA, 13 bp, Unknown
  misc_feature (1)..( 13): Result.006 file - promoters50/4900939
ctaaacactaatg

SEQ ID NO: 194205 - DNA, 13 bp, Unknown
  misc_feature (1)..( 13): Result.006 file - promoters50/4900939
tataataagtcaa

SEQ ID NO: 194206 - DNA, 13 bp, Unknown
  misc_feature (1)..( 13): Result.006 file - promoters50/4900939
caaatcaaattat

SEQ ID NO: 194207 - DNA, 13 bp, Unknown
  misc_feature (1)..( 13): Result.006 file - promoters50/4901133
aatgtcacattca

SEQ ID NO: 194208 - DNA, 15 bp, Unknown
  misc_feature (1)..( 15): Result.006 file - promoters50/4901133
tcctttagttttaat

SEQ ID NO: 194209 - DNA, 15 bp, Unknown
  misc_feature (1)..( 15): Result.006 file - promoters50/4901133
gaattttgtttttga

SEQ ID NO: 194210 - DNA, 16 bp, Unknown
  misc_feature (1)..( 16): Result.006 file - promoters50/4901133
ccaaattgattttgat

SEQ ID NO: 194211 - DNA, 16 bp, Unknown
  misc_feature (1)..( 16): Result.006 file - promoters50/4901133
taaattatgttattat

SEQ ID NO: 194212 - DNA, 16 bp, Unknown
  misc_feature (1)..( 16): Result.006 file - promoters50/4901133
taatttaatgcatcta

SEQ ID NO: 194213 - DNA, 16 bp, Unknown
  misc_feature (1)..( 16): Result.006 file - promoters50/4901133
tattatatgtttcaaa

SEQ ID NO: 194214 - DNA, 10 bp, Unknown
  misc_feature (1)..( 10): Result.006 file - promoters50/4901133
ttttcaaaat

SEQ ID NO: 194215 - DNA, 10 bp, Unknown
  misc_feature (1)..( 10): Result.006 file - promoters50/4901133
aaatcaaaat

SEQ ID NO: 194216 - DNA, 10 bp, Unknown
  misc_feature (1)..( 10): Result.006 file - promoters50/4901133
gtttcaaaaa

SEQ ID NO: 194217 - DNA, 10 bp, Unknown
  misc_feature (1)..( 10): Result.006 file - promoters50/4901133
atttgaaatc

SEQ ID NO: 194218 - DNA, 10 bp, Unknown
  misc_feature (1)..( 10): Result.006 file - promoters50/4901133
atttgatcac

SEQ ID NO: 194219 - DNA, 10 bp, Unknown
  misc_feature (1)..( 10): Result.006 file - promoters50/4901149
atttgagcgg

SEQ ID NO: 194220 - DNA, 8 bp, Unknown
  misc_feature (1)..( 8): Result.006 file - promoters50/4901149
tatttcta

SEQ ID NO: 194221 - DNA, 8 bp, Unknown
  misc_feature (1)..( 8): Result.006 file - promoters50/4901149
aatttctt

SEQ ID NO: 194222 - DNA, 8 bp, Unknown
  misc_feature (1)..( 8): Result.006 file - promoters50/4901149
aatatctt

SEQ ID NO: 194223 - DNA, 9 bp, Unknown
  misc_feature (1)..( 9): Result.006 file - promoters50/4901149
tatgtaaac

SEQ ID NO: 194224 - DNA, 9 bp, Unknown
  misc_feature (1)..( 9): Result.006 file - promoters50/4901149
aatgaaaat

SEQ ID NO: 194225 - DNA, 9 bp, Unknown
  misc_feature (1)..( 9): Result.006 file - promoters50/4901149
aatcaaaat

SEQ ID NO: 194226 - DNA, 7 bp, Unknown
  misc_feature (1)..( 7): Result.006 file - promoters50/4901149
tctaata

SEQ ID NO: 194227 - DNA, 7 bp, Unknown
  misc_feature (1)..( 7): Result.006 file - promoters50/4901149
tctaatc

SEQ ID NO: 194228 - DNA, 7 bp, Unknown
  misc_feature (1)..( 7): Result.006 file - promoters50/4901149
gctaata

SEQ ID NO: 194229 - DNA, 8 bp, Unknown
  misc_feature (1)..( 8): Result.006 file - promoters50/4901149
ctctccaa

SEQ ID NO: 194230 - DNA, 8 bp, Unknown
  misc_feature (1)..( 8): Result.006 file - promoters50/4901149
ctctcctt

SEQ ID NO: 194231 - DNA, 8 bp, Unknown
  misc_feature (1)..( 8): Result.006 file - promoters50/4901149
ttctcctt

SEQ ID NO: 194232 - DNA, 7 bp, Unknown
  misc_feature (1)..( 7): Result.006 file - promoters50/4901149
tttacag

SEQ ID NO: 194233 - DNA, 7 bp, Unknown
  misc_feature (1)..( 7): Result.006 file - promoters50/4901149
tttgcag

SEQ ID NO: 194234 - DNA, 8 bp, Unknown
  misc_feature (1)..( 8): Result.006 file - promoters50/4901149
tttaacaa

SEQ ID NO: 194235 - DNA, 8 bp, Unknown
  misc_feature (1)..( 8): Result.006 file - promoters50/4901149
tttaacat

SEQ ID NO: 194236 - DNA, 8 bp, Unknown
  misc_feature (1)..( 8): Result.006 file - promoters50/4901149
tttactta

SEQ ID NO: 194237 - DNA, 8 bp, Unknown
  misc_feature (1)..( 8): Result.006 file - promoters50/4901149
ttttcttt

SEQ ID NO: 194238 - DNA, 8 bp, Unknown
  misc_feature (1)..( 8): Result.006 file - promoters50/4901149
tattcttt

SEQ ID NO: 194239 - DNA, 9 bp, Unknown
  misc_feature (1)..( 9): Result.006 file - promoters50/4901149
aaatatagt

SEQ ID NO: 194240 - DNA, 9 bp, Unknown
  misc_feature (1)..( 9): Result.006 file - promoters50/4901149
agatatagt

SEQ ID NO: 194241 - DNA, 9 bp, Unknown
  misc_feature (1)..( 9): Result.006 file - promoters50/4901149
agagatatg

SEQ ID NO: 194242 - DNA, 8 bp, Unknown
  misc_feature (1)..( 8): Result.006 file - promoters50/4901149
gtactgta

SEQ ID NO: 194243 - DNA, 8 bp, Unknown
  misc_feature (1)..( 8): Result.006 file - promoters50/4901149
ttactgtc

SEQ ID NO: 194244 - DNA, 8 bp, Unknown
  misc_feature (1)..( 8): Result.006 file - promoters50/4901225
ttacagtc

SEQ ID NO: 194245 - DNA, 10 bp, Unknown
  misc_feature (1)..( 10): Result.006 file - promoters50/4901225
taaaaaaacg

SEQ ID NO: 194246 - DNA, 10 bp, Unknown
  misc_feature (1)..( 10): Result.006 file - promoters50/4901225
acaaaacacg

SEQ ID NO: 194247 - DNA, 10 bp, Unknown
  misc_feature (1)..( 10): Result.006 file - promoters50/4901241
acaatacact

SEQ ID NO: 194248 - DNA, 17 bp, Unknown
  misc_feature (1)..( 17): Result.006 file - promoters50/4901241
acatatttttataaata

SEQ ID NO: 194249 - DNA, 17 bp, Unknown
  misc_feature (1)..( 17): Result.006 file - promoters50/4901241
aaatatttttatgtggt

SEQ ID NO: 194250 - DNA, 17 bp, Unknown
  misc_feature (1)..( 17): Result.006 file - promoters50/4901241
aaatatatttaatcaga

SEQ ID NO: 194251 - DNA, 17 bp, Unknown
  misc_feature (1)..( 17): Result.006 file - promoters50/4901241
ttgaaattttatggata

SEQ ID NO: 194252 - DNA, 17 bp, Unknown
  misc_feature (1)..( 17): Result.006 file - promoters50/4901241
tgaaatattataataca

SEQ ID NO: 194253 - DNA, 17 bp, Unknown
  misc_feature (1)..( 17): Result.006 file - promoters50/4901241
aataatattcaaatcaa

SEQ ID NO: 194254 - DNA, 17 bp, Unknown
  misc_feature (1)..( 17): Result.006 file - promoters50/4901241
gcaaattttattgcttg

SEQ ID NO: 194255 - DNA, 17 bp, Unknown
  misc_feature (1)..( 17): Result.006 file - promoters50/4901241
gatcgctttaaactata

SEQ ID NO: 194256 - DNA, 13 bp, Unknown
  misc_feature (1)..( 13): Result.006 file - promoters50/4901241
aaaaaagaattta

SEQ ID NO: 194257 - DNA, 13 bp, Unknown
  misc_feature (1)..( 13): Result.006 file - promoters50/4901241
tcaaaagatttat

SEQ ID NO: 194258 - DNA, 14 bp, Unknown
  misc_feature (1)..( 14): Result.006 file - promoters50/4901241
aaaataagagatac

SEQ ID NO: 194259 - DNA, 14 bp, Unknown
  misc_feature (1)..( 14): Result.006 file - promoters50/4901241
agttaaagacttta

SEQ ID NO: 194260 - DNA, 14 bp, Unknown
  misc_feature (1)..( 14): Result.006 file - promoters50/4901241
tctgaaatattata

SEQ ID NO: 194261 - DNA, 14 bp, Unknown
  misc_feature (1)..( 14): Result.006 file - promoters50/4901241
tcgaaaatatacag

SEQ ID NO: 194262 - DNA, 12 bp, Unknown
  misc_feature (1)..( 12): Result.006 file - promoters50/4901241
cgattaaatgaa

SEQ ID NO: 194263 - DNA, 12 bp, Unknown
  misc_feature (1)..( 12): Result.006 file - promoters50/4901241
cgactaattaaa

SEQ ID NO: 194264 - DNA, 12 bp, Unknown
  misc_feature (1)..( 12): Result.006 file - promoters50/4901241
tgattaataatt

SEQ ID NO: 194265 - DNA, 12 bp, Unknown
  misc_feature (1)..( 12): Result.006 file - promoters50/4901241
agactaattaat

SEQ ID NO: 194266 - DNA, 12 bp, Unknown
  misc_feature (1)..( 12): Result.006 file - promoters50/4901241
attgtaaataat

SEQ ID NO: 194267 - DNA, 12 bp, Unknown
  misc_feature (1)..( 12): Result.006 file - promoters50/4901241
aaattaataaag

SEQ ID NO: 194268 - DNA, 14 bp, Unknown
  misc_feature (1)..( 14): Result.006 file - promoters50/4901241
cgattaaatgaaac

SEQ ID NO: 194269 - DNA, 14 bp, Unknown
  misc_feature (1)..( 14): Result.006 file - promoters50/4901241
ccgactaattaaat

SEQ ID NO: 194270 - DNA, 14 bp, Unknown
  misc_feature (1)..( 14): Result.006 file - promoters50/4901241
ctaattaatgaaac

SEQ ID NO: 194271 - DNA, 14 bp, Unknown
  misc_feature (1)..( 14): Result.006 file - promoters50/4901241
aattgtaaataatt

SEQ ID NO: 194272 - DNA, 14 bp, Unknown
  misc_feature (1)..( 14): Result.006 file - promoters50/4901241
tttaaaaattaata

SEQ ID NO: 194273 - DNA, 14 bp, Unknown
  misc_feature (1)..( 14): Result.006 file - promoters50/4901241
aattgtaaatatac

SEQ ID NO: 194274 - DNA, 19 bp, Unknown
  misc_feature (1)..( 19): Result.006 file - promoters50/4901241
aaagtaaaaaacatcttat

SEQ ID NO: 194275 - DNA, 19 bp, Unknown
  misc_feature (1)..( 19): Result.006 file - promoters50/4901241
aaatttttaaacattgtcc

SEQ ID NO: 194276 - DNA, 19 bp, Unknown
  misc_feature (1)..( 19): Result.006 file - promoters50/4901241
gagacttgcaacttcttat

SEQ ID NO: 194277 - DNA, 19 bp, Unknown
  misc_feature (1)..( 19): Result.006 file - promoters50/4901241
gatggattaatcataggag

SEQ ID NO: 194278 - DNA, 19 bp, Unknown
  misc_feature (1)..( 19): Result.006 file - promoters50/4901241
aaatttttaaatattttta

SEQ ID NO: 194279 - DNA, 19 bp, Unknown
  misc_feature (1)..( 19): Result.006 file - promoters50/4901241
gagaatctaaacttcgacc

SEQ ID NO: 194280 - DNA, 19 bp, Unknown
  misc_feature (1)..( 19): Result.006 file - promoters50/4901241
taattttaaaataatgaat

SEQ ID NO: 194281 - DNA, 12 bp, Unknown
  misc_feature (1)..( 12): Result.006 file - promoters50/4901241
taataaaatatc

SEQ ID NO: 194282 - DNA, 12 bp, Unknown
  misc_feature (1)..( 12): Result.006 file - promoters50/4901241
ttttaaattatg

SEQ ID NO: 194283 - DNA, 12 bp, Unknown
  misc_feature (1)..( 12): Result.006 file - promoters50/4901241
agatagaataaa

SEQ ID NO: 194284 - DNA, 12 bp, Unknown
  misc_feature (1)..( 12): Result.006 file - promoters50/4901241
cttaagaatacc

SEQ ID NO: 194285 - DNA, 12 bp, Unknown
  misc_feature (1)..( 12): Result.006 file - promoters50/4901241
gaaaaaaacaaa

SEQ ID NO: 194286 - DNA, 12 bp, Unknown
  misc_feature (1)..( 12): Result.006 file - promoters50/4901241
ttttttaacaaa

SEQ ID NO: 194287 - DNA, 12 bp, Unknown
  misc_feature (1)..( 12): Result.006 file - promoters50/4901241
cctaatttcttc

SEQ ID NO: 194288 - DNA, 12 bp, Unknown
  misc_feature (1)..( 12): Result.006 file - promoters50/4901241
cctaatttgagc

SEQ ID NO: 194289 - DNA, 12 bp, Unknown
  misc_feature (1)..( 12): Result.006 file - promoters50/4901241
tctattttgtcg

SEQ ID NO: 194290 - DNA, 12 bp, Unknown
  misc_feature (1)..( 12): Result.006 file - promoters50/4901241
ggaaatttcatt

SEQ ID NO: 194291 - DNA, 12 bp, Unknown
  misc_feature (1)..( 12): Result.006 file - promoters50/4901241
gcaaatttttaa

SEQ ID NO: 194292 - DNA, 12 bp, Unknown
  misc_feature (1)..( 12): Result.006 file - promoters50/4901241
tcaaatttaatt

SEQ ID NO: 194293 - DNA, 12 bp, Unknown
  misc_feature (1)..( 12): Result.006 file - promoters50/4901241
tctgtttgaaaa

SEQ ID NO: 194294 - DNA, 12 bp, Unknown
  misc_feature (1)..( 12): Result.006 file - promoters50/4901241
ataaatttgaaa

SEQ ID NO: 194295 - DNA, 13 bp, Unknown
  misc_feature (1)..( 13): Result.006 file - promoters50/4901241
cgttgaagaaaaa

SEQ ID NO: 194296 - DNA, 13 bp, Unknown
  misc_feature (1)..( 13): Result.006 file - promoters50/4901241
ggctgatgaaaaa

SEQ ID NO: 194297 - DNA, 13 bp, Unknown
  misc_feature (1)..( 13): Result.006 file - promoters50/4901241
atctgaagaaaaa

SEQ ID NO: 194298 - DNA, 13 bp, Unknown
  misc_feature (1)..( 13): Result.006 file - promoters50/4901241
taaatctgaaaat

SEQ ID NO: 194299 - DNA, 13 bp, Unknown
  misc_feature (1)..( 13): Result.006 file - promoters50/4901241
taaatttgaaaag

SEQ ID NO: 194300 - DNA, 13 bp, Unknown
  misc_feature (1)..( 13): Result.006 file - promoters50/4901241
cttctttgcaaat

SEQ ID NO: 194301 - DNA, 11 bp, Unknown
  misc_feature (1)..( 11): Result.006 file - promoters50/4901241
aaagaatttat

SEQ ID NO: 194302 - DNA, 11 bp, Unknown
  misc_feature (1)..( 11): Result.006 file - promoters50/4901241
gaagaatctga

SEQ ID NO: 194303 - DNA, 11 bp, Unknown
  misc_feature (1)..( 11): Result.006 file - promoters50/4901241
aaagactttag

SEQ ID NO: 194304 - DNA, 11 bp, Unknown
  misc_feature (1)..( 11): Result.006 file - promoters50/4901241
ttagaattaga

SEQ ID NO: 194305 - DNA, 11 bp, Unknown
  misc_feature (1)..( 11): Result.006 file - promoters50/4901241
tatgaataatt

SEQ ID NO: 194306 - DNA, 11 bp, Unknown
  misc_feature (1)..( 11): Result.006 file - promoters50/4901241
aataaattatt

SEQ ID NO: 194307 - DNA, 11 bp, Unknown
  misc_feature (1)..( 11): Result.006 file - promoters50/4901241
cgaaaatatac

SEQ ID NO: 194308 - DNA, 13 bp, Unknown
  misc_feature (1)..( 13): Result.006 file - promoters50/4901241
ataaaatgcacgt

SEQ ID NO: 194309 - DNA, 13 bp, Unknown
  misc_feature (1)..( 13): Result.006 file - promoters50/4901241
atacaataacctc

SEQ ID NO: 194310 - DNA, 12 bp, Unknown
  misc_feature (1)..( 12): Result.006 file - promoters50/4901241
taaaatataaat

SEQ ID NO: 194311 - DNA, 13 bp, Unknown
  misc_feature (1)..( 13): Result.006 file - promoters50/4901241
aaaaaatgtttga

SEQ ID NO: 194312 - DNA, 13 bp, Unknown
  misc_feature (1)..( 13): Result.006 file - promoters50/4901241
tgaaaatacaaat

SEQ ID NO: 194313 - DNA, 13 bp, Unknown
  misc_feature (1)..( 13): Result.006 file - promoters50/4901241
gaaaaattaaaat

SEQ ID NO: 194314 - DNA, 19 bp, Unknown
  misc_feature (1)..( 19): Result.006 file - promoters50/4901241
agtaaaaaaatcttggtca

SEQ ID NO: 194315 - DNA, 19 bp, Unknown
  misc_feature (1)..( 19): Result.006 file - promoters50/4901241
taataaacaataaattatt

SEQ ID NO: 194316 - DNA, 19 bp, Unknown
  misc_feature (1)..( 19): Result.006 file - promoters50/4901241
aaagaaaaaatatttttat

SEQ ID NO: 194317 - DNA, 19 bp, Unknown
  misc_feature (1)..( 19): Result.006 file - promoters50/4901241
agttaaaaaatcttgaaaa

SEQ ID NO: 194318 - DNA, 19 bp, Unknown
  misc_feature (1)..( 19): Result.006 file - promoters50/4901241
cttgaagaaatatttttat

SEQ ID NO: 194319 - DNA, 19 bp, Unknown
  misc_feature (1)..( 19): Result.006 file - promoters50/4901241
taatcagaaattagagatg

SEQ ID NO: 194320 - DNA, 19 bp, Unknown
  misc_feature (1)..( 19): Result.006 file - promoters50/4901241
caccctaagatctagaagc

SEQ ID NO: 194321 - DNA, 9 bp, Unknown
  misc_feature (1)..( 9): Result.006 file - promoters50/4901241
caaaaaaag

SEQ ID NO: 194322 - DNA, 9 bp, Unknown
  misc_feature (1)..( 9): Result.006 file - promoters50/4901241
taaaaaata

SEQ ID NO: 194323 - DNA, 9 bp, Unknown
  misc_feature (1)..( 9): Result.006 file - promoters50/4901241
gaaaaaaac

SEQ ID NO: 194324 - DNA, 9 bp, Unknown
  misc_feature (1)..( 9): Result.006 file - promoters50/4901241
gaaaatata

SEQ ID NO: 194325 - DNA, 9 bp, Unknown
  misc_feature (1)..( 9): Result.006 file - promoters50/4901241
gaaaatata

SEQ ID NO: 194326 - DNA, 9 bp, Unknown
  misc_feature (1)..( 9): Result.006 file - promoters50/4901241
gaaaatggc

SEQ ID NO: 194327 - DNA, 14 bp, Unknown
  misc_feature (1)..( 14): Result.006 file - promoters50/4901241
ctgaaaatacaaat

SEQ ID NO: 194328 - DNA, 14 bp, Unknown
  misc_feature (1)..( 14): Result.006 file - promoters50/4901241
attaaaatatattt

SEQ ID NO: 194329 - DNA, 12 bp, Unknown
  misc_feature (1)..( 12): Result.006 file - promoters50/4901241
taaaatataaat

SEQ ID NO: 194330 - DNA, 14 bp, Unknown
  misc_feature (1)..( 14): Result.006 file - promoters50/4901241
ttgataatatctga

SEQ ID NO: 194331 - DNA, 14 bp, Unknown
  misc_feature (1)..( 14): Result.006 file - promoters50/4901241
tttaaactatagtt

SEQ ID NO: 194332 - DNA, 14 bp, Unknown
  misc_feature (1)..( 14): Result.006 file - promoters50/4901241
attcaaatcaaaat

SEQ ID NO: 194333 - DNA, 16 bp, Unknown
  misc_feature (1)..( 16): Result.006 file - promoters50/4901241
tagtactatcgtttca

SEQ ID NO: 194334 - DNA, 16 bp, Unknown
  misc_feature (1)..( 16): Result.006 file - promoters50/4901241
ttaaactatagttgga

SEQ ID NO: 194335 - DNA, 16 bp, Unknown
  misc_feature (1)..( 16): Result.006 file - promoters50/4901241
ttaaaatatatttaat

SEQ ID NO: 194336 - DNA, 16 bp, Unknown
  misc_feature (1)..( 16): Result.006 file - promoters50/4901241
attcgatatatataat

SEQ ID NO: 194337 - DNA, 16 bp, Unknown
  misc_feature (1)..( 16): Result.006 file - promoters50/4901241
ctgaaatattataata

SEQ ID NO: 194338 - DNA, 16 bp, Unknown
  misc_feature (1)..( 16): Result.006 file - promoters50/4901516
aaaaaatatttttatt

SEQ ID NO: 194339 - DNA, 14 bp, Unknown
  misc_feature (1)..( 14): Result.006 file - promoters50/4901516
aatacaaacacatt

SEQ ID NO: 194340 - DNA, 14 bp, Unknown
  misc_feature (1)..( 14): Result.006 file - promoters50/4901516
gaaacaaaaacatt

SEQ ID NO: 194341 - DNA, 14 bp, Unknown
  misc_feature (1)..( 14): Result.006 file - promoters50/4901516
gaaagaaagctttg

SEQ ID NO: 194342 - DNA, 9 bp, Unknown
  misc_feature (1)..( 9): Result.006 file - promoters50/4901516
aacacaaaa

SEQ ID NO: 194343 - DNA, 9 bp, Unknown
  misc_feature (1)..( 9): Result.006 file - promoters50/4901516
cccactaaa

SEQ ID NO: 194344 - DNA, 9 bp, Unknown
  misc_feature (1)..( 9): Result.006 file - promoters50/4901516
cccactaga

SEQ ID NO: 194345 - DNA, 8 bp, Unknown
  misc_feature (1)..( 8): Result.006 file - promoters50/4901516
tatatatt

SEQ ID NO: 194346 - DNA, 8 bp, Unknown
  misc_feature (1)..( 8): Result.006 file - promoters50/4901516
tatttatt

SEQ ID NO: 194347 - DNA, 8 bp, Unknown
  misc_feature (1)..( 8): Result.006 file - promoters50/4901516
tatataaa

SEQ ID NO: 194348 - DNA, 10 bp, Unknown
  misc_feature (1)..( 10): Result.006 file - promoters50/4901516
tactaagata

SEQ ID NO: 194349 - DNA, 10 bp, Unknown
  misc_feature (1)..( 10): Result.006 file - promoters50/4901516
aaataaaata

SEQ ID NO: 194350 - DNA, 10 bp, Unknown
  misc_feature (1)..( 10): Result.006 file - promoters50/4901528
aaatgaaata

SEQ ID NO: 194351 - DNA, 13 bp, Unknown
  misc_feature (1)..( 13): Result.006 file - promoters50/4901528
taaattcaaaagc

SEQ ID NO: 194352 - DNA, 13 bp, Unknown
  misc_feature (1)..( 13): Result.006 file - promoters50/4901528
taaactcaaaatc

SEQ ID NO: 194353 - DNA, 13 bp, Unknown
  misc_feature (1)..( 13): Result.006 file - promoters50/4901528
aaaatccaatttg

SEQ ID NO: 194354 - DNA, 13 bp, Unknown
  misc_feature (1)..( 13): Result.006 file - promoters50/4901528
tacttccaagatc

SEQ ID NO: 194355 - DNA, 13 bp, Unknown
  misc_feature (1)..( 13): Result.006 file - promoters50/4901564
caaattcacaacc

SEQ ID NO: 194356 - DNA, 17 bp, Unknown
  misc_feature (1)..( 17): Result.006 file - promoters50/4901564
gatgataggcccattac

SEQ ID NO: 194357 - DNA, 17 bp, Unknown
  misc_feature (1)..( 17): Result.006 file - promoters50/4901564
atgtaaaagcccatcgt

SEQ ID NO: 194358 - DNA, 17 bp, Unknown
  misc_feature (1)..( 17): Result.006 file - promoters50/4901564
gcgtctctcccctttac

SEQ ID NO: 194359 - DNA, 17 bp, Unknown
  misc_feature (1)..( 17): Result.006 file - promoters50/4901564
aagcccaagcccactac

SEQ ID NO: 194360 - DNA, 17 bp, Unknown
  misc_feature (1)..( 17): Result.006 file - promoters50/4901564
aaggccaggcccataat

SEQ ID NO: 194361 - DNA, 17 bp, Unknown
  misc_feature (1)..( 17): Result.006 file - promoters50/4901564
cttaataagcccataat

SEQ ID NO: 194362 - DNA, 12 bp, Unknown
  misc_feature (1)..( 12): Result.006 file - promoters50/4901564
atttagatttgg

SEQ ID NO: 194363 - DNA, 12 bp, Unknown
  misc_feature (1)..( 12): Result.006 file - promoters50/4901564
attaagattgtg

SEQ ID NO: 194364 - DNA, 12 bp, Unknown
  misc_feature (1)..( 12): Result.006 file - promoters50/4901564
ttttaaattatt

SEQ ID NO: 194365 - DNA, 12 bp, Unknown
  misc_feature (1)..( 12): Result.006 file - promoters50/4901564
attaaggaaaca

SEQ ID NO: 194366 - DNA, 12 bp, Unknown
  misc_feature (1)..( 12): Result.006 file - promoters50/4901564
ctagagattgtg

SEQ ID NO: 194367 - DNA, 12 bp, Unknown
  misc_feature (1)..( 12): Result.006 file - promoters50/4901568
gttaagatctca

SEQ ID NO: 194368 - DNA, 9 bp, Unknown
  misc_feature (1)..( 9): Result.006 file - promoters50/4901568
gaagatcca

SEQ ID NO: 194369 - DNA, 9 bp, Unknown
  misc_feature (1)..( 9): Result.006 file - promoters50/4901568
gaagatgca

SEQ ID NO: 194370 - DNA, 9 bp, Unknown
  misc_feature (1)..( 9): Result.006 file - promoters50/4901568
aaagttgca

SEQ ID NO: 194371 - DNA, 6 bp, Unknown
  misc_feature (1)..( 6): Result.006 file - promoters50/4901568
tttgga

SEQ ID NO: 194372 - DNA, 6 bp, Unknown
  misc_feature (1)..( 6): Result.006 file - promoters50/4901568
tttgga

SEQ ID NO: 194373 - DNA, 6 bp, Unknown
  misc_feature (1)..( 6): Result.006 file - promoters50/4901568
tttgga

SEQ ID NO: 194374 - DNA, 11 bp, Unknown
  misc_feature (1)..( 11): Result.006 file - promoters50/4901568
gcataaatgaa

SEQ ID NO: 194375 - DNA, 11 bp, Unknown
  misc_feature (1)..( 11): Result.006 file - promoters50/4901568
gcaaaaaatgc

SEQ ID NO: 194376 - DNA, 11 bp, Unknown
  misc_feature (1)..( 11): Result.006 file - promoters50/4901592
aaataaatgaa

SEQ ID NO: 194377 - DNA, 9 bp, Unknown
  misc_feature (1)..( 9): Result.006 file - promoters50/4901592
attgttttg

SEQ ID NO: 194378 - DNA, 9 bp, Unknown
  misc_feature (1)..( 9): Result.006 file - promoters50/4901592
cctgtcttg

SEQ ID NO: 194379 - DNA, 9 bp, Unknown
  misc_feature (1)..( 9): Result.006 file - promoters50/4901592
tttgtttcg

SEQ ID NO: 194380 - DNA, 9 bp, Unknown
  misc_feature (1)..( 9): Result.006 file - promoters50/4901592
tttgttgac

SEQ ID NO: 194381 - DNA, 7 bp, Unknown
  misc_feature (1)..( 7): Result.006 file - promoters50/4901592
tttattg

SEQ ID NO: 194382 - DNA, 7 bp, Unknown
  misc_feature (1)..( 7): Result.006 file - promoters50/4901592
tttcttg

SEQ ID NO: 194383 - DNA, 7 bp, Unknown
  misc_feature (1)..( 7): Result.006 file - promoters50/4901592
tttgttg

SEQ ID NO: 194384 - DNA, 7 bp, Unknown
  misc_feature (1)..( 7): Result.006 file - promoters50/4901592
tttgttt

SEQ ID NO: 194385 - DNA, 8 bp, Unknown
  misc_feature (1)..( 8): Result.006 file - promoters50/4901592
ttttgtaa

SEQ ID NO: 194386 - DNA, 8 bp, Unknown
  misc_feature (1)..( 8): Result.006 file - promoters50/4901592
atttgtaa

SEQ ID NO: 194387 - DNA, 8 bp, Unknown
  misc_feature (1)..( 8): Result.006 file - promoters50/4901592
atttgttt

SEQ ID NO: 194388 - DNA, 8 bp, Unknown
  misc_feature (1)..( 8): Result.006 file - promoters50/4901673
gtttgttg

SEQ ID NO: 194389 - DNA, 7 bp, Unknown
  misc_feature (1)..( 7): Result.006 file - promoters50/4901673
aattcaa

SEQ ID NO: 194390 - DNA, 7 bp, Unknown
  misc_feature (1)..( 7): Result.006 file - promoters50/4901673
aattcat

SEQ ID NO: 194391 - DNA, 7 bp, Unknown
  misc_feature (1)..( 7): Result.006 file - promoters50/4901673
gattcaa

SEQ ID NO: 194392 - DNA, 9 bp, Unknown
  misc_feature (1)..( 9): Result.006 file - promoters50/4901673
tatttaagc

SEQ ID NO: 194393 - DNA, 9 bp, Unknown
  misc_feature (1)..( 9): Result.006 file - promoters50/4901673
tatttaatt

SEQ ID NO: 194394 - DNA, 9 bp, Unknown
  misc_feature (1)..( 9): Result.006 file - promoters50/4901673
gttttcagc

SEQ ID NO: 194395 - DNA, 13 bp, Unknown
  misc_feature (1)..( 13): Result.006 file - promoters50/4901673
ttcttagctacgt

SEQ ID NO: 194396 - DNA, 13 bp, Unknown
  misc_feature (1)..( 13): Result.006 file - promoters50/4901673
ttcctagatacag

SEQ ID NO: 194397 - DNA, 13 bp, Unknown
  misc_feature (1)..( 13): Result.006 file - promoters50/4901673
gattccgatccag

SEQ ID NO: 194398 - DNA, 8 bp, Unknown
  misc_feature (1)..( 8): Result.006 file - promoters50/4901673
tttcaata

SEQ ID NO: 194399 - DNA, 8 bp, Unknown
  misc_feature (1)..( 8): Result.006 file - promoters50/4901673
attccata

SEQ ID NO: 194400 - DNA, 8 bp, Unknown
  misc_feature (1)..( 8): Result.006 file - promoters50/4901736
attccagc

SEQ ID NO: 194401 - DNA, 11 bp, Unknown
  misc_feature (1)..( 11): Result.006 file - promoters50/4901736
aagtttgtttg

SEQ ID NO: 194402 - DNA, 11 bp, Unknown
  misc_feature (1)..( 11): Result.006 file - promoters50/4901736
taggttgtttt

SEQ ID NO: 194403 - DNA, 11 bp, Unknown
  misc_feature (1)..( 11): Result.006 file - promoters50/4901736
atgattgtttt

SEQ ID NO: 194404 - DNA, 11 bp, Unknown
  misc_feature (1)..( 11): Result.006 file - promoters50/4901736
ataattttttt

SEQ ID NO: 194405 - DNA, 11 bp, Unknown
  misc_feature (1)..( 11): Result.006 file - promoters50/4901736
taaattttggt

SEQ ID NO: 194406 - DNA, 11 bp, Unknown
  misc_feature (1)..( 11): Result.006 file - promoters50/4901736
caaatttgtct

SEQ ID NO: 194407 - DNA, 13 bp, Unknown
  misc_feature (1)..( 13): Result.006 file - promoters50/4901736
caaagtttgtttg

SEQ ID NO: 194408 - DNA, 13 bp, Unknown
  misc_feature (1)..( 13): Result.006 file - promoters50/4901736
taaattttggtaa

SEQ ID NO: 194409 - DNA, 13 bp, Unknown
  misc_feature (1)..( 13): Result.006 file - promoters50/4901736
tttattttagatt

SEQ ID NO: 194410 - DNA, 13 bp, Unknown
  misc_feature (1)..( 13): Result.006 file - promoters50/4901736
tttcttttaccct

SEQ ID NO: 194411 - DNA, 13 bp, Unknown
  misc_feature (1)..( 13): Result.006 file - promoters50/4901736
attgttttggttg

SEQ ID NO: 194412 - DNA, 13 bp, Unknown
  misc_feature (1)..( 13): Result.006 file - promoters50/4901736
caaatttgtctca

SEQ ID NO: 194413 - DNA, 13 bp, Unknown
  misc_feature (1)..( 13): Result.006 file - promoters50/4901736
aagactttgggtg

SEQ ID NO: 194414 - DNA, 10 bp, Unknown
  misc_feature (1)..( 10): Result.006 file - promoters50/4901736
atggcccaat

SEQ ID NO: 194415 - DNA, 10 bp, Unknown
  misc_feature (1)..( 10): Result.006 file - promoters50/4901736
taggcccata

SEQ ID NO: 194416 - DNA, 10 bp, Unknown
  misc_feature (1)..( 10): Result.006 file - promoters50/4901736
aaggcccaat

SEQ ID NO: 194417 - DNA, 10 bp, Unknown
  misc_feature (1)..( 10): Result.006 file - promoters50/4901736
aaggcccaaa

SEQ ID NO: 194418 - DNA, 10 bp, Unknown
  misc_feature (1)..( 10): Result.006 file - promoters50/4901736
tgggccgaat

SEQ ID NO: 194419 - DNA, 10 bp, Unknown
  misc_feature (1)..( 10): Result.006 file - promoters50/4901793
aagaccctaa

SEQ ID NO: 194420 - DNA, 8 bp, Unknown
  misc_feature (1)..( 8): Result.006 file - promoters50/4901793
taacttat

SEQ ID NO: 194421 - DNA, 8 bp, Unknown
  misc_feature (1)..( 8): Result.006 file - promoters50/4901793
taaattac

SEQ ID NO: 194422 - DNA, 8 bp, Unknown
  misc_feature (1)..( 8): Result.006 file - promoters50/4901822
aaacatat

SEQ ID NO: 194423 - DNA, 10 bp, Unknown
  misc_feature (1)..( 10): Result.006 file - promoters50/4901822
tgagtcaata

SEQ ID NO: 194424 - DNA, 10 bp, Unknown
  misc_feature (1)..( 10): Result.006 file - promoters50/4901822
tgaatcaata

SEQ ID NO: 194425 - DNA, 10 bp, Unknown
  misc_feature (1)..( 10): Result.006 file - promoters50/4901822
tgattcaaaa

SEQ ID NO: 194426 - DNA, 10 bp, Unknown
  misc_feature (1)..( 10): Result.006 file - promoters50/4901822
atggtttttg

SEQ ID NO: 194427 - DNA, 10 bp, Unknown
  misc_feature (1)..( 10): Result.006 file - promoters50/4901822
aaggtgtttg

SEQ ID NO: 194428 - DNA, 10 bp, Unknown
  misc_feature (1)..( 10): Result.006 file - promoters50/4901822
atgatttgag

SEQ ID NO: 194429 - DNA, 7 bp, Unknown
  misc_feature (1)..( 7): Result.006 file - promoters50/4901822
catgtga

SEQ ID NO: 194430 - DNA, 7 bp, Unknown
  misc_feature (1)..( 7): Result.006 file - promoters50/4901822
catttga

SEQ ID NO: 194431 - DNA, 7 bp, Unknown
  misc_feature (1)..( 7): Result.006 file - promoters50/4901822
aatgtga

SEQ ID NO: 194432 - DNA, 8 bp, Unknown
  misc_feature (1)..( 8): Result.006 file - promoters50/4901822
ttaaccct

SEQ ID NO: 194433 - DNA, 8 bp, Unknown
  misc_feature (1)..( 8): Result.006 file - promoters50/4901822
ttaacctt

SEQ ID NO: 194434 - DNA, 8 bp, Unknown
  misc_feature (1)..( 8): Result.006 file - promoters50/4901823
ctaatctt

SEQ ID NO: 194435 - DNA, 11 bp, Unknown
  misc_feature (1)..( 11): Result.006 file - promoters50/4901823
attttttttgt

SEQ ID NO: 194436 - DNA, 11 bp, Unknown
  misc_feature (1)..( 11): Result.006 file - promoters50/4901823
atttttcagtc

SEQ ID NO: 194437 - DNA, 11 bp, Unknown
  misc_feature (1)..( 11): Result.006 file - promoters50/4901823
tttttttgtgt

SEQ ID NO: 194438 - DNA, 10 bp, Unknown
  misc_feature (1)..( 10): Result.006 file - promoters50/4901823
ttgcattttt

SEQ ID NO: 194439 - DNA, 10 bp, Unknown
  misc_feature (1)..( 10): Result.006 file - promoters50/4901823
ttgaattttt

SEQ ID NO: 194440 - DNA, 10 bp, Unknown
  misc_feature (1)..( 10): Result.006 file - promoters50/4901842
ttgtattcac

SEQ ID NO: 194441 - DNA, 8 bp, Unknown
  misc_feature (1)..( 8): Result.006 file - promoters50/4901842
ggaaaaaa

SEQ ID NO: 194442 - DNA, 8 bp, Unknown
  misc_feature (1)..( 8): Result.006 file - promoters50/4901842
ggaagaaa

SEQ ID NO: 194443 - DNA, 8 bp, Unknown
  misc_feature (1)..( 8): Result.006 file - promoters50/4901842
aaaagaaa

SEQ ID NO: 194444 - DNA, 7 bp, Unknown
  misc_feature (1)..( 7): Result.006 file - promoters50/4901842
caaatag

SEQ ID NO: 194445 - DNA, 7 bp, Unknown
  misc_feature (1)..( 7): Result.006 file - promoters50/4901842
caaataa

SEQ ID NO: 194446 - DNA, 7 bp, Unknown
  misc_feature (1)..( 7): Result.006 file - promoters50/4901842
caagtaa

SEQ ID NO: 194447 - DNA, 8 bp, Unknown
  misc_feature (1)..( 8): Result.006 file - promoters50/4901842
taaagcaa

SEQ ID NO: 194448 - DNA, 8 bp, Unknown
  misc_feature (1)..( 8): Result.006 file - promoters50/4901842
taaggcac

SEQ ID NO: 194449 - DNA, 8 bp, Unknown
  misc_feature (1)..( 8): Result.006 file - promoters50/4901884
caaagcaa

SEQ ID NO: 194450 - DNA, 10 bp, Unknown
  misc_feature (1)..( 10): Result.006 file - promoters50/4901884
aaaaaactta

SEQ ID NO: 194451 - DNA, 10 bp, Unknown
  misc_feature (1)..( 10): Result.006 file - promoters50/4901884
ataaaacttt

SEQ ID NO: 194452 - DNA, 10 bp, Unknown
  misc_feature (1)..( 10): Result.006 file - promoters50/4901884
aaaaaaatta

SEQ ID NO: 194453 - DNA, 10 bp, Unknown
  misc_feature (1)..( 10): Result.006 file - promoters50/4901884
ctaaaaacgg

SEQ ID NO: 194454 - DNA, 10 bp, Unknown
  misc_feature (1)..( 10): Result.006 file - promoters50/4901884
agaaaacaat

SEQ ID NO: 194455 - DNA, 12 bp, Unknown
  misc_feature (1)..( 12): Result.006 file - promoters50/4901884
tgagatactaaa

SEQ ID NO: 194456 - DNA, 12 bp, Unknown
  misc_feature (1)..( 12): Result.006 file - promoters50/4901884
tgagacactttc

SEQ ID NO: 194457 - DNA, 12 bp, Unknown
  misc_feature (1)..( 12): Result.006 file - promoters50/4901884
aaaaataataaa

SEQ ID NO: 194458 - DNA, 12 bp, Unknown
  misc_feature (1)..( 12): Result.006 file - promoters50/4901884
gcaaaaaatgat

SEQ ID NO: 194459 - DNA, 12 bp, Unknown
  misc_feature (1)..( 12): Result.006 file - promoters50/4901884
gaaaacaatctt

SEQ ID NO: 194460 - DNA, 12 bp, Unknown
  misc_feature (1)..( 12): Result.006 file - promoters50/4901884
atataaagaaaa

SEQ ID NO: 194461 - DNA, 12 bp, Unknown
  misc_feature (1)..( 12): Result.006 file - promoters50/4901884
aacaaaacaaac

SEQ ID NO: 194462 - DNA, 12 bp, Unknown
  misc_feature (1)..( 12): Result.006 file - promoters50/4901884
tttgaaagaagt

SEQ ID NO: 194463 - DNA, 12 bp, Unknown
  misc_feature (1)..( 12): Result.006 file - promoters50/4901884
aacaaaacaaaa

SEQ ID NO: 194464 - DNA, 12 bp, Unknown
  misc_feature (1)..( 12): Result.006 file - promoters50/4902029
caaactacaaaa

SEQ ID NO: 194465 - DNA, 10 bp, Unknown
  misc_feature (1)..( 10): Result.006 file - promoters50/4902029
ctttttattt

SEQ ID NO: 194466 - DNA, 10 bp, Unknown
  misc_feature (1)..( 10): Result.006 file - promoters50/4902029
aattttgttt

SEQ ID NO: 194467 - DNA, 10 bp, Unknown
  misc_feature (1)..( 10): Result.006 file - promoters50/4902029
ctttttaact

SEQ ID NO: 194468 - DNA, 7 bp, Unknown
  misc_feature (1)..( 7): Result.006 file - promoters50/4902029
cattaaa

SEQ ID NO: 194469 - DNA, 7 bp, Unknown
  misc_feature (1)..( 7): Result.006 file - promoters50/4902029
cataaaa

SEQ ID NO: 194470 - DNA, 7 bp, Unknown
  misc_feature (1)..( 7): Result.006 file - promoters50/4902029
cataaag

SEQ ID NO: 194471 - DNA, 14 bp, Unknown
  misc_feature (1)..( 14): Result.006 file - promoters50/4902029
tattagtctttttc

SEQ ID NO: 194472 - DNA, 14 bp, Unknown
  misc_feature (1)..( 14): Result.006 file - promoters50/4902029
actatatgtttttc

SEQ ID NO: 194473 - DNA, 14 bp, Unknown
  misc_feature (1)..( 14): Result.006 file - promoters50/4902038
tttacttctcttta

SEQ ID NO: 194474 - DNA, 8 bp, Unknown
  misc_feature (1)..( 8): Result.006 file - promoters50/4902038
tgaaaact

SEQ ID NO: 194475 - DNA, 8 bp, Unknown
  misc_feature (1)..( 8): Result.006 file - promoters50/4902038
ataaaact

SEQ ID NO: 194476 - DNA, 8 bp, Unknown
  misc_feature (1)..( 8): Result.006 file - promoters50/4902038
tgagaact

SEQ ID NO: 194477 - DNA, 7 bp, Unknown
  misc_feature (1)..( 7): Result.006 file - promoters50/4902038
tacgaaa

SEQ ID NO: 194478 - DNA, 7 bp, Unknown
  misc_feature (1)..( 7): Result.006 file - promoters50/4902038
cacgaaa

SEQ ID NO: 194479 - DNA, 7 bp, Unknown
  misc_feature (1)..( 7): Result.006 file - promoters50/4902082
cactaaa

SEQ ID NO: 194480 - DNA, 13 bp, Unknown
  misc_feature (1)..( 13): Result.006 file - promoters50/4902082
ttccttcacattg

SEQ ID NO: 194481 - DNA, 13 bp, Unknown
  misc_feature (1)..( 13): Result.006 file - promoters50/4902082
agtattcccatta

SEQ ID NO: 194482 - DNA, 13 bp, Unknown
  misc_feature (1)..( 13): Result.006 file - promoters50/4902082
ttccctcacattg

SEQ ID NO: 194483 - DNA, 8 bp, Unknown
  misc_feature (1)..( 8): Result.006 file - promoters50/4902082
gtaaattt

SEQ ID NO: 194484 - DNA, 8 bp, Unknown
  misc_feature (1)..( 8): Result.006 file - promoters50/4902082
ataatttt

SEQ ID NO: 194485 - DNA, 9 bp, Unknown
  misc_feature (1)..( 9): Result.006 file - promoters50/4902143
ataatgttt

SEQ ID NO: 194486 - DNA, 7 bp, Unknown
  misc_feature (1)..( 7): Result.006 file - promoters50/4902143
cggttta

SEQ ID NO: 194487 - DNA, 7 bp, Unknown
  misc_feature (1)..( 7): Result.006 file - promoters50/4902143
tggttta

SEQ ID NO: 194488 - DNA, 7 bp, Unknown
  misc_feature (1)..( 7): Result.006 file - promoters50/4902387
atgtttt

SEQ ID NO: 194489 - DNA, 11 bp, Unknown
  misc_feature (1)..( 11): Result.006 file - promoters50/4902387
atctaaataaa

SEQ ID NO: 194490 - DNA, 11 bp, Unknown
  misc_feature (1)..( 11): Result.006 file - promoters50/4902387
atctgaatact

SEQ ID NO: 194491 - DNA, 11 bp, Unknown
  misc_feature (1)..( 11): Result.006 file - promoters50/4902387
tattaaacaaa

SEQ ID NO: 194492 - DNA, 11 bp, Unknown
  misc_feature (1)..( 11): Result.006 file - promoters50/4902387
aaatgaattta

SEQ ID NO: 194493 - DNA, 11 bp, Unknown
  misc_feature (1)..( 11): Result.006 file - promoters50/4902387
tgctgaatctt

SEQ ID NO: 194494 - DNA, 11 bp, Unknown
  misc_feature (1)..( 11): Result.006 file - promoters50/4902387
taggcaacaaa

SEQ ID NO: 194495 - DNA, 9 bp, Unknown
  misc_feature (1)..( 9): Result.006 file - promoters50/4902387
caatgttta

SEQ ID NO: 194496 - DNA, 9 bp, Unknown
  misc_feature (1)..( 9): Result.006 file - promoters50/4902387
aaatgttga

SEQ ID NO: 194497 - DNA, 9 bp, Unknown
  misc_feature (1)..( 9): Result.006 file - promoters50/4902387
acatgtttt

SEQ ID NO: 194498 - DNA, 9 bp, Unknown
  misc_feature (1)..( 9): Result.006 file - promoters50/4902387
caatgatta

SEQ ID NO: 194499 - DNA, 9 bp, Unknown
  misc_feature (1)..( 9): Result.006 file - promoters50/4902387
tcatgttta

SEQ ID NO: 194500 - DNA, 9 bp, Unknown
  misc_feature (1)..( 9): Result.006 file - promoters50/4902425
tcattttta

SEQ ID NO: 194501 - DNA, 9 bp, Unknown
  misc_feature (1)..( 9): Result.006 file - promoters50/4902425
ccactacac

SEQ ID NO: 194502 - DNA, 9 bp, Unknown
  misc_feature (1)..( 9): Result.006 file - promoters50/4902425
ccactacat

SEQ ID NO: 194503 - DNA, 9 bp, Unknown
  misc_feature (1)..( 9): Result.006 file - promoters50/4902456
tcactccat

SEQ ID NO: 194504 - DNA, 10 bp, Unknown
  misc_feature (1)..( 10): Result.006 file - promoters50/4902456
acatatgttt

SEQ ID NO: 194505 - DNA, 10 bp, Unknown
  misc_feature (1)..( 10): Result.006 file - promoters50/4902456
ctatatgtat

SEQ ID NO: 194506 - DNA, 10 bp, Unknown
  misc_feature (1)..( 10): Result.006 file - promoters50/4902456
cactatcttt

SEQ ID NO: 194507 - DNA, 10 bp, Unknown
  misc_feature (1)..( 10): Result.006 file - promoters50/4902456
caccatctcc

SEQ ID NO: 194508 - DNA, 9 bp, Unknown
  misc_feature (1)..( 9): Result.006 file - promoters50/4902456
taaaaaaca

SEQ ID NO: 194509 - DNA, 9 bp, Unknown
  misc_feature (1)..( 9): Result.006 file - promoters50/4902456
gaaaaaaca

SEQ ID NO: 194510 - DNA, 9 bp, Unknown
  misc_feature (1)..( 9): Result.006 file - promoters50/4902456
gaaaaaaga

SEQ ID NO: 194511 - DNA, 9 bp, Unknown
  misc_feature (1)..( 9): Result.006 file - promoters50/4902456
ataaaaaca

SEQ ID NO: 194512 - DNA, 9 bp, Unknown
  misc_feature (1)..( 9): Result.006 file - promoters50/4902456
gaaattata

SEQ ID NO: 194513 - DNA, 9 bp, Unknown
  misc_feature (1)..( 9): Result.006 file - promoters50/4902456
aaaaatatc

SEQ ID NO: 194514 - DNA, 9 bp, Unknown
  misc_feature (1)..( 9): Result.006 file - promoters50/4902456
aaaaataag

SEQ ID NO: 194515 - DNA, 9 bp, Unknown
  misc_feature (1)..( 9): Result.006 file - promoters50/4902456
gaaaacaag

SEQ ID NO: 194516 - DNA, 7 bp, Unknown
  misc_feature (1)..( 7): Result.006 file - promoters50/4902456
aaaaaag

SEQ ID NO: 194517 - DNA, 7 bp, Unknown
  misc_feature (1)..( 7): Result.006 file - promoters50/4902456
aaagaag

SEQ ID NO: 194518 - DNA, 7 bp, Unknown
  misc_feature (1)..( 7): Result.006 file - promoters50/4902456
aaaaaaa

SEQ ID NO: 194519 - DNA, 8 bp, Unknown
  misc_feature (1)..( 8): Result.006 file - promoters50/4902456
ggatattc

SEQ ID NO: 194520 - DNA, 8 bp, Unknown
  misc_feature (1)..( 8): Result.006 file - promoters50/4902456
agatatta

SEQ ID NO: 194521 - DNA, 8 bp, Unknown
  misc_feature (1)..( 8): Result.006 file - promoters50/4902456
agatattt

SEQ ID NO: 194522 - DNA, 8 bp, Unknown
  misc_feature (1)..( 8): Result.006 file - promoters50/4902456
agatttta

SEQ ID NO: 194523 - DNA, 8 bp, Unknown
  misc_feature (1)..( 8): Result.006 file - promoters50/4902456
aaatagat

SEQ ID NO: 194524 - DNA, 8 bp, Unknown
  misc_feature (1)..( 8): Result.006 file - promoters50/4902456
aaaaagag

SEQ ID NO: 194525 - DNA, 8 bp, Unknown
  misc_feature (1)..( 8): Result.006 file - promoters50/4902456
gaattgat

SEQ ID NO: 194526 - DNA, 9 bp, Unknown
  misc_feature (1)..( 9): Result.006 file - promoters50/4902456
taattttat

SEQ ID NO: 194527 - DNA, 9 bp, Unknown
  misc_feature (1)..( 9): Result.006 file - promoters50/4902456
tttttttat

SEQ ID NO: 194528 - DNA, 10 bp, Unknown
  misc_feature (1)..( 10): Result.006 file - promoters50/4902791
ctttttctat

SEQ ID NO: 194529 - DNA, 10 bp, Unknown
  misc_feature (1)..( 10): Result.006 file - promoters50/4902791
aatattttta

SEQ ID NO: 194530 - DNA, 10 bp, Unknown
  misc_feature (1)..( 10): Result.006 file - promoters50/4902791
gatatttttg

SEQ ID NO: 194531 - DNA, 10 bp, Unknown
  misc_feature (1)..( 10): Result.006 file - promoters50/4902791
tccattttta

SEQ ID NO: 194532 - DNA, 10 bp, Unknown
  misc_feature (1)..( 10): Result.006 file - promoters50/4902791
gtaatttttg

SEQ ID NO: 194533 - DNA, 10 bp, Unknown
  misc_feature (1)..( 10): Result.006 file - promoters50/4902791
gccactttga

SEQ ID NO: 194534 - DNA, 10 bp, Unknown
  misc_feature (1)..( 10): Result.006 file - promoters50/4903159
gccactgagt

SEQ ID NO: 194535 - DNA, 13 bp, Unknown
  misc_feature (1)..( 13): Result.006 file - promoters50/4903159
tcggtttaaataa

SEQ ID NO: 194536 - DNA, 13 bp, Unknown
  misc_feature (1)..( 13): Result.006 file - promoters50/4903159
attagttaaataa

SEQ ID NO: 194537 - DNA, 13 bp, Unknown
  misc_feature (1)..( 13): Result.006 file - promoters50/4903159
atttgttaaactg

SEQ ID NO: 194538 - DNA, 13 bp, Unknown
  misc_feature (1)..( 13): Result.006 file - promoters50/4903171
tattgttaatata

SEQ ID NO: 194539 - DNA, 9 bp, Unknown
  misc_feature (1)..( 9): Result.006 file - promoters50/4903171
atatgattt

SEQ ID NO: 194540 - DNA, 9 bp, Unknown
  misc_feature (1)..( 9): Result.006 file - promoters50/4903171
atatgattt

SEQ ID NO: 194541 - DNA, 7 bp, Unknown
  misc_feature (1)..( 7): Result.006 file - promoters50/4903171
atgtttt

SEQ ID NO: 194542 - DNA, 8 bp, Unknown
  misc_feature (1)..( 8): Result.006 file - promoters50/4903171
tcttcgaa

SEQ ID NO: 194543 - DNA, 8 bp, Unknown
  misc_feature (1)..( 8): Result.006 file - promoters50/4903171
acttagaa

SEQ ID NO: 194544 - DNA, 8 bp, Unknown
  misc_feature (1)..( 8): Result.006 file - promoters50/4903171
actaagaa

SEQ ID NO: 194545 - DNA, 8 bp, Unknown
  misc_feature (1)..( 8): Result.006 file - promoters50/4903171
gaaaaatc

SEQ ID NO: 194546 - DNA, 8 bp, Unknown
  misc_feature (1)..( 8): Result.006 file - promoters50/4903171
gaaaaatg

SEQ ID NO: 194547 - DNA, 8 bp, Unknown
  misc_feature (1)..( 8): Result.006 file - promoters50/4903171
ttaaaatc

SEQ ID NO: 194548 - DNA, 7 bp, Unknown
  misc_feature (1)..( 7): Result.006 file - promoters50/4903171
gattgga

SEQ ID NO: 194549 - DNA, 7 bp, Unknown
  misc_feature (1)..( 7): Result.006 file - promoters50/4903171
aattgga

SEQ ID NO: 194550 - DNA, 7 bp, Unknown
  misc_feature (1)..( 7): Result.006 file - promoters50/4903178
gattgga

SEQ ID NO: 194551 - DNA, 10 bp, Unknown
  misc_feature (1)..( 10): Result.006 file - promoters50/4903178
agataaataa

SEQ ID NO: 194552 - DNA, 10 bp, Unknown
  misc_feature (1)..( 10): Result.006 file - promoters50/4903178
aattaaatat

SEQ ID NO: 194553 - DNA, 10 bp, Unknown
  misc_feature (1)..( 10): Result.006 file - promoters50/4903178
ttctaattaa

SEQ ID NO: 194554 - DNA, 10 bp, Unknown
  misc_feature (1)..( 10): Result.006 file - promoters50/4903178
gattaattac

SEQ ID NO: 194555 - DNA, 11 bp, Unknown
  misc_feature (1)..( 11): Result.006 file - promoters50/4903178
actctgtattc

SEQ ID NO: 194556 - DNA, 11 bp, Unknown
  misc_feature (1)..( 11): Result.006 file - promoters50/4903178
tttctttattc

SEQ ID NO: 194557 - DNA, 11 bp, Unknown
  misc_feature (1)..( 11): Result.006 file - promoters50/4903178
actctgtctaa

SEQ ID NO: 194558 - DNA, 11 bp, Unknown
  misc_feature (1)..( 11): Result.006 file - promoters50/4903407
tgtatgcatta

SEQ ID NO: 194559 - DNA, 16 bp, Unknown
  misc_feature (1)..( 16): Result.006 file - promoters50/4903407
ataaaaatatattaat

SEQ ID NO: 194560 - DNA, 16 bp, Unknown
  misc_feature (1)..( 16): Result.006 file - promoters50/4903407
ccaaagatatatctga

SEQ ID NO: 194561 - DNA, 16 bp, Unknown
  misc_feature (1)..( 16): Result.006 file - promoters50/4903407
cttataatttatagtc

SEQ ID NO: 194562 - DNA, 16 bp, Unknown
  misc_feature (1)..( 16): Result.006 file - promoters50/4903407
tgacaaatttattgtt

SEQ ID NO: 194563 - DNA, 16 bp, Unknown
  misc_feature (1)..( 16): Result.006 file - promoters50/4903407
acagctttctatgtct

SEQ ID NO: 194564 - DNA, 16 bp, Unknown
  misc_feature (1)..( 16): Result.006 file - promoters50/4903407
ccaaaaataatagtaa

SEQ ID NO: 194565 - DNA, 16 bp, Unknown
  misc_feature (1)..( 16): Result.006 file - promoters50/4903407
aataaactaaacactg

SEQ ID NO: 194566 - DNA, 9 bp, Unknown
  misc_feature (1)..( 9): Result.006 file - promoters50/4903407
tttctttat

SEQ ID NO: 194567 - DNA, 9 bp, Unknown
  misc_feature (1)..( 9): Result.006 file - promoters50/4903407
tttatttat

SEQ ID NO: 194568 - DNA, 9 bp, Unknown
  misc_feature (1)..( 9): Result.006 file - promoters50/4903407
tttattttt

SEQ ID NO: 194569 - DNA, 9 bp, Unknown
  misc_feature (1)..( 9): Result.006 file - promoters50/4903407
tttcttgta

SEQ ID NO: 194570 - DNA, 9 bp, Unknown
  misc_feature (1)..( 9): Result.006 file - promoters50/4903407
tttgtttta

SEQ ID NO: 194571 - DNA, 9 bp, Unknown
  misc_feature (1)..( 9): Result.006 file - promoters50/4903407
tttatctcc

SEQ ID NO: 194572 - DNA, 9 bp, Unknown
  misc_feature (1)..( 9): Result.006 file - promoters50/4903407
agttattta

SEQ ID NO: 194573 - DNA, 9 bp, Unknown
  misc_feature (1)..( 9): Result.006 file - promoters50/4903407
gtttatttt

SEQ ID NO: 194574 - DNA, 9 bp, Unknown
  misc_feature (1)..( 9): Result.006 file - promoters50/4903407
cattatttt

SEQ ID NO: 194575 - DNA, 9 bp, Unknown
  misc_feature (1)..( 9): Result.006 file - promoters50/4903407
cattgtttt

SEQ ID NO: 194576 - DNA, 9 bp, Unknown
  misc_feature (1)..( 9): Result.006 file - promoters50/4903407
ccatatttt

SEQ ID NO: 194577 - DNA, 9 bp, Unknown
  misc_feature (1)..( 9): Result.006 file - promoters50/4903407
gtttattac

SEQ ID NO: 194578 - DNA, 12 bp, Unknown
  misc_feature (1)..( 12): Result.006 file - promoters50/4903407
aattaaaactat

SEQ ID NO: 194579 - DNA, 12 bp, Unknown
  misc_feature (1)..( 12): Result.006 file - promoters50/4903407
ttttaaaaatgt

SEQ ID NO: 194580 - DNA, 12 bp, Unknown
  misc_feature (1)..( 12): Result.006 file - promoters50/4903407
gtttataaccaa

SEQ ID NO: 194581 - DNA, 12 bp, Unknown
  misc_feature (1)..( 12): Result.006 file - promoters50/4903407
aaataaactaaa

SEQ ID NO: 194582 - DNA, 12 bp, Unknown
  misc_feature (1)..( 12): Result.006 file - promoters50/4903407
tcctaaaatagt

SEQ ID NO: 194583 - DNA, 12 bp, Unknown
  misc_feature (1)..( 12): Result.006 file - promoters50/4903407
aaataaatcgta

SEQ ID NO: 194584 - DNA, 15 bp, Unknown
  misc_feature (1)..( 15): Result.006 file - promoters50/4903407
acaaattaaaactat

SEQ ID NO: 194585 - DNA, 15 bp, Unknown
  misc_feature (1)..( 15): Result.006 file - promoters50/4903407
caaaaataatagtaa

SEQ ID NO: 194586 - DNA, 15 bp, Unknown
  misc_feature (1)..( 15): Result.006 file - promoters50/4903407
gaaaaataaactaaa

SEQ ID NO: 194587 - DNA, 16 bp, Unknown
  misc_feature (1)..( 16): Result.006 file - promoters50/4903407
ccaaagatatatctga

SEQ ID NO: 194588 - DNA, 16 bp, Unknown
  misc_feature (1)..( 16): Result.006 file - promoters50/4903407
cctaaaatagtttcaa

SEQ ID NO: 194589 - DNA, 16 bp, Unknown
  misc_feature (1)..( 16): Result.006 file - promoters50/4903407
gtaaatatatttgaga

SEQ ID NO: 194590 - DNA, 16 bp, Unknown
  misc_feature (1)..( 16): Result.006 file - promoters50/4903614
ttcgaaataaatgaca

SEQ ID NO: 194591 - DNA, 10 bp, Unknown
  misc_feature (1)..( 10): Result.006 file - promoters50/4903614
acaatttaaa

SEQ ID NO: 194592 - DNA, 10 bp, Unknown
  misc_feature (1)..( 10): Result.006 file - promoters50/4903614
ttaatataaa

SEQ ID NO: 194593 - DNA, 10 bp, Unknown
  misc_feature (1)..( 10): Result.006 file - promoters50/4903653
ttattataaa

SEQ ID NO: 194594 - DNA, 10 bp, Unknown
  misc_feature (1)..( 10): Result.006 file - promoters50/4903653
cttgtatacg

SEQ ID NO: 194595 - DNA, 10 bp, Unknown
  misc_feature (1)..( 10): Result.006 file - promoters50/4903653
tttgtatttc

SEQ ID NO: 194596 - DNA, 10 bp, Unknown
  misc_feature (1)..( 10): Result.006 file - promoters50/4903653
tttgtttttc

SEQ ID NO: 194597 - DNA, 10 bp, Unknown
  misc_feature (1)..( 10): Result.006 file - promoters50/4903653
tttgtaaaaa

SEQ ID NO: 194598 - DNA, 12 bp, Unknown
  misc_feature (1)..( 12): Result.006 file - promoters50/4903653
ttaaaaaaaaaa

SEQ ID NO: 194599 - DNA, 12 bp, Unknown
  misc_feature (1)..( 12): Result.006 file - promoters50/4903653
acaaaacaaaaa

SEQ ID NO: 194600 - DNA, 12 bp, Unknown
  misc_feature (1)..( 12): Result.006 file - promoters50/4903653
ttataaaaacga

SEQ ID NO: 194601 - DNA, 12 bp, Unknown
  misc_feature (1)..( 12): Result.006 file - promoters50/4906473
ggccaaaaaccc

SEQ ID NO: 194602 - DNA, 8 bp, Unknown
  misc_feature (1)..( 8): Result.006 file - promoters50/4906473
ttttgaaa

SEQ ID NO: 194603 - DNA, 8 bp, Unknown
  misc_feature (1)..( 8): Result.006 file - promoters50/4906473
tttggaag

SEQ ID NO: 194604 - DNA, 8 bp, Unknown
  misc_feature (1)..( 8): Result.006 file - promoters50/4907396
tgtggaag

SEQ ID NO: 194605 - DNA, 11 bp, Unknown
  misc_feature (1)..( 11): Result.006 file - promoters50/4907396
atctatagtcg

SEQ ID NO: 194606 - DNA, 11 bp, Unknown
  misc_feature (1)..( 11): Result.006 file - promoters50/4907396
atctttagtta

SEQ ID NO: 194607 - DNA, 11 bp, Unknown
  misc_feature (1)..( 11): Result.006 file - promoters50/4909449
tttcttaatta

SEQ ID NO: 194608 - DNA, 10 bp, Unknown
  misc_feature (1)..( 10): Result.006 file - promoters50/4909449
ttattaataa

SEQ ID NO: 194609 - DNA, 10 bp, Unknown
  misc_feature (1)..( 10): Result.006 file - promoters50/4909449
ctatttatac

SEQ ID NO: 194610 - DNA, 10 bp, Unknown
  misc_feature (1)..( 10): Result.006 file - promoters50/4909449
gtaataataa

SEQ ID NO: 194611 - DNA, 10 bp, Unknown
  misc_feature (1)..( 10): Result.006 file - promoters50/4909449
atataaatac

SEQ ID NO: 194612 - DNA, 10 bp, Unknown
  misc_feature (1)..( 10): Result.006 file - promoters50/4909449
atacaaaacc

SEQ ID NO: 194613 - DNA, 10 bp, Unknown
  misc_feature (1)..( 10): Result.006 file - promoters50/4909449
atataaaacg

SEQ ID NO: 194614 - DNA, 11 bp, Unknown
  misc_feature (1)..( 11): Result.006 file - promoters50/4909449
caatcaaatcg

SEQ ID NO: 194615 - DNA, 11 bp, Unknown
  misc_feature (1)..( 11): Result.006 file - promoters50/4909449
ttgtcaaatga

SEQ ID NO: 194616 - DNA, 11 bp, Unknown
  misc_feature (1)..( 11): Result.006 file - promoters50/4909449
gaataaaaaca

SEQ ID NO: 194617 - DNA, 11 bp, Unknown
  misc_feature (1)..( 11): Result.006 file - promoters50/4909449
caaacaaaaca

SEQ ID NO: 194618 - DNA, 11 bp, Unknown
  misc_feature (1)..( 11): Result.006 file - promoters50/4909449
gagtcaaagaa

SEQ ID NO: 194619 - DNA, 11 bp, Unknown
  misc_feature (1)..( 11): Result.006 file - promoters50/4909449
aagaaaaaaaa

SEQ ID NO: 194620 - DNA, 16 bp, Unknown
  misc_feature (1)..( 16): Result.006 file - promoters50/4909449
tcgtatataaagacgc

SEQ ID NO: 194621 - DNA, 16 bp, Unknown
  misc_feature (1)..( 16): Result.006 file - promoters50/4909449
tataatataaaggtcc

SEQ ID NO: 194622 - DNA, 16 bp, Unknown
  misc_feature (1)..( 16): Result.006 file - promoters50/4909449
ttactattaaagccgc

SEQ ID NO: 194623 - DNA, 16 bp, Unknown
  misc_feature (1)..( 16): Result.006 file - promoters50/4909449
aagcatataaagtcat

SEQ ID NO: 194624 - DNA, 16 bp, Unknown
  misc_feature (1)..( 16): Result.006 file - promoters50/4909449
tccactataaattcaa

SEQ ID NO: 194625 - DNA, 16 bp, Unknown
  misc_feature (1)..( 16): Result.006 file - promoters50/4909449
cactatttaaagctcg

SEQ ID NO: 194626 - DNA, 16 bp, Unknown
  misc_feature (1)..( 16): Result.006 file - promoters50/4910180
cactatataaagacaa

SEQ ID NO: 194627 - DNA, 10 bp, Unknown
  misc_feature (1)..( 10): Result.006 file - promoters50/4910180
ttgaatttga

SEQ ID NO: 194628 - DNA, 10 bp, Unknown
  misc_feature (1)..( 10): Result.006 file - promoters50/4910180
ttgcatttga

SEQ ID NO: 194629 - DNA, 10 bp, Unknown
  misc_feature (1)..( 10): Result.006 file - promoters50/4910180
ttgaatatac

SEQ ID NO: 194630 - DNA, 11 bp, Unknown
  misc_feature (1)..( 11): Result.006 file - promoters50/4910180
aaagttactat

SEQ ID NO: 194631 - DNA, 11 bp, Unknown
  misc_feature (1)..( 11): Result.006 file - promoters50/4910180
aaagtgactca

SEQ ID NO: 194632 - DNA, 11 bp, Unknown
  misc_feature (1)..( 11): Result.006 file - promoters50/4910287
taatttattat

SEQ ID NO: 194633 - DNA, 11 bp, Unknown
  misc_feature (1)..( 11): Result.006 file - promoters50/4910287
ttatttttttt

SEQ ID NO: 194634 - DNA, 11 bp, Unknown
  misc_feature (1)..( 11): Result.006 file - promoters50/4910287
ttatttactta

SEQ ID NO: 194635 - DNA, 11 bp, Unknown
  misc_feature (1)..( 11): Result.006 file - promoters50/4910298
ttaattaatta

SEQ ID NO: 194636 - DNA, 10 bp, Unknown
  misc_feature (1)..( 10): Result.006 file - promoters50/4910298
atttttctaa

SEQ ID NO: 194637 - DNA, 10 bp, Unknown
  misc_feature (1)..( 10): Result.006 file - promoters50/4910298
ctctttctaa

SEQ ID NO: 194638 - DNA, 10 bp, Unknown
  misc_feature (1)..( 10): Result.006 file - promoters50/4910298
atttttttaa

SEQ ID NO: 194639 - DNA, 9 bp, Unknown
  misc_feature (1)..( 9): Result.006 file - promoters50/4910298
ttttttgga

SEQ ID NO: 194640 - DNA, 9 bp, Unknown
  misc_feature (1)..( 9): Result.006 file - promoters50/4910298
ttttttaaa

SEQ ID NO: 194641 - DNA, 9 bp, Unknown
  misc_feature (1)..( 9): Result.006 file - promoters50/4910298
tttattaaa

SEQ ID NO: 194642 - DNA, 7 bp, Unknown
  misc_feature (1)..( 7): Result.006 file - promoters50/4910298
acaaaaa

SEQ ID NO: 194643 - DNA, 7 bp, Unknown
  misc_feature (1)..( 7): Result.006 file - promoters50/4910298
acaaaag

SEQ ID NO: 194644 - DNA, 7 bp, Unknown
  misc_feature (1)..( 7): Result.006 file - promoters50/4910298
gcaaaag

SEQ ID NO: 194645 - DNA, 8 bp, Unknown
  misc_feature (1)..( 8): Result.006 file - promoters50/4910298
aaaaagtt

SEQ ID NO: 194646 - DNA, 8 bp, Unknown
  misc_feature (1)..( 8): Result.006 file - promoters50/4910298
caaaagtt

SEQ ID NO: 194647 - DNA, 8 bp, Unknown
  misc_feature (1)..( 8): Result.006 file - promoters50/4910362
caaaagaa

SEQ ID NO: 194648 - DNA, 8 bp, Unknown
  misc_feature (1)..( 8): Result.006 file - promoters50/4910362
atttgtct

SEQ ID NO: 194649 - DNA, 8 bp, Unknown
  misc_feature (1)..( 8): Result.006 file - promoters50/4910362
atttatct

SEQ ID NO: 194650 - DNA, 8 bp, Unknown
  misc_feature (1)..( 8): Result.006 file - promoters50/4910362
ttttgtca

SEQ ID NO: 194651 - DNA, 7 bp, Unknown
  misc_feature (1)..( 7): Result.006 file - promoters50/4910362
ctctttg

SEQ ID NO: 194652 - DNA, 7 bp, Unknown
  misc_feature (1)..( 7): Result.006 file - promoters50/4910362
ttctttg

SEQ ID NO: 194653 - DNA, 7 bp, Unknown
  misc_feature (1)..( 7): Result.006 file - promoters50/4910362
ttcattg

SEQ ID NO: 194654 - DNA, 7 bp, Unknown
  misc_feature (1)..( 7): Result.006 file - promoters50/4910362
ttctttc

SEQ ID NO: 194655 - DNA, 9 bp, Unknown
  misc_feature (1)..( 9): Result.006 file - promoters50/4910362
aatatacta

SEQ ID NO: 194656 - DNA, 9 bp, Unknown
  misc_feature (1)..( 9): Result.006 file - promoters50/4910362
aatttactt

SEQ ID NO: 194657 - DNA, 9 bp, Unknown
  misc_feature (1)..( 9): Result.006 file - promoters50/4910362
tctttgctt

SEQ ID NO: 194658 - DNA, 7 bp, Unknown
  misc_feature (1)..( 7): Result.006 file - promoters50/4910362
ttttgta

SEQ ID NO: 194659 - DNA, 7 bp, Unknown
  misc_feature (1)..( 7): Result.006 file - promoters50/4910362
atttgta

SEQ ID NO: 194660 - DNA, 7 bp, Unknown
  misc_feature (1)..( 7): Result.006 file - promoters50/4910362
ttttgta

SEQ ID NO: 194661 - DNA, 10 bp, Unknown
  misc_feature (1)..( 10): Result.006 file - promoters50/4910362
gaaaaaagaa

SEQ ID NO: 194662 - DNA, 10 bp, Unknown
  misc_feature (1)..( 10): Result.006 file - promoters50/4910362
gaaaaaatct

SEQ ID NO: 194663 - DNA, 10 bp, Unknown
  misc_feature (1)..( 10): Result.006 file - promoters50/4910362
caaaatagaa

SEQ ID NO: 194664 - DNA, 7 bp, Unknown
  misc_feature (1)..( 7): Result.006 file - promoters50/4910362
gtttttt

SEQ ID NO: 194665 - DNA, 7 bp, Unknown
  misc_feature (1)..( 7): Result.006 file - promoters50/4910362
gttcttt

SEQ ID NO: 194666 - DNA, 7 bp, Unknown
  misc_feature (1)..( 7): Result.006 file - promoters50/4910362
tttcttt

SEQ ID NO: 194667 - DNA, 12 bp, Unknown
  misc_feature (1)..( 12): Result.006 file - promoters50/4910362
ttgaccttattt

SEQ ID NO: 194668 - DNA, 12 bp, Unknown
  misc_feature (1)..( 12): Result.006 file - promoters50/4910362
ttgcccttataa

SEQ ID NO: 194669 - DNA, 12 bp, Unknown
  misc_feature (1)..( 12): Result.006 file - promoters50/4910362
caaaccctattt

SEQ ID NO: 194670 - DNA, 10 bp, Unknown
  misc_feature (1)..( 10): Result.006 file - promoters50/4910362
ttttctataa

SEQ ID NO: 194671 - DNA, 10 bp, Unknown
  misc_feature (1)..( 10): Result.006 file - promoters50/4910362
tttcctaagt

SEQ ID NO: 194672 - DNA, 10 bp, Unknown
  misc_feature (1)..( 10): Result.006 file - promoters50/4910366
cctccaaagt

SEQ ID NO: 194673 - DNA, 18 bp, Unknown
  misc_feature (1)..( 18): Result.006 file - promoters50/4910366
ttttttaacaaatttcta

SEQ ID NO: 194674 - DNA, 18 bp, Unknown
  misc_feature (1)..( 18): Result.006 file - promoters50/4910366
ggttttaatcgaatggta

SEQ ID NO: 194675 - DNA, 18 bp, Unknown
  misc_feature (1)..( 18): Result.006 file - promoters50/4910366
gattttaaaaaaaaaaag

SEQ ID NO: 194676 - DNA, 18 bp, Unknown
  misc_feature (1)..( 18): Result.006 file - promoters50/4910366
atatttaatcagaaatta

SEQ ID NO: 194677 - DNA, 18 bp, Unknown
  misc_feature (1)..( 18): Result.006 file - promoters50/4910366
tgctataaaaaaacaaag

SEQ ID NO: 194678 - DNA, 18 bp, Unknown
  misc_feature (1)..( 18): Result.006 file - promoters50/4910366
gatgttatgattcactaa

SEQ ID NO: 194679 - DNA, 11 bp, Unknown
  misc_feature (1)..( 11): Result.006 file - promoters50/4910366
gaaagaagaag

SEQ ID NO: 194680 - DNA, 11 bp, Unknown
  misc_feature (1)..( 11): Result.006 file - promoters50/4910366
caaacaagaaa

SEQ ID NO: 194681 - DNA, 11 bp, Unknown
  misc_feature (1)..( 11): Result.006 file - promoters50/4910366
gaaagaaagag

SEQ ID NO: 194682 - DNA, 11 bp, Unknown
  misc_feature (1)..( 11): Result.006 file - promoters50/4910366
taaagaaacgc

SEQ ID NO: 194683 - DNA, 11 bp, Unknown
  misc_feature (1)..( 11): Result.006 file - promoters50/4910366
taaaaaaatgg

SEQ ID NO: 194684 - DNA, 11 bp, Unknown
  misc_feature (1)..( 11): Result.006 file - promoters50/4910417
aaaagaaatgg

SEQ ID NO: 194685 - DNA, 8 bp, Unknown
  misc_feature (1)..( 8): Result.006 file - promoters50/4910417
ctacaaga

SEQ ID NO: 194686 - DNA, 8 bp, Unknown
  misc_feature (1)..( 8): Result.006 file - promoters50/4910417
ctacaaaa

SEQ ID NO: 194687 - DNA, 8 bp, Unknown
  misc_feature (1)..( 8): Result.006 file - promoters50/4910426
ttacaaaa

SEQ ID NO: 194688 - DNA, 11 bp, Unknown
  misc_feature (1)..( 11): Result.006 file - promoters50/4910426
ctatatatata

SEQ ID NO: 194689 - DNA, 11 bp, Unknown
  misc_feature (1)..( 11): Result.006 file - promoters50/4910426
ctatatataca

SEQ ID NO: 194690 - DNA, 11 bp, Unknown
  misc_feature (1)..( 11): Result.006 file - promoters50/4910426
gtatttattaa

SEQ ID NO: 194691 - DNA, 11 bp, Unknown
  misc_feature (1)..( 11): Result.006 file - promoters50/4910426
ctataaatata

SEQ ID NO: 194692 - DNA, 11 bp, Unknown
  misc_feature (1)..( 11): Result.006 file - promoters50/4910426
ctatatataaa

SEQ ID NO: 194693 - DNA, 11 bp, Unknown
  misc_feature (1)..( 11): Result.006 file - promoters50/4910426
gtatataaata

SEQ ID NO: 194694 - DNA, 11 bp, Unknown
  misc_feature (1)..( 11): Result.006 file - promoters50/4910426
atataaatttg

SEQ ID NO: 194695 - DNA, 12 bp, Unknown
  misc_feature (1)..( 12): Result.006 file - promoters50/4910426
ttaattattgtt

SEQ ID NO: 194696 - DNA, 12 bp, Unknown
  misc_feature (1)..( 12): Result.006 file - promoters50/4910426
ttatttatacaa

SEQ ID NO: 194697 - DNA, 12 bp, Unknown
  misc_feature (1)..( 12): Result.006 file - promoters50/4910426
acaattatcgac

SEQ ID NO: 194698 - DNA, 12 bp, Unknown
  misc_feature (1)..( 12): Result.006 file - promoters50/4910426
ttaattttctca

SEQ ID NO: 194699 - DNA, 12 bp, Unknown
  misc_feature (1)..( 12): Result.006 file - promoters50/4910426
atatttaaatcc

SEQ ID NO: 194700 - DNA, 12 bp, Unknown
  misc_feature (1)..( 12): Result.006 file - promoters50/4910426
cacattatcgat

SEQ ID NO: 194701 - DNA, 12 bp, Unknown
  misc_feature (1)..( 12): Result.006 file - promoters50/4910426
ttaatttttgac

SEQ ID NO: 194702 - DNA, 12 bp, Unknown
  misc_feature (1)..( 12): Result.006 file - promoters50/4910426
ctgtgtatggat

SEQ ID NO: 194703 - DNA, 10 bp, Unknown
  misc_feature (1)..( 10): Result.006 file - promoters50/4910426
aaaatattta

SEQ ID NO: 194704 - DNA, 10 bp, Unknown
  misc_feature (1)..( 10): Result.006 file - promoters50/4910426
caaatattaa

SEQ ID NO: 194705 - DNA, 10 bp, Unknown
  misc_feature (1)..( 10): Result.006 file - promoters50/4910426
agaatattct

SEQ ID NO: 194706 - DNA, 10 bp, Unknown
  misc_feature (1)..( 10): Result.006 file - promoters50/4910426
aaaagatttt

SEQ ID NO: 194707 - DNA, 10 bp, Unknown
  misc_feature (1)..( 10): Result.006 file - promoters50/4910426
caattatcga

SEQ ID NO: 194708 - DNA, 10 bp, Unknown
  misc_feature (1)..( 10): Result.006 file - promoters50/4910874
acattatcga

SEQ ID NO: 194709 - DNA, 13 bp, Unknown
  misc_feature (1)..( 13): Result.006 file - promoters50/4910874
gttgagtcttccg

SEQ ID NO: 194710 - DNA, 13 bp, Unknown
  misc_feature (1)..( 13): Result.006 file - promoters50/4910874
attgagttttcat

SEQ ID NO: 194711 - DNA, 13 bp, Unknown
  misc_feature (1)..( 13): Result.006 file - promoters50/4910874
tgtgagttttatg

SEQ ID NO: 194712 - DNA, 13 bp, Unknown
  misc_feature (1)..( 13): Result.006 file - promoters50/4910874
acaatgttttcac

SEQ ID NO: 194713 - DNA, 13 bp, Unknown
  misc_feature (1)..( 13): Result.006 file - promoters50/4910874
attgagataacgc

SEQ ID NO: 194714 - DNA, 13 bp, Unknown
  misc_feature (1)..( 13): Result.006 file - promoters50/4910874
ttttcgtttaaca

SEQ ID NO: 194715 - DNA, 13 bp, Unknown
  misc_feature (1)..( 13): Result.006 file - promoters50/4910874
gtaaattttgcac

SEQ ID NO: 194716 - DNA, 13 bp, Unknown
  misc_feature (1)..( 13): Result.006 file - promoters50/4910874
catttatttaact

SEQ ID NO: 194717 - DNA, 14 bp, Unknown
  misc_feature (1)..( 14): Result.006 file - promoters50/4910874
ccaagaaagttata

SEQ ID NO: 194718 - DNA, 14 bp, Unknown
  misc_feature (1)..( 14): Result.006 file - promoters50/4910874
aggagacagtgaaa

SEQ ID NO: 194719 - DNA, 14 bp, Unknown
  misc_feature (1)..( 14): Result.006 file - promoters50/4910874
ataagaaagtaaac

SEQ ID NO: 194720 - DNA, 14 bp, Unknown
  misc_feature (1)..( 14): Result.006 file - promoters50/4910874
tcttcaaaattata

SEQ ID NO: 194721 - DNA, 14 bp, Unknown
  misc_feature (1)..( 14): Result.006 file - promoters50/4910874
tcaaaaaaaaaagt

SEQ ID NO: 194722 - DNA, 14 bp, Unknown
  misc_feature (1)..( 14): Result.006 file - promoters50/4910874
tcaaaacgacgtaa

SEQ ID NO: 194723 - DNA, 9 bp, Unknown
  misc_feature (1)..( 9): Result.006 file - promoters50/4910874
agttttatg

SEQ ID NO: 194724 - DNA, 9 bp, Unknown
  misc_feature (1)..( 9): Result.006 file - promoters50/4910874
gttttcatg

SEQ ID NO: 194725 - DNA, 9 bp, Unknown
  misc_feature (1)..( 9): Result.006 file - promoters50/4910874
acttttatt

SEQ ID NO: 194726 - DNA, 9 bp, Unknown
  misc_feature (1)..( 9): Result.006 file - promoters50/4910874
atttttgtt

SEQ ID NO: 194727 - DNA, 9 bp, Unknown
  misc_feature (1)..( 9): Result.006 file - promoters50/4910874
gttttcaca

SEQ ID NO: 194728 - DNA, 9 bp, Unknown
  misc_feature (1)..( 9): Result.006 file - promoters50/4910874
ttttgcact

SEQ ID NO: 194729 - DNA, 9 bp, Unknown
  misc_feature (1)..( 9): Result.006 file - promoters50/4910902
gcatttatt

SEQ ID NO: 194730 - DNA, 8 bp, Unknown
  misc_feature (1)..( 8): Result.006 file - promoters50/4910902
cttcatga

SEQ ID NO: 194731 - DNA, 8 bp, Unknown
  misc_feature (1)..( 8): Result.006 file - promoters50/4910902
gatcatga

SEQ ID NO: 194732 - DNA, 8 bp, Unknown
  misc_feature (1)..( 8): Result.006 file - promoters50/4910902
cttgatga

SEQ ID NO: 194733 - DNA, 9 bp, Unknown
  misc_feature (1)..( 9): Result.006 file - promoters50/4910902
ttaaattaa

SEQ ID NO: 194734 - DNA, 9 bp, Unknown
  misc_feature (1)..( 9): Result.006 file - promoters50/4910902
ttatattta

SEQ ID NO: 194735 - DNA, 9 bp, Unknown
  misc_feature (1)..( 9): Result.006 file - promoters50/4910902
ctatgttta

SEQ ID NO: 194736 - DNA, 7 bp, Unknown
  misc_feature (1)..( 7): Result.006 file - promoters50/4910902
atattta

SEQ ID NO: 194737 - DNA, 7 bp, Unknown
  misc_feature (1)..( 7): Result.006 file - promoters50/4910902
ttattta

SEQ ID NO: 194738 - DNA, 7 bp, Unknown
  misc_feature (1)..( 7): Result.006 file - promoters50/4910949
atatttg

SEQ ID NO: 194739 - DNA, 8 bp, Unknown
  misc_feature (1)..( 8): Result.006 file - promoters50/4910949
tttcttgt

SEQ ID NO: 194740 - DNA, 8 bp, Unknown
  misc_feature (1)..( 8): Result.006 file - promoters50/4910949
actcttgt

SEQ ID NO: 194741 - DNA, 8 bp, Unknown
  misc_feature (1)..( 8): Result.006 file - promoters50/4910949
ttttttgg

SEQ ID NO: 194742 - DNA, 7 bp, Unknown
  misc_feature (1)..( 7): Result.006 file - promoters50/4910949
tatgatt

SEQ ID NO: 194743 - DNA, 7 bp, Unknown
  misc_feature (1)..( 7): Result.006 file - promoters50/4910949
tatgatt

SEQ ID NO: 194744 - DNA, 7 bp, Unknown
  misc_feature (1)..( 7): Result.006 file - promoters50/4910949
tattatt

SEQ ID NO: 194745 - DNA, 8 bp, Unknown
  misc_feature (1)..( 8): Result.006 file - promoters50/4910949
cttgtgtt

SEQ ID NO: 194746 - DNA, 8 bp, Unknown
  misc_feature (1)..( 8): Result.006 file - promoters50/4910949
attgagtt

SEQ ID NO: 194747 - DNA, 8 bp, Unknown
  misc_feature (1)..( 8): Result.006 file - promoters50/4910949
cttgtgga

SEQ ID NO: 194748 - DNA, 15 bp, Unknown
  misc_feature (1)..( 15): Result.006 file - promoters50/4910949
ttgtggtgtgtattg

SEQ ID NO: 194749 - DNA, 15 bp, Unknown
  misc_feature (1)..( 15): Result.006 file - promoters50/4910949
ttttattgtttatca

SEQ ID NO: 194750 - DNA, 15 bp, Unknown
  misc_feature (1)..( 15): Result.006 file - promoters50/4910949
ataataaatttatca

SEQ ID NO: 194751 - DNA, 15 bp, Unknown
  misc_feature (1)..( 15): Result.006 file - promoters50/4910949
tttttttgttttttt

SEQ ID NO: 194752 - DNA, 11 bp, Unknown
  misc_feature (1)..( 11): Result.006 file - promoters50/4910949
ttgctttcttc

SEQ ID NO: 194753 - DNA, 11 bp, Unknown
  misc_feature (1)..( 11): Result.006 file - promoters50/4910949
aagctttctgt

SEQ ID NO: 194754 - DNA, 11 bp, Unknown
  misc_feature (1)..( 11): Result.006 file - promoters50/4910949
ttgtttttttt

SEQ ID NO: 194755 - DNA, 11 bp, Unknown
  misc_feature (1)..( 11): Result.006 file - promoters50/4910949
accttttggtt

SEQ ID NO: 194756 - DNA, 11 bp, Unknown
  misc_feature (1)..( 11): Result.006 file - promoters50/4910949
aacaccttttg

SEQ ID NO: 194757 - DNA, 11 bp, Unknown
  misc_feature (1)..( 11): Result.006 file - promoters50/4910949
aacaactttta

SEQ ID NO: 194758 - DNA, 11 bp, Unknown
  misc_feature (1)..( 11): Result.006 file - promoters50/4910949
taaggcttttg

SEQ ID NO: 194759 - DNA, 9 bp, Unknown
  misc_feature (1)..( 9): Result.006 file - promoters50/4910949
ctacgtttt

SEQ ID NO: 194760 - DNA, 9 bp, Unknown
  misc_feature (1)..( 9): Result.006 file - promoters50/4910949
ctacctttt

SEQ ID NO: 194761 - DNA, 9 bp, Unknown
  misc_feature (1)..( 9): Result.006 file - promoters50/4910949
tcacctttt

SEQ ID NO: 194762 - DNA, 10 bp, Unknown
  misc_feature (1)..( 10): Result.006 file - promoters50/4910949
cgttttgtgg

SEQ ID NO: 194763 - DNA, 10 bp, Unknown
  misc_feature (1)..( 10): Result.006 file - promoters50/4910949
ttttttgttt

SEQ ID NO: 194764 - DNA, 11 bp, Unknown
  misc_feature (1)..( 11): Result.006 file - promoters50/4910949
ttttattgttt

SEQ ID NO: 194765 - DNA, 11 bp, Unknown
  misc_feature (1)..( 11): Result.006 file - promoters50/4910949
ccttttggttc

SEQ ID NO: 194766 - DNA, 11 bp, Unknown
  misc_feature (1)..( 11): Result.006 file - promoters50/4910949
atcgtggccgt

SEQ ID NO: 194767 - DNA, 11 bp, Unknown
  misc_feature (1)..( 11): Result.006 file - promoters50/4910949
tacttggtcgt

SEQ ID NO: 194768 - DNA, 11 bp, Unknown
  misc_feature (1)..( 11): Result.006 file - promoters50/4911303
tactttgtcaa

SEQ ID NO: 194769 - DNA, 8 bp, Unknown
  misc_feature (1)..( 8): Result.006 file - promoters50/4911303
tttaagaa

SEQ ID NO: 194770 - DNA, 8 bp, Unknown
  misc_feature (1)..( 8): Result.006 file - promoters50/4911303
tttaagtt

SEQ ID NO: 194771 - DNA, 8 bp, Unknown
  misc_feature (1)..( 8): Result.006 file - promoters50/4911303
gttaggaa

SEQ ID NO: 194772 - DNA, 7 bp, Unknown
  misc_feature (1)..( 7): Result.006 file - promoters50/4911303
taattta

SEQ ID NO: 194773 - DNA, 7 bp, Unknown
  misc_feature (1)..( 7): Result.006 file - promoters50/4911303
caattta

SEQ ID NO: 194774 - DNA, 7 bp, Unknown
  misc_feature (1)..( 7): Result.006 file - promoters50/4911303
taagtta

SEQ ID NO: 194775 - DNA, 11 bp, Unknown
  misc_feature (1)..( 11): Result.006 file - promoters50/4911303
agaggaaatga

SEQ ID NO: 194776 - DNA, 11 bp, Unknown
  misc_feature (1)..( 11): Result.006 file - promoters50/4911303
agagtaaataa

SEQ ID NO: 194777 - DNA, 11 bp, Unknown
  misc_feature (1)..( 11): Result.006 file - promoters50/4911303
tcttgaagtga

SEQ ID NO: 194778 - DNA, 9 bp, Unknown
  misc_feature (1)..( 9): Result.006 file - promoters50/4911303
tctatttaa

SEQ ID NO: 194779 - DNA, 9 bp, Unknown
  misc_feature (1)..( 9): Result.006 file - promoters50/4911303
tcttttttt

SEQ ID NO: 194780 - DNA, 9 bp, Unknown
  misc_feature (1)..( 9): Result.006 file - promoters50/4911303
tctaattaa

SEQ ID NO: 194781 - DNA, 8 bp, Unknown
  misc_feature (1)..( 8): Result.006 file - promoters50/4911303
tttttatt

SEQ ID NO: 194782 - DNA, 8 bp, Unknown
  misc_feature (1)..( 8): Result.006 file - promoters50/4911303
gtttaatt

SEQ ID NO: 194783 - DNA, 9 bp, Unknown
  misc_feature (1)..( 9): Result.006 file - promoters50/4911303
ttttctatt

SEQ ID NO: 194784 - DNA, 10 bp, Unknown
  misc_feature (1)..( 10): Result.006 file - promoters50/4911303
taacagaaaa

SEQ ID NO: 194785 - DNA, 10 bp, Unknown
  misc_feature (1)..( 10): Result.006 file - promoters50/4911303
taacagagat

SEQ ID NO: 194786 - DNA, 10 bp, Unknown
  misc_feature (1)..( 10): Result.006 file - promoters50/4911309
atacagagat

SEQ ID NO: 194787 - DNA, 10 bp, Unknown
  misc_feature (1)..( 10): Result.006 file - promoters50/4911309
ttcttttgag

SEQ ID NO: 194788 - DNA, 10 bp, Unknown
  misc_feature (1)..( 10): Result.006 file - promoters50/4911309
ttcatttgaa

SEQ ID NO: 194789 - DNA, 10 bp, Unknown
  misc_feature (1)..( 10): Result.006 file - promoters50/4911309
gacttttagt

SEQ ID NO: 194790 - DNA, 8 bp, Unknown
  misc_feature (1)..( 8): Result.006 file - promoters50/4911309
tctcctta

SEQ ID NO: 194791 - DNA, 8 bp, Unknown
  misc_feature (1)..( 8): Result.006 file - promoters50/4911309
tcttctta

SEQ ID NO: 194792 - DNA, 8 bp, Unknown
  misc_feature (1)..( 8): Result.006 file - promoters50/4911309
gcttatta

SEQ ID NO: 194793 - DNA, 12 bp, Unknown
  misc_feature (1)..( 12): Result.006 file - promoters50/4911309
caaaatttcttg

SEQ ID NO: 194794 - DNA, 12 bp, Unknown
  misc_feature (1)..( 12): Result.006 file - promoters50/4911309
caacattgcttg

SEQ ID NO: 194795 - DNA, 12 bp, Unknown
  misc_feature (1)..( 12): Result.006 file - promoters50/4911309
gaaagttttctc

SEQ ID NO: 194796 - DNA, 6 bp, Unknown
  misc_feature (1)..( 6): Result.006 file - promoters50/4911309
ttttct

SEQ ID NO: 194797 - DNA, 6 bp, Unknown
  misc_feature (1)..( 6): Result.006 file - promoters50/4911309
ttttct

SEQ ID NO: 194798 - DNA, 6 bp, Unknown
  misc_feature (1)..( 6): Result.006 file - promoters50/4911309
ttttct

SEQ ID NO: 194799 - DNA, 8 bp, Unknown
  misc_feature (1)..( 8): Result.006 file - promoters50/4911309
atgcttat

SEQ ID NO: 194800 - DNA, 8 bp, Unknown
  misc_feature (1)..( 8): Result.006 file - promoters50/4911309
atgtttat

SEQ ID NO: 194801 - DNA, 8 bp, Unknown
  misc_feature (1)..( 8): Result.006 file - promoters50/4911309
cttcttac

SEQ ID NO: 194802 - DNA, 8 bp, Unknown
  misc_feature (1)..( 8): Result.006 file - promoters50/4911309
cttattat

SEQ ID NO: 194803 - DNA, 8 bp, Unknown
  misc_feature (1)..( 8): Result.006 file - promoters50/4911309
attattat

SEQ ID NO: 194804 - DNA, 8 bp, Unknown
  misc_feature (1)..( 8): Result.006 file - promoters50/4911312
cttcttac

SEQ ID NO: 194805 - DNA, 13 bp, Unknown
  misc_feature (1)..( 13): Result.006 file - promoters50/4911312
tgattacattttg

SEQ ID NO: 194806 - DNA, 13 bp, Unknown
  misc_feature (1)..( 13): Result.006 file - promoters50/4911312
ggatcacaataca

SEQ ID NO: 194807 - DNA, 13 bp, Unknown
  misc_feature (1)..( 13): Result.006 file - promoters50/4911312
attttacagtttg

SEQ ID NO: 194808 - DNA, 13 bp, Unknown
  misc_feature (1)..( 13): Result.006 file - promoters50/4911312
acatcacattcat

SEQ ID NO: 194809 - DNA, 13 bp, Unknown
  misc_feature (1)..( 13): Result.006 file - promoters50/4911312
ggatcacttgcga

SEQ ID NO: 194810 - DNA, 13 bp, Unknown
  misc_feature (1)..( 13): Result.006 file - promoters50/4911314
tttttacacaaat

SEQ ID NO: 194811 - DNA, 7 bp, Unknown
  misc_feature (1)..( 7): Result.006 file - promoters50/4911314
cagttgt

SEQ ID NO: 194812 - DNA, 7 bp, Unknown
  misc_feature (1)..( 7): Result.006 file - promoters50/4911314
gagttgt

SEQ ID NO: 194813 - DNA, 7 bp, Unknown
  misc_feature (1)..( 7): Result.006 file - promoters50/4911314
gagttgt

SEQ ID NO: 194814 - DNA, 7 bp, Unknown
  misc_feature (1)..( 7): Result.006 file - promoters50/4911314
cagttgc

SEQ ID NO: 194815 - DNA, 9 bp, Unknown
  misc_feature (1)..( 9): Result.006 file - promoters50/4911314
ctgttgaca

SEQ ID NO: 194816 - DNA, 9 bp, Unknown
  misc_feature (1)..( 9): Result.006 file - promoters50/4911314
ctgatgaaa

SEQ ID NO: 194817 - DNA, 9 bp, Unknown
  misc_feature (1)..( 9): Result.006 file - promoters50/4911314
gggatcaaa

SEQ ID NO: 194818 - DNA, 9 bp, Unknown
  misc_feature (1)..( 9): Result.006 file - promoters50/4911314
aaaatttaa

SEQ ID NO: 194819 - DNA, 9 bp, Unknown
  misc_feature (1)..( 9): Result.006 file - promoters50/4911314
ttgatttaa

SEQ ID NO: 194820 - DNA, 9 bp, Unknown
  misc_feature (1)..( 9): Result.006 file - promoters50/4911314
ttgttttat

SEQ ID NO: 194821 - DNA, 7 bp, Unknown
  misc_feature (1)..( 7): Result.006 file - promoters50/4911314
ttggaat

SEQ ID NO: 194822 - DNA, 7 bp, Unknown
  misc_feature (1)..( 7): Result.006 file - promoters50/4911314
ttggaaa

SEQ ID NO: 194823 - DNA, 7 bp, Unknown
  misc_feature (1)..( 7): Result.006 file - promoters50/4911314
ttgaaaa

SEQ ID NO: 194824 - DNA, 16 bp, Unknown
  misc_feature (1)..( 16): Result.006 file - promoters50/4911314
ttgtgtaagacacatt

SEQ ID NO: 194825 - DNA, 16 bp, Unknown
  misc_feature (1)..( 16): Result.006 file - promoters50/4911314
aaaaaaaaaacaaatt

SEQ ID NO: 194826 - DNA, 16 bp, Unknown
  misc_feature (1)..( 16): Result.006 file - promoters50/4911344
aaaaaagaaagaaatc

SEQ ID NO: 194827 - DNA, 9 bp, Unknown
  misc_feature (1)..( 9): Result.006 file - promoters50/4911344
ttgttaatg

SEQ ID NO: 194828 - DNA, 9 bp, Unknown
  misc_feature (1)..( 9): Result.006 file - promoters50/4911344
cagtttatg

SEQ ID NO: 194829 - DNA, 9 bp, Unknown
  misc_feature (1)..( 9): Result.006 file - promoters50/4911380
cagtatatc

SEQ ID NO: 194830 - DNA, 11 bp, Unknown
  misc_feature (1)..( 11): Result.006 file - promoters50/4911380
ccttttttctg

SEQ ID NO: 194831 - DNA, 11 bp, Unknown
  misc_feature (1)..( 11): Result.006 file - promoters50/4911380
tctcatttctg

SEQ ID NO: 194832 - DNA, 11 bp, Unknown
  misc_feature (1)..( 11): Result.006 file - promoters50/4911380
gaaaatttcta

SEQ ID NO: 194833 - DNA, 11 bp, Unknown
  misc_feature (1)..( 11): Result.006 file - promoters50/4911380
aaaaaattcca

SEQ ID NO: 194834 - DNA, 11 bp, Unknown
  misc_feature (1)..( 11): Result.006 file - promoters50/4911380
aaaaaatagcc

SEQ ID NO: 194835 - DNA, 11 bp, Unknown
  misc_feature (1)..( 11): Result.006 file - promoters50/4911380
tgaaactagat

SEQ ID NO: 194836 - DNA, 12 bp, Unknown
  misc_feature (1)..( 12): Result.006 file - promoters50/4911380
ctatctatcaac

SEQ ID NO: 194837 - DNA, 12 bp, Unknown
  misc_feature (1)..( 12): Result.006 file - promoters50/4911380
taatctaacaac

SEQ ID NO: 194838 - DNA, 12 bp, Unknown
  misc_feature (1)..( 12): Result.006 file - promoters50/4911380
atatatatgttt

SEQ ID NO: 194839 - DNA, 12 bp, Unknown
  misc_feature (1)..( 12): Result.006 file - promoters50/4911380
ttatatagcaaa

SEQ ID NO: 194840 - DNA, 12 bp, Unknown
  misc_feature (1)..( 12): Result.006 file - promoters50/4911380
agaaataacaaa

SEQ ID NO: 194841 - DNA, 12 bp, Unknown
  misc_feature (1)..( 12): Result.006 file - promoters50/4911457
atatatatagtt

SEQ ID NO: 194842 - DNA, 13 bp, Unknown
  misc_feature (1)..( 13): Result.006 file - promoters50/4911457
ctttagtctttta

SEQ ID NO: 194843 - DNA, 13 bp, Unknown
  misc_feature (1)..( 13): Result.006 file - promoters50/4911457
cttgagtcgttta

SEQ ID NO: 194844 - DNA, 13 bp, Unknown
  misc_feature (1)..( 13): Result.006 file - promoters50/4911457
aaagagtcgtttg

SEQ ID NO: 194845 - DNA, 13 bp, Unknown
  misc_feature (1)..( 13): Result.006 file - promoters50/4911457
tttgagtccctgg

SEQ ID NO: 194846 - DNA, 10 bp, Unknown
  misc_feature (1)..( 10): Result.006 file - promoters50/4911457
ctttgcagac

SEQ ID NO: 194847 - DNA, 10 bp, Unknown
  misc_feature (1)..( 10): Result.006 file - promoters50/4911457
tgttggagaa

SEQ ID NO: 194848 - DNA, 10 bp, Unknown
  misc_feature (1)..( 10): Result.006 file - promoters50/4911457
tgttggattt

SEQ ID NO: 194849 - DNA, 10 bp, Unknown
  misc_feature (1)..( 10): Result.006 file - promoters50/4911457
ggttgaattt

SEQ ID NO: 194850 - DNA, 11 bp, Unknown
  misc_feature (1)..( 11): Result.006 file - promoters50/4911457
taatattaaaa

SEQ ID NO: 194851 - DNA, 11 bp, Unknown
  misc_feature (1)..( 11): Result.006 file - promoters50/4911457
caattttagat

SEQ ID NO: 194852 - DNA, 11 bp, Unknown
  misc_feature (1)..( 11): Result.006 file - promoters50/4911457
gaatttgagat

SEQ ID NO: 194853 - DNA, 11 bp, Unknown
  misc_feature (1)..( 11): Result.006 file - promoters50/4911485
gaatttggata

SEQ ID NO: 194854 - DNA, 8 bp, Unknown
  misc_feature (1)..( 8): Result.006 file - promoters50/4911485
ctttttac

SEQ ID NO: 194855 - DNA, 8 bp, Unknown
  misc_feature (1)..( 8): Result.006 file - promoters50/4911485
gtttttat

SEQ ID NO: 194856 - DNA, 8 bp, Unknown
  misc_feature (1)..( 8): Result.006 file - promoters50/4911485
atttttac

SEQ ID NO: 194857 - DNA, 8 bp, Unknown
  misc_feature (1)..( 8): Result.006 file - promoters50/4911485
gttgttac

SEQ ID NO: 194858 - DNA, 8 bp, Unknown
  misc_feature (1)..( 8): Result.006 file - promoters50/4911485
attggtgt

SEQ ID NO: 194859 - DNA, 8 bp, Unknown
  misc_feature (1)..( 8): Result.006 file - promoters50/4911485
attattat

SEQ ID NO: 194860 - DNA, 12 bp, Unknown
  misc_feature (1)..( 12): Result.006 file - promoters50/4911485
agagttggatag

SEQ ID NO: 194861 - DNA, 12 bp, Unknown
  misc_feature (1)..( 12): Result.006 file - promoters50/4911485
ttgagtggatat

SEQ ID NO: 194862 - DNA, 12 bp, Unknown
  misc_feature (1)..( 12): Result.006 file - promoters50/4911485
ttacttgcataa

SEQ ID NO: 194863 - DNA, 12 bp, Unknown
  misc_feature (1)..( 12): Result.006 file - promoters50/4911485
gatgtttgatta

SEQ ID NO: 194864 - DNA, 12 bp, Unknown
  misc_feature (1)..( 12): Result.006 file - promoters50/4911485
ttctttggatta

SEQ ID NO: 194865 - DNA, 12 bp, Unknown
  misc_feature (1)..( 12): Result.006 file - promoters50/4911485
atgcttgcttaa

SEQ ID NO: 194866 - DNA, 12 bp, Unknown
  misc_feature (1)..( 12): Result.006 file - promoters50/4911485
gggtttcgataa

SEQ ID NO: 194867 - DNA, 10 bp, Unknown
  misc_feature (1)..( 10): Result.006 file - promoters50/4911485
ttatcaatgg

SEQ ID NO: 194868 - DNA, 10 bp, Unknown
  misc_feature (1)..( 10): Result.006 file - promoters50/4911485
gtataaatat

SEQ ID NO: 194869 - DNA, 10 bp, Unknown
  misc_feature (1)..( 10): Result.006 file - promoters50/4911485
ttaacaaaac

SEQ ID NO: 194870 - DNA, 10 bp, Unknown
  misc_feature (1)..( 10): Result.006 file - promoters50/4911485
tcatccatga

SEQ ID NO: 194871 - DNA, 10 bp, Unknown
  misc_feature (1)..( 10): Result.006 file - promoters50/4911485
caaacgaaac

SEQ ID NO: 194872 - DNA, 10 bp, Unknown
  misc_feature (1)..( 10): Result.006 file - promoters50/4911485
acataaattt

SEQ ID NO: 194873 - DNA, 14 bp, Unknown
  misc_feature (1)..( 14): Result.006 file - promoters50/4911485
tttgtaaattttgc

SEQ ID NO: 194874 - DNA, 14 bp, Unknown
  misc_feature (1)..( 14): Result.006 file - promoters50/4911485
tgagtatattttat

SEQ ID NO: 194875 - DNA, 14 bp, Unknown
  misc_feature (1)..( 14): Result.006 file - promoters50/4911485
gacataaatttttt

SEQ ID NO: 194876 - DNA, 14 bp, Unknown
  misc_feature (1)..( 14): Result.006 file - promoters50/4911485
gatgtaaaaattat

SEQ ID NO: 194877 - DNA, 14 bp, Unknown
  misc_feature (1)..( 14): Result.006 file - promoters50/4911485
ggcttcgattgttt

SEQ ID NO: 194878 - DNA, 14 bp, Unknown
  misc_feature (1)..( 14): Result.006 file - promoters50/4911485
tgattatatgtaca

SEQ ID NO: 194879 - DNA, 11 bp, Unknown
  misc_feature (1)..( 11): Result.006 file - promoters50/4911485
tgtataatttt

SEQ ID NO: 194880 - DNA, 11 bp, Unknown
  misc_feature (1)..( 11): Result.006 file - promoters50/4911485
ccaataattta

SEQ ID NO: 194881 - DNA, 11 bp, Unknown
  misc_feature (1)..( 11): Result.006 file - promoters50/4911485
ataaaaatttt

SEQ ID NO: 194882 - DNA, 11 bp, Unknown
  misc_feature (1)..( 11): Result.006 file - promoters50/4911485
taaatcatttt

SEQ ID NO: 194883 - DNA, 11 bp, Unknown
  misc_feature (1)..( 11): Result.006 file - promoters50/4911485
ttgaaaattta

SEQ ID NO: 194884 - DNA, 11 bp, Unknown
  misc_feature (1)..( 11): Result.006 file - promoters50/4911485
ataaaagtttg

SEQ ID NO: 194885 - DNA, 15 bp, Unknown
  misc_feature (1)..( 15): Result.006 file - promoters50/4911485
tatatgcttgcttaa

SEQ ID NO: 194886 - DNA, 15 bp, Unknown
  misc_feature (1)..( 15): Result.006 file - promoters50/4911485
ccactgcttgttggt

SEQ ID NO: 194887 - DNA, 15 bp, Unknown
  misc_feature (1)..( 15): Result.006 file - promoters50/4911485
ctgatgtttgattaa

SEQ ID NO: 194888 - DNA, 15 bp, Unknown
  misc_feature (1)..( 15): Result.006 file - promoters50/4911485
ttaatgtttgagtgg

SEQ ID NO: 194889 - DNA, 15 bp, Unknown
  misc_feature (1)..( 15): Result.006 file - promoters50/4911485
ttaatgtttgcttct

SEQ ID NO: 194890 - DNA, 15 bp, Unknown
  misc_feature (1)..( 15): Result.006 file - promoters50/4911485
ttgatgtgtgatttc

SEQ ID NO: 194891 - DNA, 15 bp, Unknown
  misc_feature (1)..( 15): Result.006 file - promoters50/4911485
agtttgtttgttact

SEQ ID NO: 194892 - DNA, 12 bp, Unknown
  misc_feature (1)..( 12): Result.006 file - promoters50/4911485
atgattgtgaac

SEQ ID NO: 194893 - DNA, 12 bp, Unknown
  misc_feature (1)..( 12): Result.006 file - promoters50/4911485
atgtttgagtgg

SEQ ID NO: 194894 - DNA, 12 bp, Unknown
  misc_feature (1)..( 12): Result.006 file - promoters50/4911485
gtttttgctgat

SEQ ID NO: 194895 - DNA, 12 bp, Unknown
  misc_feature (1)..( 12): Result.006 file - promoters50/4911485
atgtttgcttct

SEQ ID NO: 194896 - DNA, 12 bp, Unknown
  misc_feature (1)..( 12): Result.006 file - promoters50/4911485
ttgtttgttact

SEQ ID NO: 194897 - DNA, 12 bp, Unknown
  misc_feature (1)..( 12): Result.006 file - promoters50/4911485
atgtgtgatttc

SEQ ID NO: 194898 - DNA, 10 bp, Unknown
  misc_feature (1)..( 10): Result.006 file - promoters50/4911485
gagttcataa

SEQ ID NO: 194899 - DNA, 10 bp, Unknown
  misc_feature (1)..( 10): Result.006 file - promoters50/4911485
ttgtttatat

SEQ ID NO: 194900 - DNA, 10 bp, Unknown
  misc_feature (1)..( 10): Result.006 file - promoters50/4911485
atgtttaatc

SEQ ID NO: 194901 - DNA, 10 bp, Unknown
  misc_feature (1)..( 10): Result.006 file - promoters50/4911485
ttgattaaaa

SEQ ID NO: 194902 - DNA, 10 bp, Unknown
  misc_feature (1)..( 10): Result.006 file - promoters50/4911485
acttttatta

SEQ ID NO: 194903 - DNA, 10 bp, Unknown
  misc_feature (1)..( 10): Result.006 file - promoters50/4911492
cattttatgt

SEQ ID NO: 194904 - DNA, 15 bp, Unknown
  misc_feature (1)..( 15): Result.006 file - promoters50/4911492
tatttttatgtataa

SEQ ID NO: 194905 - DNA, 15 bp, Unknown
  misc_feature (1)..( 15): Result.006 file - promoters50/4911492
tttttgtatccatca

SEQ ID NO: 194906 - DNA, 15 bp, Unknown
  misc_feature (1)..( 15): Result.006 file - promoters50/4911492
tattcttaattgtat

SEQ ID NO: 194907 - DNA, 15 bp, Unknown
  misc_feature (1)..( 15): Result.006 file - promoters50/4911492
caattttatgcaagg

SEQ ID NO: 194908 - DNA, 15 bp, Unknown
  misc_feature (1)..( 15): Result.006 file - promoters50/4911492
caaatttattgttgt

SEQ ID NO: 194909 - DNA, 15 bp, Unknown
  misc_feature (1)..( 15): Result.006 file - promoters50/4911492
taggtttaaatttta

SEQ ID NO: 194910 - DNA, 16 bp, Unknown
  misc_feature (1)..( 16): Result.006 file - promoters50/4911492
tttttatgtataatgg

SEQ ID NO: 194911 - DNA, 16 bp, Unknown
  misc_feature (1)..( 16): Result.006 file - promoters50/4911492
tttatatctataataa

SEQ ID NO: 194912 - DNA, 16 bp, Unknown
  misc_feature (1)..( 16): Result.006 file - promoters50/4911492
cttctatgtatttaat

SEQ ID NO: 194913 - DNA, 16 bp, Unknown
  misc_feature (1)..( 16): Result.006 file - promoters50/4911492
aaaatatgcatagctt

SEQ ID NO: 194914 - DNA, 16 bp, Unknown
  misc_feature (1)..( 16): Result.006 file - promoters50/4911492
ataaatcgtaaaattt

SEQ ID NO: 194915 - DNA, 16 bp, Unknown
  misc_feature (1)..( 16): Result.006 file - promoters50/4911492
aaacactggaaacttt

SEQ ID NO: 194916 - DNA, 16 bp, Unknown
  misc_feature (1)..( 16): Result.006 file - promoters50/4911492
aaccaaaataaaataa

SEQ ID NO: 194917 - DNA, 16 bp, Unknown
  misc_feature (1)..( 16): Result.006 file - promoters50/4911492
agagcccatatttctc

SEQ ID NO: 194918 - DNA, 11 bp, Unknown
  misc_feature (1)..( 11): Result.006 file - promoters50/4911492
gttttatttca

SEQ ID NO: 194919 - DNA, 11 bp, Unknown
  misc_feature (1)..( 11): Result.006 file - promoters50/4911492
tttttatttca

SEQ ID NO: 194920 - DNA, 11 bp, Unknown
  misc_feature (1)..( 11): Result.006 file - promoters50/4911492
gttttatttat

SEQ ID NO: 194921 - DNA, 11 bp, Unknown
  misc_feature (1)..( 11): Result.006 file - promoters50/4911492
ctttaattttg

SEQ ID NO: 194922 - DNA, 11 bp, Unknown
  misc_feature (1)..( 11): Result.006 file - promoters50/4911492
tttttacggcg

SEQ ID NO: 194923 - DNA, 11 bp, Unknown
  misc_feature (1)..( 11): Result.006 file - promoters50/4911492
aaattattttc

SEQ ID NO: 194924 - DNA, 14 bp, Unknown
  misc_feature (1)..( 14): Result.006 file - promoters50/4911492
atgtataatggaaa

SEQ ID NO: 194925 - DNA, 14 bp, Unknown
  misc_feature (1)..( 14): Result.006 file - promoters50/4911492
ttgtataattttgt

SEQ ID NO: 194926 - DNA, 14 bp, Unknown
  misc_feature (1)..( 14): Result.006 file - promoters50/4911492
ttgtatccatcaac

SEQ ID NO: 194927 - DNA, 14 bp, Unknown
  misc_feature (1)..( 14): Result.006 file - promoters50/4911492
gtcgatagtttaac

SEQ ID NO: 194928 - DNA, 14 bp, Unknown
  misc_feature (1)..( 14): Result.006 file - promoters50/4911492
ttcaatattttaac

SEQ ID NO: 194929 - DNA, 14 bp, Unknown
  misc_feature (1)..( 14): Result.006 file - promoters50/4911492
gtttaaattttaat

SEQ ID NO: 194930 - DNA, 14 bp, Unknown
  misc_feature (1)..( 14): Result.006 file - promoters50/4911492
gattaaatatgtta

SEQ ID NO: 194931 - DNA, 10 bp, Unknown
  misc_feature (1)..( 10): Result.006 file - promoters50/4911492
tccaactgtg

SEQ ID NO: 194932 - DNA, 10 bp, Unknown
  misc_feature (1)..( 10): Result.006 file - promoters50/4911492
ttcaattgta

SEQ ID NO: 194933 - DNA, 10 bp, Unknown
  misc_feature (1)..( 10): Result.006 file - promoters50/4911492
ttcaatttaa

SEQ ID NO: 194934 - DNA, 10 bp, Unknown
  misc_feature (1)..( 10): Result.006 file - promoters50/4911492
cacaatttac

SEQ ID NO: 194935 - DNA, 10 bp, Unknown
  misc_feature (1)..( 10): Result.006 file - promoters50/4911492
aataatagta

SEQ ID NO: 194936 - DNA, 10 bp, Unknown
  misc_feature (1)..( 10): Result.006 file - promoters50/4911492
cttaattgta

SEQ ID NO: 194937 - DNA, 10 bp, Unknown
  misc_feature (1)..( 10): Result.006 file - promoters50/4911492
gttatttgag

SEQ ID NO: 194938 - DNA, 13 bp, Unknown
  misc_feature (1)..( 13): Result.006 file - promoters50/4911492
aaaaataaactaa

SEQ ID NO: 194939 - DNA, 13 bp, Unknown
  misc_feature (1)..( 13): Result.006 file - promoters50/4911492
caaaataaaataa

SEQ ID NO: 194940 - DNA, 13 bp, Unknown
  misc_feature (1)..( 13): Result.006 file - promoters50/4911492
ataaccaaaaata

SEQ ID NO: 194941 - DNA, 13 bp, Unknown
  misc_feature (1)..( 13): Result.006 file - promoters50/4911492
taaagtaatttaa

SEQ ID NO: 194942 - DNA, 13 bp, Unknown
  misc_feature (1)..( 13): Result.006 file - promoters50/4911492
acaaataaatcgt

SEQ ID NO: 194943 - DNA, 13 bp, Unknown
  misc_feature (1)..( 13): Result.006 file - promoters50/4911582
caagataaataaa

SEQ ID NO: 194944 - DNA, 7 bp, Unknown
  misc_feature (1)..( 7): Result.006 file - promoters50/4911582
tttcctt

SEQ ID NO: 194945 - DNA, 7 bp, Unknown
  misc_feature (1)..( 7): Result.006 file - promoters50/4911582
ttttctt

SEQ ID NO: 194946 - DNA, 7 bp, Unknown
  misc_feature (1)..( 7): Result.006 file - promoters50/4911598
ttttctt

SEQ ID NO: 194947 - DNA, 8 bp, Unknown
  misc_feature (1)..( 8): Result.006 file - promoters50/4911598
taaaatgt

SEQ ID NO: 194948 - DNA, 8 bp, Unknown
  misc_feature (1)..( 8): Result.006 file - promoters50/4911598
taaaatga

SEQ ID NO: 194949 - DNA, 8 bp, Unknown
  misc_feature (1)..( 8): Result.006 file - promoters50/4911598
aaaaatgt

SEQ ID NO: 194950 - DNA, 9 bp, Unknown
  misc_feature (1)..( 9): Result.006 file - promoters50/4911598
aagtataat

SEQ ID NO: 194951 - DNA, 9 bp, Unknown
  misc_feature (1)..( 9): Result.006 file - promoters50/4911598
aaggataat

SEQ ID NO: 194952 - DNA, 9 bp, Unknown
  misc_feature (1)..( 9): Result.006 file - promoters50/4911598
tagtatagt

SEQ ID NO: 194953 - DNA, 9 bp, Unknown
  misc_feature (1)..( 9): Result.006 file - promoters50/4911598
aagtatttt

SEQ ID NO: 194954 - DNA, 14 bp, Unknown
  misc_feature (1)..( 14): Result.006 file - promoters50/4911598
taaagacatattga

SEQ ID NO: 194955 - DNA, 14 bp, Unknown
  misc_feature (1)..( 14): Result.006 file - promoters50/4911598
tgtacccatactga

SEQ ID NO: 194956 - DNA, 14 bp, Unknown
  misc_feature (1)..( 14): Result.006 file - promoters50/4911598
taaacacatataaa

SEQ ID NO: 194957 - DNA, 13 bp, Unknown
  misc_feature (1)..( 13): Result.006 file - promoters50/4911598
tttcaatctaaaa

SEQ ID NO: 194958 - DNA, 13 bp, Unknown
  misc_feature (1)..( 13): Result.006 file - promoters50/4911598
tctatctctaaaa

SEQ ID NO: 194959 - DNA, 13 bp, Unknown
  misc_feature (1)..( 13): Result.006 file - promoters50/4911598
tatttatctttaa

SEQ ID NO: 194960 - DNA, 14 bp, Unknown
  misc_feature (1)..( 14): Result.006 file - promoters50/4911598
taatcaaaaatatt

SEQ ID NO: 194961 - DNA, 14 bp, Unknown
  misc_feature (1)..( 14): Result.006 file - promoters50/4911598
cttacaaaattatt

SEQ ID NO: 194962 - DNA, 14 bp, Unknown
  misc_feature (1)..( 14): Result.006 file - promoters50/4911598
gtgataaacatatt

SEQ ID NO: 194963 - DNA, 14 bp, Unknown
  misc_feature (1)..( 14): Result.006 file - promoters50/4911598
cttccaagatttcc

SEQ ID NO: 194964 - DNA, 9 bp, Unknown
  misc_feature (1)..( 9): Result.006 file - promoters50/4911598
aatgtgtct

SEQ ID NO: 194965 - DNA, 9 bp, Unknown
  misc_feature (1)..( 9): Result.006 file - promoters50/4911598
aatgtgata

SEQ ID NO: 194966 - DNA, 9 bp, Unknown
  misc_feature (1)..( 9): Result.006 file - promoters50/4911598
catgtgtct

SEQ ID NO: 194967 - DNA, 7 bp, Unknown
  misc_feature (1)..( 7): Result.006 file - promoters50/4911598
aatttta

SEQ ID NO: 194968 - DNA, 7 bp, Unknown
  misc_feature (1)..( 7): Result.006 file - promoters50/4911598
aattttt

SEQ ID NO: 194969 - DNA, 7 bp, Unknown
  misc_feature (1)..( 7): Result.006 file - promoters50/4911598
aatatta

SEQ ID NO: 194970 - DNA, 11 bp, Unknown
  misc_feature (1)..( 11): Result.006 file - promoters50/4911598
aataatttcta

SEQ ID NO: 194971 - DNA, 11 bp, Unknown
  misc_feature (1)..( 11): Result.006 file - promoters50/4911598
tatattttgaa

SEQ ID NO: 194972 - DNA, 11 bp, Unknown
  misc_feature (1)..( 11): Result.006 file - promoters50/4911598
tatattccttg

SEQ ID NO: 194973 - DNA, 11 bp, Unknown
  misc_feature (1)..( 11): Result.006 file - promoters50/4911598
taaattttgaa

SEQ ID NO: 194974 - DNA, 11 bp, Unknown
  misc_feature (1)..( 11): Result.006 file - promoters50/4911598
gaagaaatcta

SEQ ID NO: 194975 - DNA, 11 bp, Unknown
  misc_feature (1)..( 11): Result.006 file - promoters50/4911598
gaaaaaaacta

SEQ ID NO: 194976 - DNA, 11 bp, Unknown
  misc_feature (1)..( 11): Result.006 file - promoters50/4911598
aaagaaaaatg

SEQ ID NO: 194977 - DNA, 9 bp, Unknown
  misc_feature (1)..( 9): Result.006 file - promoters50/4911598
ggtttttct

SEQ ID NO: 194978 - DNA, 9 bp, Unknown
  misc_feature (1)..( 9): Result.006 file - promoters50/4911598
tatttttct

SEQ ID NO: 194979 - DNA, 9 bp, Unknown
  misc_feature (1)..( 9): Result.006 file - promoters50/4911946
tatttttta

SEQ ID NO: 194980 - DNA, 8 bp, Unknown
  misc_feature (1)..( 8): Result.006 file - promoters50/4911946
tgaagaaa

SEQ ID NO: 194981 - DNA, 8 bp, Unknown
  misc_feature (1)..( 8): Result.006 file - promoters50/4911946
cgaaaaaa

SEQ ID NO: 194982 - DNA, 8 bp, Unknown
  misc_feature (1)..( 8): Result.006 file - promoters50/4911946
tgaagagg

SEQ ID NO: 194983 - DNA, 8 bp, Unknown
  misc_feature (1)..( 8): Result.006 file - promoters50/4911946
tcaaaaaa

SEQ ID NO: 194984 - DNA, 7 bp, Unknown
  misc_feature (1)..( 7): Result.006 file - promoters50/4911946
aatggtt

SEQ ID NO: 194985 - DNA, 7 bp, Unknown
  misc_feature (1)..( 7): Result.006 file - promoters50/4911946
aattgtt

SEQ ID NO: 194986 - DNA, 7 bp, Unknown
  misc_feature (1)..( 7): Result.006 file - promoters50/4911946
cattgtt

SEQ ID NO: 194987 - DNA, 9 bp, Unknown
  misc_feature (1)..( 9): Result.006 file - promoters50/4911946
ttgaattca

SEQ ID NO: 194988 - DNA, 9 bp, Unknown
  misc_feature (1)..( 9): Result.006 file - promoters50/4911946
ttgatttca

SEQ ID NO: 194989 - DNA, 9 bp, Unknown
  misc_feature (1)..( 9): Result.006 file - promoters50/4911950
gtgaattca

SEQ ID NO: 194990 - DNA, 10 bp, Unknown
  misc_feature (1)..( 10): Result.006 file - promoters50/4911950
caaaatggta

SEQ ID NO: 194991 - DNA, 10 bp, Unknown
  misc_feature (1)..( 10): Result.006 file - promoters50/4911950
aaaaatcgta

SEQ ID NO: 194992 - DNA, 10 bp, Unknown
  misc_feature (1)..( 10): Result.006 file - promoters50/4911994
caaaatctgg

SEQ ID NO: 194993 - DNA, 9 bp, Unknown
  misc_feature (1)..( 9): Result.006 file - promoters50/4911994
tttttttgt

SEQ ID NO: 194994 - DNA, 9 bp, Unknown
  misc_feature (1)..( 9): Result.006 file - promoters50/4911994
ctttgttgt

SEQ ID NO: 194995 - DNA, 10 bp, Unknown
  misc_feature (1)..( 10): Result.006 file - promoters50/4912060
cttcttttag

SEQ ID NO: 194996 - DNA, 8 bp, Unknown
  misc_feature (1)..( 8): Result.006 file - promoters50/4912060
taattttt

SEQ ID NO: 194997 - DNA, 8 bp, Unknown
  misc_feature (1)..( 8): Result.006 file - promoters50/4912060
taagtttg

SEQ ID NO: 194998 - DNA, 8 bp, Unknown
  misc_feature (1)..( 8): Result.006 file - promoters50/4912060
ggattttt

SEQ ID NO: 194999 - DNA, 7 bp, Unknown
  misc_feature (1)..( 7): Result.006 file - promoters50/4912060
tttgttt

SEQ ID NO: 195000 - DNA, 7 bp, Unknown
  misc_feature (1)..( 7): Result.006 file - promoters50/4912060
ttttttt

SEQ ID NO: 195001 - DNA, 7 bp, Unknown
  misc_feature (1)..( 7): Result.006 file - promoters50/4912130
attgttt

SEQ ID NO: 195002 - DNA, 11 bp, Unknown
  misc_feature (1)..( 11): Result.006 file - promoters50/4912130
tatatttttaa

SEQ ID NO: 195003 - DNA, 11 bp, Unknown
  misc_feature (1)..( 11): Result.006 file - promoters50/4912130
ttaatttttac

SEQ ID NO: 195004 - DNA, 11 bp, Unknown
  misc_feature (1)..( 11): Result.006 file - promoters50/4912130
tatagttttaa

SEQ ID NO: 195005 - DNA, 10 bp, Unknown
  misc_feature (1)..( 10): Result.006 file - promoters50/4912130
agtatataaa

SEQ ID NO: 195006 - DNA, 10 bp, Unknown
  misc_feature (1)..( 10): Result.006 file - promoters50/4912130
agtgtataaa

SEQ ID NO: 195007 - DNA, 10 bp, Unknown
  misc_feature (1)..( 10): Result.006 file - promoters50/4912130
gccgtacaaa

SEQ ID NO: 195008 - DNA, 9 bp, Unknown
  misc_feature (1)..( 9): Result.006 file - promoters50/4912130
aaaccgaat

SEQ ID NO: 195009 - DNA, 9 bp, Unknown
  misc_feature (1)..( 9): Result.006 file - promoters50/4912130
ttaccaaat

SEQ ID NO: 195010 - DNA, 9 bp, Unknown
  misc_feature (1)..( 9): Result.006 file - promoters50/4912137
ttaacaaaa

SEQ ID NO: 195011 - DNA, 17 bp, Unknown
  misc_feature (1)..( 17): Result.006 file - promoters50/4912137
gtttagagtctataaac

SEQ ID NO: 195012 - DNA, 17 bp, Unknown
  misc_feature (1)..( 17): Result.006 file - promoters50/4912137
tgatcaaatttattaac

SEQ ID NO: 195013 - DNA, 17 bp, Unknown
  misc_feature (1)..( 17): Result.006 file - promoters50/4912137
tgatgaaaattagtaat

SEQ ID NO: 195014 - DNA, 9 bp, Unknown
  misc_feature (1)..( 9): Result.006 file - promoters50/4912137
attatatta

SEQ ID NO: 195015 - DNA, 9 bp, Unknown
  misc_feature (1)..( 9): Result.006 file - promoters50/4912137
attatataa

SEQ ID NO: 195016 - DNA, 9 bp, Unknown
  misc_feature (1)..( 9): Result.006 file - promoters50/4912137
tctatgtaa

SEQ ID NO: 195017 - DNA, 7 bp, Unknown
  misc_feature (1)..( 7): Result.006 file - promoters50/4912137
aaaatac

SEQ ID NO: 195018 - DNA, 7 bp, Unknown
  misc_feature (1)..( 7): Result.006 file - promoters50/4912137
aaaataa

SEQ ID NO: 195019 - DNA, 7 bp, Unknown
  misc_feature (1)..( 7): Result.006 file - promoters50/4912176
caaataa

SEQ ID NO: 195020 - DNA, 9 bp, Unknown
  misc_feature (1)..( 9): Result.006 file - promoters50/4912176
tatatttga

SEQ ID NO: 195021 - DNA, 9 bp, Unknown
  misc_feature (1)..( 9): Result.006 file - promoters50/4912176
tatgttttt

SEQ ID NO: 195022 - DNA, 9 bp, Unknown
  misc_feature (1)..( 9): Result.006 file - promoters50/4912240
tatatttga

SEQ ID NO: 195023 - DNA, 9 bp, Unknown
  misc_feature (1)..( 9): Result.006 file - promoters50/4912240
ggggaatta

SEQ ID NO: 195024 - DNA, 9 bp, Unknown
  misc_feature (1)..( 9): Result.006 file - promoters50/4912240
ttggattta

SEQ ID NO: 195025 - DNA, 9 bp, Unknown
  misc_feature (1)..( 9): Result.006 file - promoters50/4912240
ttggttttg

SEQ ID NO: 195026 - DNA, 9 bp, Unknown
  misc_feature (1)..( 9): Result.006 file - promoters50/4912240
gtggattta

SEQ ID NO: 195027 - DNA, 8 bp, Unknown
  misc_feature (1)..( 8): Result.006 file - promoters50/4912240
caaaacac

SEQ ID NO: 195028 - DNA, 8 bp, Unknown
  misc_feature (1)..( 8): Result.006 file - promoters50/4912240
caaaacct

SEQ ID NO: 195029 - DNA, 8 bp, Unknown
  misc_feature (1)..( 8): Result.006 file - promoters50/4912240
gaaagcac

SEQ ID NO: 195030 - DNA, 8 bp, Unknown
  misc_feature (1)..( 8): Result.006 file - promoters50/4912240
aaaaacat

SEQ ID NO: 195031 - DNA, 16 bp, Unknown
  misc_feature (1)..( 16): Result.006 file - promoters50/4912240
agcttgaatcaatatt

SEQ ID NO: 195032 - DNA, 16 bp, Unknown
  misc_feature (1)..( 16): Result.006 file - promoters50/4912240
taattgattcaaaatt

SEQ ID NO: 195033 - DNA, 16 bp, Unknown
  misc_feature (1)..( 16): Result.006 file - promoters50/4912240
taagtgatggtgagag

SEQ ID NO: 195034 - DNA, 16 bp, Unknown
  misc_feature (1)..( 16): Result.006 file - promoters50/4912541
taagtgacacgttcta

SEQ ID NO: 195035 - DNA, 7 bp, Unknown
  misc_feature (1)..( 7): Result.006 file - promoters50/4912541
gtttaaa

SEQ ID NO: 195036 - DNA, 7 bp, Unknown
  misc_feature (1)..( 7): Result.006 file - promoters50/4912541
gtttaag

SEQ ID NO: 195037 - DNA, 8 bp, Unknown
  misc_feature (1)..( 8): Result.006 file - promoters50/4912541
ctttcaat

SEQ ID NO: 195038 - DNA, 10 bp, Unknown
  misc_feature (1)..( 10): Result.006 file - promoters50/4912541
ttgttcaaat

SEQ ID NO: 195039 - DNA, 10 bp, Unknown
  misc_feature (1)..( 10): Result.006 file - promoters50/4912541
tgattctaat

SEQ ID NO: 195040 - DNA, 10 bp, Unknown
  misc_feature (1)..( 10): Result.006 file - promoters50/4912541
agattctaga

SEQ ID NO: 195041 - DNA, 10 bp, Unknown
  misc_feature (1)..( 10): Result.006 file - promoters50/4912541
agaatcttta

SEQ ID NO: 195042 - DNA, 10 bp, Unknown
  misc_feature (1)..( 10): Result.006 file - promoters50/4912541
tagtgagagc

SEQ ID NO: 195043 - DNA, 10 bp, Unknown
  misc_feature (1)..( 10): Result.006 file - promoters50/4912541
tagggagaga

SEQ ID NO: 195044 - DNA, 10 bp, Unknown
  misc_feature (1)..( 10): Result.006 file - promoters50/4913011
gatggagaga

SEQ ID NO: 195045 - DNA, 8 bp, Unknown
  misc_feature (1)..( 8): Result.006 file - promoters50/4913011
agaattaa

SEQ ID NO: 195046 - DNA, 8 bp, Unknown
  misc_feature (1)..( 8): Result.006 file - promoters50/4913011
ctaattaa

SEQ ID NO: 195047 - DNA, 8 bp, Unknown
  misc_feature (1)..( 8): Result.006 file - promoters50/4913068
ctaaataa

SEQ ID NO: 195048 - DNA, 12 bp, Unknown
  misc_feature (1)..( 12): Result.006 file - promoters50/4913068
acgtaaacttta

SEQ ID NO: 195049 - DNA, 12 bp, Unknown
  misc_feature (1)..( 12): Result.006 file - promoters50/4913068
ttttaaaattta

SEQ ID NO: 195050 - DNA, 12 bp, Unknown
  misc_feature (1)..( 12): Result.006 file - promoters50/4913068
tgtaaaaatttg

SEQ ID NO: 195051 - DNA, 12 bp, Unknown
  misc_feature (1)..( 12): Result.006 file - promoters50/4913068
aaataaactagt

SEQ ID NO: 195052 - DNA, 12 bp, Unknown
  misc_feature (1)..( 12): Result.006 file - promoters50/4913068
atgtaaaaatta

SEQ ID NO: 195053 - DNA, 12 bp, Unknown
  misc_feature (1)..( 12): Result.006 file - promoters50/4913068
tttcaaaaatac

SEQ ID NO: 195054 - DNA, 11 bp, Unknown
  misc_feature (1)..( 11): Result.006 file - promoters50/4913068
aattgttttcg

SEQ ID NO: 195055 - DNA, 11 bp, Unknown
  misc_feature (1)..( 11): Result.006 file - promoters50/4913068
gattattttgg

SEQ ID NO: 195056 - DNA, 11 bp, Unknown
  misc_feature (1)..( 11): Result.006 file - promoters50/4913068
tattatttcaa

SEQ ID NO: 195057 - DNA, 11 bp, Unknown
  misc_feature (1)..( 11): Result.006 file - promoters50/4913068
gatgattttgg

SEQ ID NO: 195058 - DNA, 11 bp, Unknown
  misc_feature (1)..( 11): Result.006 file - promoters50/4913068
tattatcaatg

SEQ ID NO: 195059 - DNA, 16 bp, Unknown
  misc_feature (1)..( 16): Result.006 file - promoters50/4913068
acaaattaaatttaaa

SEQ ID NO: 195060 - DNA, 16 bp, Unknown
  misc_feature (1)..( 16): Result.006 file - promoters50/4913068
aattatttaatctaga

SEQ ID NO: 195061 - DNA, 16 bp, Unknown
  misc_feature (1)..( 16): Result.006 file - promoters50/4913068
acaaagtaaagtgaag

SEQ ID NO: 195062 - DNA, 16 bp, Unknown
  misc_feature (1)..( 16): Result.006 file - promoters50/4913068
tctaatgaaatttttc

SEQ ID NO: 195063 - DNA, 16 bp, Unknown
  misc_feature (1)..( 16): Result.006 file - promoters50/4913068
cgtaagaaaaaaaaaa

SEQ ID NO: 195064 - DNA, 20 bp, Unknown
  misc_feature (1)..( 20): Result.006 file - promoters50/4913068
aataaaatagtaatcaaaat

SEQ ID NO: 195065 - DNA, 20 bp, Unknown
  misc_feature (1)..( 20): Result.006 file - promoters50/4913068
aaaaaaattgtaatcctttt

SEQ ID NO: 195066 - DNA, 20 bp, Unknown
  misc_feature (1)..( 20): Result.006 file - promoters50/4913068
aataaactagtaacttaaat

SEQ ID NO: 195067 - DNA, 20 bp, Unknown
  misc_feature (1)..( 20): Result.006 file - promoters50/4913068
gctaacaacttaattctttt

SEQ ID NO: 195068 - DNA, 20 bp, Unknown
  misc_feature (1)..( 20): Result.006 file - promoters50/4913068
aaagatgcattaatttgttt

SEQ ID NO: 195069 - DNA, 17 bp, Unknown
  misc_feature (1)..( 17): Result.006 file - promoters50/4913068
tcgtataaaaaaaattt

SEQ ID NO: 195070 - DNA, 17 bp, Unknown
  misc_feature (1)..( 17): Result.006 file - promoters50/4913068
ttatatataaaaatttt

SEQ ID NO: 195071 - DNA, 17 bp, Unknown
  misc_feature (1)..( 17): Result.006 file - promoters50/4913068
ttgtataattttatata

SEQ ID NO: 195072 - DNA, 17 bp, Unknown
  misc_feature (1)..( 17): Result.006 file - promoters50/4913068
ttggatattttcagtta

SEQ ID NO: 195073 - DNA, 17 bp, Unknown
  misc_feature (1)..( 17): Result.006 file - promoters50/4913724
tttcataaaaaaaaagt

SEQ ID NO: 195074 - DNA, 13 bp, Unknown
  misc_feature (1)..( 13): Result.006 file - promoters50/4913724
aacattttggttt

SEQ ID NO: 195075 - DNA, 13 bp, Unknown
  misc_feature (1)..( 13): Result.006 file - promoters50/4913724
aacagtttgctgt

SEQ ID NO: 195076 - DNA, 13 bp, Unknown
  misc_feature (1)..( 13): Result.006 file - promoters50/4913724
tttcttttggttt

SEQ ID NO: 195077 - DNA, 13 bp, Unknown
  misc_feature (1)..( 13): Result.006 file - promoters50/4914111
accattttcgatc

SEQ ID NO: 195078 - DNA, 7 bp, Unknown
  misc_feature (1)..( 7): Result.006 file - promoters50/4914111
tgtataa

SEQ ID NO: 195079 - DNA, 7 bp, Unknown
  misc_feature (1)..( 7): Result.006 file - promoters50/4914111
tgtatat

SEQ ID NO: 195080 - DNA, 7 bp, Unknown
  misc_feature (1)..( 7): Result.006 file - promoters50/4914111
tgtttat

SEQ ID NO: 195081 - DNA, 9 bp, Unknown
  misc_feature (1)..( 9): Result.006 file - promoters50/4914111
ttgtttctc

SEQ ID NO: 195082 - DNA, 9 bp, Unknown
  misc_feature (1)..( 9): Result.006 file - promoters50/4914111
ctgtgtctc

SEQ ID NO: 195083 - DNA, 9 bp, Unknown
  misc_feature (1)..( 9): Result.006 file - promoters50/4914111
ctgtgttga

SEQ ID NO: 195084 - DNA, 7 bp, Unknown
  misc_feature (1)..( 7): Result.006 file - promoters50/4914111
aatttcg

SEQ ID NO: 195085 - DNA, 7 bp, Unknown
  misc_feature (1)..( 7): Result.006 file - promoters50/4914111
aatttct

SEQ ID NO: 195086 - DNA, 7 bp, Unknown
  misc_feature (1)..( 7): Result.006 file - promoters50/4914111
aatatct

SEQ ID NO: 195087 - DNA, 8 bp, Unknown
  misc_feature (1)..( 8): Result.006 file - promoters50/4914111
ctgttttc

SEQ ID NO: 195088 - DNA, 8 bp, Unknown
  misc_feature (1)..( 8): Result.006 file - promoters50/4914111
ctgtttat

SEQ ID NO: 195089 - DNA, 8 bp, Unknown
  misc_feature (1)..( 8): Result.006 file - promoters50/4914111
gtgtatat

SEQ ID NO: 195090 - DNA, 7 bp, Unknown
  misc_feature (1)..( 7): Result.006 file - promoters50/4914111
tttcttg

SEQ ID NO: 195091 - DNA, 7 bp, Unknown
  misc_feature (1)..( 7): Result.006 file - promoters50/4914111
tttattg

SEQ ID NO: 195092 - DNA, 7 bp, Unknown
  misc_feature (1)..( 7): Result.006 file - promoters50/4914111
tgtatat

SEQ ID NO: 195093 - DNA, 7 bp, Unknown
  misc_feature (1)..( 7): Result.006 file - promoters50/4914111
tatgcag

SEQ ID NO: 195094 - DNA, 7 bp, Unknown
  misc_feature (1)..( 7): Result.006 file - promoters50/4914111
gatgcag

SEQ ID NO: 195095 - DNA, 7 bp, Unknown
  misc_feature (1)..( 7): Result.006 file - promoters50/4914111
gatgcac

SEQ ID NO: 195096 - DNA, 9 bp, Unknown
  misc_feature (1)..( 9): Result.006 file - promoters50/4914111
aaatgattt

SEQ ID NO: 195097 - DNA, 9 bp, Unknown
  misc_feature (1)..( 9): Result.006 file - promoters50/4914111
taatggttt

SEQ ID NO: 195098 - DNA, 9 bp, Unknown
  misc_feature (1)..( 9): Result.006 file - promoters50/4914111
taatagtta

SEQ ID NO: 195099 - DNA, 8 bp, Unknown
  misc_feature (1)..( 8): Result.006 file - promoters50/4914111
atctggtt

SEQ ID NO: 195100 - DNA, 8 bp, Unknown
  misc_feature (1)..( 8): Result.006 file - promoters50/4914111
ttcttgtt

SEQ ID NO: 195101 - DNA, 8 bp, Unknown
  misc_feature (1)..( 8): Result.006 file - promoters50/4914111
ttcctgta

SEQ ID NO: 195102 - DNA, 13 bp, Unknown
  misc_feature (1)..( 13): Result.006 file - promoters50/4914111
ttcggtgattagt

SEQ ID NO: 195103 - DNA, 13 bp, Unknown
  misc_feature (1)..( 13): Result.006 file - promoters50/4914111
ttcgatgatgctg

SEQ ID NO: 195104 - DNA, 13 bp, Unknown
  misc_feature (1)..( 13): Result.006 file - promoters50/4914228
gttgatgctgctg

SEQ ID NO: 195105 - DNA, 8 bp, Unknown
  misc_feature (1)..( 8): Result.006 file - promoters50/4914228
gagaagaa

SEQ ID NO: 195106 - DNA, 8 bp, Unknown
  misc_feature (1)..( 8): Result.006 file - promoters50/4914228
ttgaagaa

SEQ ID NO: 195107 - DNA, 8 bp, Unknown
  misc_feature (1)..( 8): Result.006 file - promoters50/4914228
aagtagag

SEQ ID NO: 195108 - DNA, 7 bp, Unknown
  misc_feature (1)..( 7): Result.006 file - promoters50/4914228
gatggac

SEQ ID NO: 195109 - DNA, 7 bp, Unknown
  misc_feature (1)..( 7): Result.006 file - promoters50/4914228
gatggat

SEQ ID NO: 195110 - DNA, 7 bp, Unknown
  misc_feature (1)..( 7): Result.006 file - promoters50/4914228
gatcgat

SEQ ID NO: 195111 - DNA, 7 bp, Unknown
  misc_feature (1)..( 7): Result.006 file - promoters50/4914228
cagaaag

SEQ ID NO: 195112 - DNA, 7 bp, Unknown
  misc_feature (1)..( 7): Result.006 file - promoters50/4914228
aagaaag

SEQ ID NO: 195113 - DNA, 7 bp, Unknown
  misc_feature (1)..( 7): Result.006 file - promoters50/4914228
aagaaat

SEQ ID NO: 195114 - DNA, 10 bp, Unknown
  misc_feature (1)..( 10): Result.006 file - promoters50/4914228
agatactgat

SEQ ID NO: 195115 - DNA, 10 bp, Unknown
  misc_feature (1)..( 10): Result.006 file - promoters50/4914228
ttataatgat

SEQ ID NO: 195116 - DNA, 10 bp, Unknown
  misc_feature (1)..( 10): Result.006 file - promoters50/4914228
ttaaaatcga

SEQ ID NO: 195117 - DNA, 10 bp, Unknown
  misc_feature (1)..( 10): Result.006 file - promoters50/4914438
tcaaaatctg

SEQ ID NO: 195118 - DNA, 10 bp, Unknown
  misc_feature (1)..( 10): Result.006 file - promoters50/4914438
aaattgattt

SEQ ID NO: 195119 - DNA, 10 bp, Unknown
  misc_feature (1)..( 10): Result.006 file - promoters50/4914438
taattgatga

SEQ ID NO: 195120 - DNA, 10 bp, Unknown
  misc_feature (1)..( 10): Result.006 file - promoters50/4914438
agattgattt

SEQ ID NO: 195121 - DNA, 10 bp, Unknown
  misc_feature (1)..( 10): Result.006 file - promoters50/4914438
ttcttgattc

SEQ ID NO: 195122 - DNA, 10 bp, Unknown
  misc_feature (1)..( 10): Result.006 file - promoters50/4914438
gatttgattg

SEQ ID NO: 195123 - DNA, 10 bp, Unknown
  misc_feature (1)..( 10): Result.006 file - promoters50/4915127
gatttaattc

SEQ ID NO: 195124 - DNA, 9 bp, Unknown
  misc_feature (1)..( 9): Result.006 file - promoters50/4915127
actataaat

SEQ ID NO: 195125 - DNA, 9 bp, Unknown
  misc_feature (1)..( 9): Result.006 file - promoters50/4915127
tttataaaa

SEQ ID NO: 195126 - DNA, 9 bp, Unknown
  misc_feature (1)..( 9): Result.006 file - promoters50/4915127
actataaat

SEQ ID NO: 195127 - DNA, 10 bp, Unknown
  misc_feature (1)..( 10): Result.006 file - promoters50/4915127
actattaaag

SEQ ID NO: 195128 - DNA, 11 bp, Unknown
  misc_feature (1)..( 11): Result.006 file - promoters50/4915127
ggtatatatat

SEQ ID NO: 195129 - DNA, 11 bp, Unknown
  misc_feature (1)..( 11): Result.006 file - promoters50/4915163
tataagtatcg

SEQ ID NO: 195130 - DNA, 17 bp, Unknown
  misc_feature (1)..( 17): Result.006 file - promoters50/4915163
tgtattctacatgggcc

SEQ ID NO: 195131 - DNA, 17 bp, Unknown
  misc_feature (1)..( 17): Result.006 file - promoters50/4915163
ttgattctaaaatattg

SEQ ID NO: 195132 - DNA, 17 bp, Unknown
  misc_feature (1)..( 17): Result.006 file - promoters50/4915163
ttagttcttcatttcca

SEQ ID NO: 195133 - DNA, 17 bp, Unknown
  misc_feature (1)..( 17): Result.006 file - promoters50/4915163
taaattttaaaattatt

SEQ ID NO: 195134 - DNA, 17 bp, Unknown
  misc_feature (1)..( 17): Result.006 file - promoters50/4915163
caaattcatcacaataa

SEQ ID NO: 195135 - DNA, 17 bp, Unknown
  misc_feature (1)..( 17): Result.006 file - promoters50/4915163
taaattttgaaataatt

SEQ ID NO: 195136 - DNA, 17 bp, Unknown
  misc_feature (1)..( 17): Result.006 file - promoters50/4915163
tgtgttttgaaaagagt

SEQ ID NO: 195137 - DNA, 12 bp, Unknown
  misc_feature (1)..( 12): Result.006 file - promoters50/4915163
ctataaaaacca

SEQ ID NO: 195138 - DNA, 12 bp, Unknown
  misc_feature (1)..( 12): Result.006 file - promoters50/4915163
ctataaatatca

SEQ ID NO: 195139 - DNA, 12 bp, Unknown
  misc_feature (1)..( 12): Result.006 file - promoters50/4915163
ccataaaagcag

SEQ ID NO: 195140 - DNA, 13 bp, Unknown
  misc_feature (1)..( 13): Result.006 file - promoters50/4915163
atataataaccaa

SEQ ID NO: 195141 - DNA, 13 bp, Unknown
  misc_feature (1)..( 13): Result.006 file - promoters50/4915163
ttatataaacaaa

SEQ ID NO: 195142 - DNA, 13 bp, Unknown
  misc_feature (1)..( 13): Result.006 file - promoters50/4915163
cgataaatatccc

SEQ ID NO: 195143 - DNA, 13 bp, Unknown
  misc_feature (1)..( 13): Result.006 file - promoters50/4915163
tttataagtataa

SEQ ID NO: 195144 - DNA, 13 bp, Unknown
  misc_feature (1)..( 13): Result.006 file - promoters50/4915163
aatataagtaaca

SEQ ID NO: 195145 - DNA, 13 bp, Unknown
  misc_feature (1)..( 13): Result.006 file - promoters50/4915163
tttgtaacttcag

SEQ ID NO: 195146 - DNA, 13 bp, Unknown
  misc_feature (1)..( 13): Result.006 file - promoters50/4915163
tttaaaagtaaga

SEQ ID NO: 195147 - DNA, 13 bp, Unknown
  misc_feature (1)..( 13): Result.006 file - promoters50/4915163
cttataattatgc

SEQ ID NO: 195148 - DNA, 13 bp, Unknown
  misc_feature (1)..( 13): Result.006 file - promoters50/4915163
agatgaagtcaca

SEQ ID NO: 195149 - DNA, 13 bp, Unknown
  misc_feature (1)..( 13): Result.006 file - promoters50/4915163
tttgaaaagagtt

SEQ ID NO: 195150 - DNA, 14 bp, Unknown
  misc_feature (1)..( 14): Result.006 file - promoters50/4915163
atctttataagtat

SEQ ID NO: 195151 - DNA, 14 bp, Unknown
  misc_feature (1)..( 14): Result.006 file - promoters50/4915163
atctttatacaaaa

SEQ ID NO: 195152 - DNA, 14 bp, Unknown
  misc_feature (1)..( 14): Result.006 file - promoters50/4915163
aaatttgtaacttc

SEQ ID NO: 195153 - DNA, 14 bp, Unknown
  misc_feature (1)..( 14): Result.006 file - promoters50/4915163
cgttttaaaagtaa

SEQ ID NO: 195154 - DNA, 14 bp, Unknown
  misc_feature (1)..( 14): Result.006 file - promoters50/4915163
aaacttataattat

SEQ ID NO: 195155 - DNA, 14 bp, Unknown
  misc_feature (1)..( 14): Result.006 file - promoters50/4915199
tgttttgaaaagag

SEQ ID NO: 195156 - DNA, 6 bp, Unknown
  misc_feature (1)..( 6): Result.006 file - promoters50/4915199
tttctt

SEQ ID NO: 195157 - DNA, 6 bp, Unknown
  misc_feature (1)..( 6): Result.006 file - promoters50/4915199
tttctt

SEQ ID NO: 195158 - DNA, 6 bp, Unknown
  misc_feature (1)..( 6): Result.006 file - promoters50/4915199
tttctt

SEQ ID NO: 195159 - DNA, 13 bp, Unknown
  misc_feature (1)..( 13): Result.006 file - promoters50/4915199
cttgtttctctac

SEQ ID NO: 195160 - DNA, 13 bp, Unknown
  misc_feature (1)..( 13): Result.006 file - promoters50/4915199
atggtttctctga

SEQ ID NO: 195161 - DNA, 13 bp, Unknown
  misc_feature (1)..( 13): Result.006 file - promoters50/4915199
cttgtttcttttg

SEQ ID NO: 195162 - DNA, 13 bp, Unknown
  misc_feature (1)..( 13): Result.006 file - promoters50/4915199
atatattctgtga

SEQ ID NO: 195163 - DNA, 10 bp, Unknown
  misc_feature (1)..( 10): Result.006 file - promoters50/4915199
tcactgtttt

SEQ ID NO: 195164 - DNA, 10 bp, Unknown
  misc_feature (1)..( 10): Result.006 file - promoters50/4915199
tcactgttta

SEQ ID NO: 195165 - DNA, 10 bp, Unknown
  misc_feature (1)..( 10): Result.006 file - promoters50/4915199
ttaatgtttt

SEQ ID NO: 195166 - DNA, 8 bp, Unknown
  misc_feature (1)..( 8): Result.006 file - promoters50/4915199
gttaagag

SEQ ID NO: 195167 - DNA, 8 bp, Unknown
  misc_feature (1)..( 8): Result.006 file - promoters50/4915199
gtttagat

SEQ ID NO: 195168 - DNA, 8 bp, Unknown
  misc_feature (1)..( 8): Result.006 file - promoters50/4915199
aattagat

SEQ ID NO: 195169 - DNA, 8 bp, Unknown
  misc_feature (1)..( 8): Result.006 file - promoters50/4915199
tgttttgg

SEQ ID NO: 195170 - DNA, 8 bp, Unknown
  misc_feature (1)..( 8): Result.006 file - promoters50/4915199
tgtgttgt

SEQ ID NO: 195171 - DNA, 8 bp, Unknown
  misc_feature (1)..( 8): Result.006 file - promoters50/4915199
tgtttttg

SEQ ID NO: 195172 - DNA, 9 bp, Unknown
  misc_feature (1)..( 9): Result.006 file - promoters50/4915199
ttttggttc

SEQ ID NO: 195173 - DNA, 9 bp, Unknown
  misc_feature (1)..( 9): Result.006 file - promoters50/4915199
tgttgcttc

SEQ ID NO: 195174 - DNA, 9 bp, Unknown
  misc_feature (1)..( 9): Result.006 file - promoters50/4915199
tttttgttt

SEQ ID NO: 195175 - DNA, 7 bp, Unknown
  misc_feature (1)..( 7): Result.006 file - promoters50/4915199
cttgttt

SEQ ID NO: 195176 - DNA, 7 bp, Unknown
  misc_feature (1)..( 7): Result.006 file - promoters50/4915199
tttgttt

SEQ ID NO: 195177 - DNA, 7 bp, Unknown
  misc_feature (1)..( 7): Result.006 file - promoters50/4915199
tttgtta

SEQ ID NO: 195178 - DNA, 7 bp, Unknown
  misc_feature (1)..( 7): Result.006 file - promoters50/4915199
tgttttg

SEQ ID NO: 195179 - DNA, 7 bp, Unknown
  misc_feature (1)..( 7): Result.006 file - promoters50/4915199
tgttttt

SEQ ID NO: 195180 - DNA, 8 bp, Unknown
  misc_feature (1)..( 8): Result.006 file - promoters50/4915199
tgttgttg

SEQ ID NO: 195181 - DNA, 8 bp, Unknown
  misc_feature (1)..( 8): Result.006 file - promoters50/4915199
tgttttgg

SEQ ID NO: 195182 - DNA, 8 bp, Unknown
  misc_feature (1)..( 8): Result.006 file - promoters50/4915199
gtttttgg

SEQ ID NO: 195183 - DNA, 9 bp, Unknown
  misc_feature (1)..( 9): Result.006 file - promoters50/4915199
tgttgttgc

SEQ ID NO: 195184 - DNA, 9 bp, Unknown
  misc_feature (1)..( 9): Result.006 file - promoters50/4915199
tgttttgtt

SEQ ID NO: 195185 - DNA, 9 bp, Unknown
  misc_feature (1)..( 9): Result.006 file - promoters50/4915199
aatttggtt

SEQ ID NO: 195186 - DNA, 9 bp, Unknown
  misc_feature (1)..( 9): Result.006 file - promoters50/4915199
aatatggat

SEQ ID NO: 195187 - DNA, 12 bp, Unknown
  misc_feature (1)..( 12): Result.006 file - promoters50/4915199
gataaaaaatat

SEQ ID NO: 195188 - DNA, 12 bp, Unknown
  misc_feature (1)..( 12): Result.006 file - promoters50/4915199
aaagaaaattat

SEQ ID NO: 195189 - DNA, 12 bp, Unknown
  misc_feature (1)..( 12): Result.006 file - promoters50/4915199
atagaaaagtaa

SEQ ID NO: 195190 - DNA, 8 bp, Unknown
  misc_feature (1)..( 8): Result.006 file - promoters50/4915199
agttgtta

SEQ ID NO: 195191 - DNA, 8 bp, Unknown
  misc_feature (1)..( 8): Result.006 file - promoters50/4915199
tgttgttg

SEQ ID NO: 195192 - DNA, 8 bp, Unknown
  misc_feature (1)..( 8): Result.006 file - promoters50/4915244
tgtttttg

SEQ ID NO: 195193 - DNA, 9 bp, Unknown
  misc_feature (1)..( 9): Result.006 file - promoters50/4915244
aataaatag

SEQ ID NO: 195194 - DNA, 9 bp, Unknown
  misc_feature (1)..( 9): Result.006 file - promoters50/4915244
aattaatct

SEQ ID NO: 195195 - DNA, 9 bp, Unknown
  misc_feature (1)..( 9): Result.006 file - promoters50/4915244
aaaaaaaag

SEQ ID NO: 195196 - DNA, 9 bp, Unknown
  misc_feature (1)..( 9): Result.006 file - promoters50/4915244
tattactct

SEQ ID NO: 195197 - DNA, 9 bp, Unknown
  misc_feature (1)..( 9): Result.006 file - promoters50/4915244
tattacaat

SEQ ID NO: 195198 - DNA, 9 bp, Unknown
  misc_feature (1)..( 9): Result.006 file - promoters50/4915244
aaaaaatca

SEQ ID NO: 195199 - DNA, 11 bp, Unknown
  misc_feature (1)..( 11): Result.006 file - promoters50/4915244
agttgtttata

SEQ ID NO: 195200 - DNA, 11 bp, Unknown
  misc_feature (1)..( 11): Result.006 file - promoters50/4915244
tcatgtttaat

SEQ ID NO: 195201 - DNA, 11 bp, Unknown
  misc_feature (1)..( 11): Result.006 file - promoters50/4915244
atgagttcata

SEQ ID NO: 195202 - DNA, 11 bp, Unknown
  misc_feature (1)..( 11): Result.006 file - promoters50/4915244
ctttgcttaca

SEQ ID NO: 195203 - DNA, 11 bp, Unknown
  misc_feature (1)..( 11): Result.006 file - promoters50/4915244
cttggcttgct

SEQ ID NO: 195204 - DNA, 11 bp, Unknown
  misc_feature (1)..( 11): Result.006 file - promoters50/4915244
acatatttagc

SEQ ID NO: 195205 - DNA, 12 bp, Unknown
  misc_feature (1)..( 12): Result.006 file - promoters50/4915244
accgagtataaa

SEQ ID NO: 195206 - DNA, 12 bp, Unknown
  misc_feature (1)..( 12): Result.006 file - promoters50/4915244
tctacgtataat

SEQ ID NO: 195207 - DNA, 12 bp, Unknown
  misc_feature (1)..( 12): Result.006 file - promoters50/4915244
acggattataat

SEQ ID NO: 195208 - DNA, 12 bp, Unknown
  misc_feature (1)..( 12): Result.006 file - promoters50/4915244
gtgtattacaat

SEQ ID NO: 195209 - DNA, 12 bp, Unknown
  misc_feature (1)..( 12): Result.006 file - promoters50/4915244
actctatattac

SEQ ID NO: 195210 - DNA, 12 bp, Unknown
  misc_feature (1)..( 12): Result.006 file - promoters50/4915244
acaatgtacaaa

SEQ ID NO: 195211 - DNA, 11 bp, Unknown
  misc_feature (1)..( 11): Result.006 file - promoters50/4915244
cttttaaatta

SEQ ID NO: 195212 - DNA, 11 bp, Unknown
  misc_feature (1)..( 11): Result.006 file - promoters50/4915244
cttgtaatgtt

SEQ ID NO: 195213 - DNA, 11 bp, Unknown
  misc_feature (1)..( 11): Result.006 file - promoters50/4915244
atttcaattta

SEQ ID NO: 195214 - DNA, 11 bp, Unknown
  misc_feature (1)..( 11): Result.006 file - promoters50/4915244
tttttaattat

SEQ ID NO: 195215 - DNA, 11 bp, Unknown
  misc_feature (1)..( 11): Result.006 file - promoters50/4915244
atttccatttg

SEQ ID NO: 195216 - DNA, 11 bp, Unknown
  misc_feature (1)..( 11): Result.006 file - promoters50/4915347
ttcccaatttt

SEQ ID NO: 195217 - DNA, 11 bp, Unknown
  misc_feature (1)..( 11): Result.006 file - promoters50/4915347
aacttttgaat

SEQ ID NO: 195218 - DNA, 11 bp, Unknown
  misc_feature (1)..( 11): Result.006 file - promoters50/4915347
atttttttaat

SEQ ID NO: 195219 - DNA, 11 bp, Unknown
  misc_feature (1)..( 11): Result.006 file - promoters50/4915355
atatttttttt

SEQ ID NO: 195220 - DNA, 12 bp, Unknown
  misc_feature (1)..( 12): Result.006 file - promoters50/4915355
tttaaaatctgg

SEQ ID NO: 195221 - DNA, 12 bp, Unknown
  misc_feature (1)..( 12): Result.006 file - promoters50/4915355
aacaaaatctta

SEQ ID NO: 195222 - DNA, 12 bp, Unknown
  misc_feature (1)..( 12): Result.006 file - promoters50/4915355
accaaaaactgt

SEQ ID NO: 195223 - DNA, 12 bp, Unknown
  misc_feature (1)..( 12): Result.006 file - promoters50/4915355
aacataatcaat

SEQ ID NO: 195224 - DNA, 12 bp, Unknown
  misc_feature (1)..( 12): Result.006 file - promoters50/4915355
cttaaaatataa

SEQ ID NO: 195225 - DNA, 13 bp, Unknown
  misc_feature (1)..( 13): Result.006 file - promoters50/4915355
ttttaaaataatt

SEQ ID NO: 195226 - DNA, 13 bp, Unknown
  misc_feature (1)..( 13): Result.006 file - promoters50/4915355
gactaaaataact

SEQ ID NO: 195227 - DNA, 13 bp, Unknown
  misc_feature (1)..( 13): Result.006 file - promoters50/4915355
tataaaaacaatt

SEQ ID NO: 195228 - DNA, 13 bp, Unknown
  misc_feature (1)..( 13): Result.006 file - promoters50/4915355
ttttacaatgtca

SEQ ID NO: 195229 - DNA, 13 bp, Unknown
  misc_feature (1)..( 13): Result.006 file - promoters50/4915355
aactgaaatttta

SEQ ID NO: 195230 - DNA, 8 bp, Unknown
  misc_feature (1)..( 8): Result.006 file - promoters50/4915355
attaaacg

SEQ ID NO: 195231 - DNA, 8 bp, Unknown
  misc_feature (1)..( 8): Result.006 file - promoters50/4915355
tttaaact

SEQ ID NO: 195232 - DNA, 9 bp, Unknown
  misc_feature (1)..( 9): Result.006 file - promoters50/4915355
attcaaaaa

SEQ ID NO: 195233 - DNA, 9 bp, Unknown
  misc_feature (1)..( 9): Result.006 file - promoters50/4915355
tttcaaatg

SEQ ID NO: 195234 - DNA, 9 bp, Unknown
  misc_feature (1)..( 9): Result.006 file - promoters50/4915355
cttccaatg

SEQ ID NO: 195235 - DNA, 12 bp, Unknown
  misc_feature (1)..( 12): Result.006 file - promoters50/4915355
gatatatcaatt

SEQ ID NO: 195236 - DNA, 12 bp, Unknown
  misc_feature (1)..( 12): Result.006 file - promoters50/4915355
gatatagcaaaa

SEQ ID NO: 195237 - DNA, 12 bp, Unknown
  misc_feature (1)..( 12): Result.006 file - promoters50/4915355
caaatatcgatt

SEQ ID NO: 195238 - DNA, 12 bp, Unknown
  misc_feature (1)..( 12): Result.006 file - promoters50/4915355
aaaatataaatt

SEQ ID NO: 195239 - DNA, 12 bp, Unknown
  misc_feature (1)..( 12): Result.006 file - promoters50/4915384
aaaatatccaaa

SEQ ID NO: 195240 - DNA, 8 bp, Unknown
  misc_feature (1)..( 8): Result.006 file - promoters50/4915384
atttgatt

SEQ ID NO: 195241 - DNA, 8 bp, Unknown
  misc_feature (1)..( 8): Result.006 file - promoters50/4915384
ttttaatt

SEQ ID NO: 195242 - DNA, 8 bp, Unknown
  misc_feature (1)..( 8): Result.006 file - promoters50/4915384
ttttaaga

SEQ ID NO: 195243 - DNA, 9 bp, Unknown
  misc_feature (1)..( 9): Result.006 file - promoters50/4915384
ttttatttt

SEQ ID NO: 195244 - DNA, 9 bp, Unknown
  misc_feature (1)..( 9): Result.006 file - promoters50/4915384
gtttatttt

SEQ ID NO: 195245 - DNA, 10 bp, Unknown
  misc_feature (1)..( 10): Result.006 file - promoters50/4915384
atttgattat

SEQ ID NO: 195246 - DNA, 10 bp, Unknown
  misc_feature (1)..( 10): Result.006 file - promoters50/4915384
ggtttattca

SEQ ID NO: 195247 - DNA, 8 bp, Unknown
  misc_feature (1)..( 8): Result.006 file - promoters50/4915384
ttaagaga

SEQ ID NO: 195248 - DNA, 8 bp, Unknown
  misc_feature (1)..( 8): Result.006 file - promoters50/4915384
ttaagaat

SEQ ID NO: 195249 - DNA, 8 bp, Unknown
  misc_feature (1)..( 8): Result.006 file - promoters50/4915384
ataagaga

SEQ ID NO: 195250 - DNA, 8 bp, Unknown
  misc_feature (1)..( 8): Result.006 file - promoters50/4915384
tcaagaga

SEQ ID NO: 195251 - DNA, 9 bp, Unknown
  misc_feature (1)..( 9): Result.006 file - promoters50/4915384
gaaaagaaa

SEQ ID NO: 195252 - DNA, 9 bp, Unknown
  misc_feature (1)..( 9): Result.006 file - promoters50/4915384
gaaaagtat

SEQ ID NO: 195253 - DNA, 9 bp, Unknown
  misc_feature (1)..( 9): Result.006 file - promoters50/4915384
gcaaaggta

SEQ ID NO: 195254 - DNA, 7 bp, Unknown
  misc_feature (1)..( 7): Result.006 file - promoters50/4915384
taagaga

SEQ ID NO: 195255 - DNA, 7 bp, Unknown
  misc_feature (1)..( 7): Result.006 file - promoters50/4915384
caagaga

SEQ ID NO: 195256 - DNA, 7 bp, Unknown
  misc_feature (1)..( 7): Result.006 file - promoters50/4915384
taagaga

SEQ ID NO: 195257 - DNA, 9 bp, Unknown
  misc_feature (1)..( 9): Result.006 file - promoters50/4915384
aaaaaatga

SEQ ID NO: 195258 - DNA, 9 bp, Unknown
  misc_feature (1)..( 9): Result.006 file - promoters50/4915384
tcaaattga

SEQ ID NO: 195259 - DNA, 9 bp, Unknown
  misc_feature (1)..( 9): Result.006 file - promoters50/4915384
tcacattct

SEQ ID NO: 195260 - DNA, 13 bp, Unknown
  misc_feature (1)..( 13): Result.006 file - promoters50/4915384
ttttaacttgttg

SEQ ID NO: 195261 - DNA, 13 bp, Unknown
  misc_feature (1)..( 13): Result.006 file - promoters50/4915384
ttttaaattatta

SEQ ID NO: 195262 - DNA, 13 bp, Unknown
  misc_feature (1)..( 13): Result.006 file - promoters50/4915384
gtttaaataatta

SEQ ID NO: 195263 - DNA, 8 bp, Unknown
  misc_feature (1)..( 8): Result.006 file - promoters50/4915384
aaatatgt

SEQ ID NO: 195264 - DNA, 8 bp, Unknown
  misc_feature (1)..( 8): Result.006 file - promoters50/4915384
aaatttgt

SEQ ID NO: 195265 - DNA, 8 bp, Unknown
  misc_feature (1)..( 8): Result.006 file - promoters50/4915384
agatttgt

SEQ ID NO: 195266 - DNA, 11 bp, Unknown
  misc_feature (1)..( 11): Result.006 file - promoters50/4915384
tgtttaaataa

SEQ ID NO: 195267 - DNA, 11 bp, Unknown
  misc_feature (1)..( 11): Result.006 file - promoters50/4915384
tgtgtaaagct

SEQ ID NO: 195268 - DNA, 11 bp, Unknown
  misc_feature (1)..( 11): Result.006 file - promoters50/4915395
gttttcaataa

SEQ ID NO: 195269 - DNA, 9 bp, Unknown
  misc_feature (1)..( 9): Result.006 file - promoters50/4915395
catataaaa

SEQ ID NO: 195270 - DNA, 9 bp, Unknown
  misc_feature (1)..( 9): Result.006 file - promoters50/4915395
tttataaaa

SEQ ID NO: 195271 - DNA, 9 bp, Unknown
  misc_feature (1)..( 9): Result.006 file - promoters50/4915395
tttttaaac

SEQ ID NO: 195272 - DNA, 7 bp, Unknown
  misc_feature (1)..( 7): Result.006 file - promoters50/4915395
caaatgg

SEQ ID NO: 195273 - DNA, 7 bp, Unknown
  misc_feature (1)..( 7): Result.006 file - promoters50/4915395
caaatga

SEQ ID NO: 195274 - DNA, 7 bp, Unknown
  misc_feature (1)..( 7): Result.006 file - promoters50/4915395
caattga

SEQ ID NO: 195275 - DNA, 8 bp, Unknown
  misc_feature (1)..( 8): Result.006 file - promoters50/4915395
aaattaaa

SEQ ID NO: 195276 - DNA, 8 bp, Unknown
  misc_feature (1)..( 8): Result.006 file - promoters50/4915395
aaaataaa

SEQ ID NO: 195277 - DNA, 8 bp, Unknown
  misc_feature (1)..( 8): Result.006 file - promoters50/4915420
aaaagata

SEQ ID NO: 195278 - DNA, 11 bp, Unknown
  misc_feature (1)..( 11): Result.006 file - promoters50/4915420
agtaatatttg

SEQ ID NO: 195279 - DNA, 11 bp, Unknown
  misc_feature (1)..( 11): Result.006 file - promoters50/4915420
attaagatttt

SEQ ID NO: 195280 - DNA, 11 bp, Unknown
  misc_feature (1)..( 11): Result.006 file - promoters50/4915420
agtgatatgag

SEQ ID NO: 195281 - DNA, 11 bp, Unknown
  misc_feature (1)..( 11): Result.006 file - promoters50/4915420
gagaatttttg

SEQ ID NO: 195282 - DNA, 11 bp, Unknown
  misc_feature (1)..( 11): Result.006 file - promoters50/4915420
cttaaaattga

SEQ ID NO: 195283 - DNA, 11 bp, Unknown
  misc_feature (1)..( 11): Result.006 file - promoters50/4915420
gagaatttttg

SEQ ID NO: 195284 - DNA, 11 bp, Unknown
  misc_feature (1)..( 11): Result.006 file - promoters50/4915420
aataaagttgt

SEQ ID NO: 195285 - DNA, 11 bp, Unknown
  misc_feature (1)..( 11): Result.006 file - promoters50/4915420
cttacaatttc

SEQ ID NO: 195286 - DNA, 8 bp, Unknown
  misc_feature (1)..( 8): Result.006 file - promoters50/4915420
atatgatt

SEQ ID NO: 195287 - DNA, 8 bp, Unknown
  misc_feature (1)..( 8): Result.006 file - promoters50/4915420
atatgagt

SEQ ID NO: 195288 - DNA, 8 bp, Unknown
  misc_feature (1)..( 8): Result.006 file - promoters50/4915420
atattagt

SEQ ID NO: 195289 - DNA, 8 bp, Unknown
  misc_feature (1)..( 8): Result.006 file - promoters50/4915420
atattagt

SEQ ID NO: 195290 - DNA, 8 bp, Unknown
  misc_feature (1)..( 8): Result.006 file - promoters50/4915420
ttattaga

SEQ ID NO: 195291 - DNA, 8 bp, Unknown
  misc_feature (1)..( 8): Result.006 file - promoters50/4915420
ttattaca

SEQ ID NO: 195292 - DNA, 10 bp, Unknown
  misc_feature (1)..( 10): Result.006 file - promoters50/4915420
tgattggtac

SEQ ID NO: 195293 - DNA, 10 bp, Unknown
  misc_feature (1)..( 10): Result.006 file - promoters50/4915420
atattagtat

SEQ ID NO: 195294 - DNA, 10 bp, Unknown
  misc_feature (1)..( 10): Result.006 file - promoters50/4915420
tttgtagtat

SEQ ID NO: 195295 - DNA, 10 bp, Unknown
  misc_feature (1)..( 10): Result.006 file - promoters50/4915420
atatgagtga

SEQ ID NO: 195296 - DNA, 10 bp, Unknown
  misc_feature (1)..( 10): Result.006 file - promoters50/4915420
ttattagact

SEQ ID NO: 195297 - DNA, 10 bp, Unknown
  misc_feature (1)..( 10): Result.006 file - promoters50/4915511
tgcttattac

SEQ ID NO: 195298 - DNA, 7 bp, Unknown
  misc_feature (1)..( 7): Result.006 file - promoters50/4915511
taacaca

SEQ ID NO: 195299 - DNA, 7 bp, Unknown
  misc_feature (1)..( 7): Result.006 file - promoters50/4915511
taaaaca

SEQ ID NO: 195300 - DNA, 7 bp, Unknown
  misc_feature (1)..( 7): Result.006 file - promoters50/4915511
aaaaaca

SEQ ID NO: 195301 - DNA, 8 bp, Unknown
  misc_feature (1)..( 8): Result.006 file - promoters50/4915511
atcttaaa

SEQ ID NO: 195302 - DNA, 8 bp, Unknown
  misc_feature (1)..( 8): Result.006 file - promoters50/4915511
ctctgaaa

SEQ ID NO: 195303 - DNA, 8 bp, Unknown
  misc_feature (1)..( 8): Result.006 file - promoters50/4915511
ctcagaag

SEQ ID NO: 195304 - DNA, 8 bp, Unknown
  misc_feature (1)..( 8): Result.006 file - promoters50/4915511
cagttata

SEQ ID NO: 195305 - DNA, 8 bp, Unknown
  misc_feature (1)..( 8): Result.006 file - promoters50/4915511
cagttaat

SEQ ID NO: 195306 - DNA, 8 bp, Unknown
  misc_feature (1)..( 8): Result.006 file - promoters50/4915511
gagttata

SEQ ID NO: 195307 - DNA, 6 bp, Unknown
  misc_feature (1)..( 6): Result.006 file - promoters50/4915511
aaaacc

SEQ ID NO: 195308 - DNA, 6 bp, Unknown
  misc_feature (1)..( 6): Result.006 file - promoters50/4915511
aaaacc

SEQ ID NO: 195309 - DNA, 6 bp, Unknown
  misc_feature (1)..( 6): Result.006 file - promoters50/4915606
aaaacc

SEQ ID NO: 195310 - DNA, 10 bp, Unknown
  misc_feature (1)..( 10): Result.006 file - promoters50/4915606
tttaaattta

SEQ ID NO: 195311 - DNA, 10 bp, Unknown
  misc_feature (1)..( 10): Result.006 file - promoters50/4915606
ttttaatgat

SEQ ID NO: 195312 - DNA, 10 bp, Unknown
  misc_feature (1)..( 10): Result.006 file - promoters50/4915606
tttaagtttc

SEQ ID NO: 195313 - DNA, 10 bp, Unknown
  misc_feature (1)..( 10): Result.006 file - promoters50/4915606
aattaatgta

SEQ ID NO: 195314 - DNA, 10 bp, Unknown
  misc_feature (1)..( 10): Result.006 file - promoters50/4915606
gattaatttc

SEQ ID NO: 195315 - DNA, 10 bp, Unknown
  misc_feature (1)..( 10): Result.006 file - promoters50/4915606
caaaaataat

SEQ ID NO: 195316 - DNA, 12 bp, Unknown
  misc_feature (1)..( 12): Result.006 file - promoters50/4915606
aaaaacaaagac

SEQ ID NO: 195317 - DNA, 12 bp, Unknown
  misc_feature (1)..( 12): Result.006 file - promoters50/4915606
taaagcaaacaa

SEQ ID NO: 195318 - DNA, 12 bp, Unknown
  misc_feature (1)..( 12): Result.006 file - promoters50/4915606
ataaataaaaga

SEQ ID NO: 195319 - DNA, 12 bp, Unknown
  misc_feature (1)..( 12): Result.006 file - promoters50/4915606
aaaaccaaaacc

SEQ ID NO: 195320 - DNA, 12 bp, Unknown
  misc_feature (1)..( 12): Result.006 file - promoters50/4915606
gaaagaaaaaca

SEQ ID NO: 195321 - DNA, 12 bp, Unknown
  misc_feature (1)..( 12): Result.006 file - promoters50/4915606
aaaaacacggct

SEQ ID NO: 195322 - DNA, 12 bp, Unknown
  misc_feature (1)..( 12): Result.006 file - promoters50/4915606
acaaccaatgga

SEQ ID NO: 195323 - DNA, 15 bp, Unknown
  misc_feature (1)..( 15): Result.006 file - promoters50/4915606
ctacttattccatta

SEQ ID NO: 195324 - DNA, 15 bp, Unknown
  misc_feature (1)..( 15): Result.006 file - promoters50/4915606
aaactcattcaatta

SEQ ID NO: 195325 - DNA, 15 bp, Unknown
  misc_feature (1)..( 15): Result.006 file - promoters50/4915606
gaaatcataatagag

SEQ ID NO: 195326 - DNA, 15 bp, Unknown
  misc_feature (1)..( 15): Result.006 file - promoters50/4915606
aaaataataataaaa

SEQ ID NO: 195327 - DNA, 15 bp, Unknown
  misc_feature (1)..( 15): Result.006 file - promoters50/4915606
caaactattcaaaac

SEQ ID NO: 195328 - DNA, 15 bp, Unknown
  misc_feature (1)..( 15): Result.006 file - promoters50/4915606
aaaattaaagtcaat

SEQ ID NO: 195329 - DNA, 10 bp, Unknown
  misc_feature (1)..( 10): Result.006 file - promoters50/4915606
aaaaaaaaac

SEQ ID NO: 195330 - DNA, 10 bp, Unknown
  misc_feature (1)..( 10): Result.006 file - promoters50/4915606
taaataaaag

SEQ ID NO: 195331 - DNA, 10 bp, Unknown
  misc_feature (1)..( 10): Result.006 file - promoters50/4915606
aaaaccaaaa

SEQ ID NO: 195332 - DNA, 10 bp, Unknown
  misc_feature (1)..( 10): Result.006 file - promoters50/4915606
gaaagaaaaa

SEQ ID NO: 195333 - DNA, 10 bp, Unknown
  misc_feature (1)..( 10): Result.006 file - promoters50/4915606
aaaaacacgg

SEQ ID NO: 195334 - DNA, 10 bp, Unknown
  misc_feature (1)..( 10): Result.006 file - promoters50/4915606
acaaccaatg

SEQ ID NO: 195335 - DNA, 11 bp, Unknown
  misc_feature (1)..( 11): Result.006 file - promoters50/4915606
ccatataaata

SEQ ID NO: 195336 - DNA, 11 bp, Unknown
  misc_feature (1)..( 11): Result.006 file - promoters50/4915606
acatatatata

SEQ ID NO: 195337 - DNA, 11 bp, Unknown
  misc_feature (1)..( 11): Result.006 file - promoters50/4915606
ccatataaatt

SEQ ID NO: 195338 - DNA, 11 bp, Unknown
  misc_feature (1)..( 11): Result.006 file - promoters50/4915606
tcctatatata

SEQ ID NO: 195339 - DNA, 11 bp, Unknown
  misc_feature (1)..( 11): Result.006 file - promoters50/4915606
ttgtatatata

SEQ ID NO: 195340 - DNA, 11 bp, Unknown
  misc_feature (1)..( 11): Result.006 file - promoters50/4915606
tagtatttatt

SEQ ID NO: 195341 - DNA, 12 bp, Unknown
  misc_feature (1)..( 12): Result.006 file - promoters50/4915606
agaaagacaaat

SEQ ID NO: 195342 - DNA, 12 bp, Unknown
  misc_feature (1)..( 12): Result.006 file - promoters50/4915606
tgaaagagttta

SEQ ID NO: 195343 - DNA, 12 bp, Unknown
  misc_feature (1)..( 12): Result.006 file - promoters50/4915606
aaaaagtttatt

SEQ ID NO: 195344 - DNA, 12 bp, Unknown
  misc_feature (1)..( 12): Result.006 file - promoters50/4915606
gaaccgttaatt

SEQ ID NO: 195345 - DNA, 12 bp, Unknown
  misc_feature (1)..( 12): Result.006 file - promoters50/4915606
tcaaaatttatc

SEQ ID NO: 195346 - DNA, 12 bp, Unknown
  misc_feature (1)..( 12): Result.006 file - promoters50/4915606
atctaatatata

SEQ ID NO: 195347 - DNA, 12 bp, Unknown
  misc_feature (1)..( 12): Result.006 file - promoters50/4915606
tagttatatatg

SEQ ID NO: 195348 - DNA, 10 bp, Unknown
  misc_feature (1)..( 10): Result.006 file - promoters50/4915606
cgtgatttat

SEQ ID NO: 195349 - DNA, 10 bp, Unknown
  misc_feature (1)..( 10): Result.006 file - promoters50/4915606
caagatttac

SEQ ID NO: 195350 - DNA, 10 bp, Unknown
  misc_feature (1)..( 10): Result.006 file - promoters50/4915606
ttagagttac

SEQ ID NO: 195351 - DNA, 10 bp, Unknown
  misc_feature (1)..( 10): Result.006 file - promoters50/4915606
aaagatttta

SEQ ID NO: 195352 - DNA, 10 bp, Unknown
  misc_feature (1)..( 10): Result.006 file - promoters50/4915606
aaatattaat

SEQ ID NO: 195353 - DNA, 10 bp, Unknown
  misc_feature (1)..( 10): Result.006 file - promoters50/4915606
aaaaatttac

SEQ ID NO: 195354 - DNA, 9 bp, Unknown
  misc_feature (1)..( 9): Result.006 file - promoters50/4915606
aaattgatc

SEQ ID NO: 195355 - DNA, 9 bp, Unknown
  misc_feature (1)..( 9): Result.006 file - promoters50/4915606
aaatttatc

SEQ ID NO: 195356 - DNA, 9 bp, Unknown
  misc_feature (1)..( 9): Result.006 file - promoters50/4915606
aaattttga

SEQ ID NO: 195357 - DNA, 10 bp, Unknown
  misc_feature (1)..( 10): Result.006 file - promoters50/4915606
aaagtttatt

SEQ ID NO: 195358 - DNA, 10 bp, Unknown
  misc_feature (1)..( 10): Result.006 file - promoters50/4915606
ctaatatata

SEQ ID NO: 195359 - DNA, 10 bp, Unknown
  misc_feature (1)..( 10): Result.006 file - promoters50/4915606
gttatatatg

SEQ ID NO: 195360 - DNA, 9 bp, Unknown
  misc_feature (1)..( 9): Result.006 file - promoters50/4915606
taaattttg

SEQ ID NO: 195361 - DNA, 9 bp, Unknown
  misc_feature (1)..( 9): Result.006 file - promoters50/4915606
aaaagttta

SEQ ID NO: 195362 - DNA, 9 bp, Unknown
  misc_feature (1)..( 9): Result.006 file - promoters50/4915606
aaaatttat

SEQ ID NO: 195363 - DNA, 10 bp, Unknown
  misc_feature (1)..( 10): Result.006 file - promoters50/4915606
aaagagttta

SEQ ID NO: 195364 - DNA, 10 bp, Unknown
  misc_feature (1)..( 10): Result.006 file - promoters50/4915606
tctaatatat

SEQ ID NO: 195365 - DNA, 10 bp, Unknown
  misc_feature (1)..( 10): Result.006 file - promoters50/4915606
agttatatat

SEQ ID NO: 195366 - DNA, 11 bp, Unknown
  misc_feature (1)..( 11): Result.006 file - promoters50/4915606
tttttattttt

SEQ ID NO: 195367 - DNA, 11 bp, Unknown
  misc_feature (1)..( 11): Result.006 file - promoters50/4915606
ttcttatttat

SEQ ID NO: 195368 - DNA, 11 bp, Unknown
  misc_feature (1)..( 11): Result.006 file - promoters50/4915606
tgtttcttttt

SEQ ID NO: 195369 - DNA, 11 bp, Unknown
  misc_feature (1)..( 11): Result.006 file - promoters50/4915606
cgttaattttt

SEQ ID NO: 195370 - DNA, 11 bp, Unknown
  misc_feature (1)..( 11): Result.006 file - promoters50/4915606
aattaattttc

SEQ ID NO: 195371 - DNA, 11 bp, Unknown
  misc_feature (1)..( 11): Result.006 file - promoters50/4915668
aattcattata

SEQ ID NO: 195372 - DNA, 7 bp, Unknown
  misc_feature (1)..( 7): Result.006 file - promoters50/4915668
taccaat

SEQ ID NO: 195373 - DNA, 7 bp, Unknown
  misc_feature (1)..( 7): Result.006 file - promoters50/4915668
tacgaat

SEQ ID NO: 195374 - DNA, 7 bp, Unknown
  misc_feature (1)..( 7): Result.006 file - promoters50/4915668
taccaaa

SEQ ID NO: 195375 - DNA, 10 bp, Unknown
  misc_feature (1)..( 10): Result.006 file - promoters50/4915668
tgatgcgtta

SEQ ID NO: 195376 - DNA, 10 bp, Unknown
  misc_feature (1)..( 10): Result.006 file - promoters50/4915668
gaatgtgtta

SEQ ID NO: 195377 - DNA, 10 bp, Unknown
  misc_feature (1)..( 10): Result.006 file - promoters50/4915694
gaatttgttt

SEQ ID NO: 195378 - DNA, 12 bp, Unknown
  misc_feature (1)..( 12): Result.006 file - promoters50/4915694
gatttaaatcaa

SEQ ID NO: 195379 - DNA, 12 bp, Unknown
  misc_feature (1)..( 12): Result.006 file - promoters50/4915694
gattcaaaatcc

SEQ ID NO: 195380 - DNA, 12 bp, Unknown
  misc_feature (1)..( 12): Result.006 file - promoters50/4915694
gttttaaataat

SEQ ID NO: 195381 - DNA, 12 bp, Unknown
  misc_feature (1)..( 12): Result.006 file - promoters50/4915694
cattcaaatttt

SEQ ID NO: 195382 - DNA, 12 bp, Unknown
  misc_feature (1)..( 12): Result.006 file - promoters50/4915694
tttgcaaatttt

SEQ ID NO: 195383 - DNA, 9 bp, Unknown
  misc_feature (1)..( 9): Result.006 file - promoters50/4915694
atttacaat

SEQ ID NO: 195384 - DNA, 9 bp, Unknown
  misc_feature (1)..( 9): Result.006 file - promoters50/4915694
tttttcaaa

SEQ ID NO: 195385 - DNA, 9 bp, Unknown
  misc_feature (1)..( 9): Result.006 file - promoters50/4915694
attttcaaa

SEQ ID NO: 195386 - DNA, 9 bp, Unknown
  misc_feature (1)..( 9): Result.006 file - promoters50/4915694
tagttcaaa

SEQ ID NO: 195387 - DNA, 9 bp, Unknown
  misc_feature (1)..( 9): Result.006 file - promoters50/4915694
ttttgcaaa

SEQ ID NO: 195388 - DNA, 9 bp, Unknown
  misc_feature (1)..( 9): Result.006 file - promoters50/4915694
ctacaaaat

SEQ ID NO: 195389 - DNA, 9 bp, Unknown
  misc_feature (1)..( 9): Result.006 file - promoters50/4915694
ctacaagaa

SEQ ID NO: 195390 - DNA, 9 bp, Unknown
  misc_feature (1)..( 9): Result.006 file - promoters50/4915694
ttacaaaaa

SEQ ID NO: 195391 - DNA, 9 bp, Unknown
  misc_feature (1)..( 9): Result.006 file - promoters50/4915694
ttacaaaat

SEQ ID NO: 195392 - DNA, 14 bp, Unknown
  misc_feature (1)..( 14): Result.006 file - promoters50/4915694
actatttaacgttt

SEQ ID NO: 195393 - DNA, 14 bp, Unknown
  misc_feature (1)..( 14): Result.006 file - promoters50/4915694
aatatttatgtaag

SEQ ID NO: 195394 - DNA, 14 bp, Unknown
  misc_feature (1)..( 14): Result.006 file - promoters50/4915694
aatattttttgttt

SEQ ID NO: 195395 - DNA, 15 bp, Unknown
  misc_feature (1)..( 15): Result.006 file - promoters50/4915694
cttatcttttttttg

SEQ ID NO: 195396 - DNA, 13 bp, Unknown
  misc_feature (1)..( 13): Result.006 file - promoters50/4915694
ttaatcaataaat

SEQ ID NO: 195397 - DNA, 13 bp, Unknown
  misc_feature (1)..( 13): Result.006 file - promoters50/4915694
gtagtcaatattt

SEQ ID NO: 195398 - DNA, 13 bp, Unknown
  misc_feature (1)..( 13): Result.006 file - promoters50/4915694
ttaatcaatttat

SEQ ID NO: 195399 - DNA, 13 bp, Unknown
  misc_feature (1)..( 13): Result.006 file - promoters50/4915694
atcctcaatctat

SEQ ID NO: 195400 - DNA, 9 bp, Unknown
  misc_feature (1)..( 9): Result.006 file - promoters50/4915694
ctaatttcg

SEQ ID NO: 195401 - DNA, 9 bp, Unknown
  misc_feature (1)..( 9): Result.006 file - promoters50/4915694
ctaaattcc

SEQ ID NO: 195402 - DNA, 9 bp, Unknown
  misc_feature (1)..( 9): Result.006 file - promoters50/4915694
ataatttta

SEQ ID NO: 195403 - DNA, 10 bp, Unknown
  misc_feature (1)..( 10): Result.006 file - promoters50/4915694
ggaatattaa

SEQ ID NO: 195404 - DNA, 9 bp, Unknown
  misc_feature (1)..( 9): Result.006 file - promoters50/4915694
aaaatttta

SEQ ID NO: 195405 - DNA, 9 bp, Unknown
  misc_feature (1)..( 9): Result.006 file - promoters50/4915694
caaattttg

SEQ ID NO: 195406 - DNA, 9 bp, Unknown
  misc_feature (1)..( 9): Result.006 file - promoters50/4915694
caacttttt

SEQ ID NO: 195407 - DNA, 9 bp, Unknown
  misc_feature (1)..( 9): Result.006 file - promoters50/4915694
gttattttg

SEQ ID NO: 195408 - DNA, 11 bp, Unknown
  misc_feature (1)..( 11): Result.006 file - promoters50/4915694
attttaatgat

SEQ ID NO: 195409 - DNA, 11 bp, Unknown
  misc_feature (1)..( 11): Result.006 file - promoters50/4915694
ttttgaataaa

SEQ ID NO: 195410 - DNA, 12 bp, Unknown
  misc_feature (1)..( 12): Result.006 file - promoters50/4915694
cttgtgatttca

SEQ ID NO: 195411 - DNA, 12 bp, Unknown
  misc_feature (1)..( 12): Result.006 file - promoters50/4915701
attttgaagaaa

SEQ ID NO: 195412 - DNA, 10 bp, Unknown
  misc_feature (1)..( 10): Result.006 file - promoters50/4915701
tgtaatcggg

SEQ ID NO: 195413 - DNA, 10 bp, Unknown
  misc_feature (1)..( 10): Result.006 file - promoters50/4915701
tgtgatcgaa

SEQ ID NO: 195414 - DNA, 10 bp, Unknown
  misc_feature (1)..( 10): Result.006 file - promoters50/4915701
ctaaattggg

SEQ ID NO: 195415 - DNA, 9 bp, Unknown
  misc_feature (1)..( 9): Result.006 file - promoters50/4915701
tcgttgtaa

SEQ ID NO: 195416 - DNA, 9 bp, Unknown
  misc_feature (1)..( 9): Result.006 file - promoters50/4915701
tcggtgttg

SEQ ID NO: 195417 - DNA, 9 bp, Unknown
  misc_feature (1)..( 9): Result.006 file - promoters50/4915709
tgggttttg

SEQ ID NO: 195418 - DNA, 8 bp, Unknown
  misc_feature (1)..( 8): Result.006 file - promoters50/4915709
tttgattt

SEQ ID NO: 195419 - DNA, 8 bp, Unknown
  misc_feature (1)..( 8): Result.006 file - promoters50/4915709
attgcttt

SEQ ID NO: 195420 - DNA, 8 bp, Unknown
  misc_feature (1)..( 8): Result.006 file - promoters50/4915724
attgcttc

SEQ ID NO: 195421 - DNA, 13 bp, Unknown
  misc_feature (1)..( 13): Result.006 file - promoters50/4915724
aatcaaggagaat

SEQ ID NO: 195422 - DNA, 13 bp, Unknown
  misc_feature (1)..( 13): Result.006 file - promoters50/4915724
aataaagaagaat

SEQ ID NO: 195423 - DNA, 13 bp, Unknown
  misc_feature (1)..( 13): Result.006 file - promoters50/4915724
aatcaaaattatt

SEQ ID NO: 195424 - DNA, 13 bp, Unknown
  misc_feature (1)..( 13): Result.006 file - promoters50/4915724
gatacagaaagga

SEQ ID NO: 195425 - DNA, 10 bp, Unknown
  misc_feature (1)..( 10): Result.006 file - promoters50/4915724
ttaaaaaaag

SEQ ID NO: 195426 - DNA, 10 bp, Unknown
  misc_feature (1)..( 10): Result.006 file - promoters50/4915724
ctaaaaacag

SEQ ID NO: 195427 - DNA, 10 bp, Unknown
  misc_feature (1)..( 10): Result.006 file - promoters50/4915724
ataaaaaaag

SEQ ID NO: 195428 - DNA, 10 bp, Unknown
  misc_feature (1)..( 10): Result.006 file - promoters50/4915724
ataaaacaaa

SEQ ID NO: 195429 - DNA, 14 bp, Unknown
  misc_feature (1)..( 14): Result.006 file - promoters50/4915724
actaatataatgtt

SEQ ID NO: 195430 - DNA, 14 bp, Unknown
  misc_feature (1)..( 14): Result.006 file - promoters50/4915724
actaaaatacaacc

SEQ ID NO: 195431 - DNA, 14 bp, Unknown
  misc_feature (1)..( 14): Result.006 file - promoters50/4915724
aataatattttccc

SEQ ID NO: 195432 - DNA, 14 bp, Unknown
  misc_feature (1)..( 14): Result.006 file - promoters50/4915745
attgaaatccaacc

SEQ ID NO: 195433 - DNA, 9 bp, Unknown
  misc_feature (1)..( 9): Result.006 file - promoters50/4915745
atatctttt

SEQ ID NO: 195434 - DNA, 9 bp, Unknown
  misc_feature (1)..( 9): Result.006 file - promoters50/4915745
atatttttt

SEQ ID NO: 195435 - DNA, 9 bp, Unknown
  misc_feature (1)..( 9): Result.006 file - promoters50/4915745
aagtttttg

SEQ ID NO: 195436 - DNA, 9 bp, Unknown
  misc_feature (1)..( 9): Result.006 file - promoters50/4915745
acattttta

SEQ ID NO: 195437 - DNA, 8 bp, Unknown
  misc_feature (1)..( 8): Result.006 file - promoters50/4915745
aattgatc

SEQ ID NO: 195438 - DNA, 8 bp, Unknown
  misc_feature (1)..( 8): Result.006 file - promoters50/4915745
aattgatt

SEQ ID NO: 195439 - DNA, 8 bp, Unknown
  misc_feature (1)..( 8): Result.006 file - promoters50/4915745
gattcatt

SEQ ID NO: 195440 - DNA, 8 bp, Unknown
  misc_feature (1)..( 8): Result.006 file - promoters50/4915745
ttttacta

SEQ ID NO: 195441 - DNA, 8 bp, Unknown
  misc_feature (1)..( 8): Result.006 file - promoters50/4915745
ttttacta

SEQ ID NO: 195442 - DNA, 8 bp, Unknown
  misc_feature (1)..( 8): Result.006 file - promoters50/4915774
cattacta

SEQ ID NO: 195443 - DNA, 7 bp, Unknown
  misc_feature (1)..( 7): Result.006 file - promoters50/4915774
ctatatt

SEQ ID NO: 195444 - DNA, 7 bp, Unknown
  misc_feature (1)..( 7): Result.006 file - promoters50/4915774
atatatt

SEQ ID NO: 195445 - DNA, 7 bp, Unknown
  misc_feature (1)..( 7): Result.006 file - promoters50/4915774
ctatata

SEQ ID NO: 195446 - DNA, 8 bp, Unknown
  misc_feature (1)..( 8): Result.006 file - promoters50/4915774
caattaag

SEQ ID NO: 195447 - DNA, 8 bp, Unknown
  misc_feature (1)..( 8): Result.006 file - promoters50/4915774
taataaag

SEQ ID NO: 195448 - DNA, 8 bp, Unknown
  misc_feature (1)..( 8): Result.006 file - promoters50/4915774
taataata

SEQ ID NO: 195449 - DNA, 9 bp, Unknown
  misc_feature (1)..( 9): Result.006 file - promoters50/4915774
tcttcgagt

SEQ ID NO: 195450 - DNA, 9 bp, Unknown
  misc_feature (1)..( 9): Result.006 file - promoters50/4915774
ccttggagt

SEQ ID NO: 195451 - DNA, 9 bp, Unknown
  misc_feature (1)..( 9): Result.006 file - promoters50/4915774
ccttggctt

SEQ ID NO: 195452 - DNA, 8 bp, Unknown
  misc_feature (1)..( 8): Result.006 file - promoters50/4915774
ctctatca

SEQ ID NO: 195453 - DNA, 8 bp, Unknown
  misc_feature (1)..( 8): Result.006 file - promoters50/4915774
ctctttca

SEQ ID NO: 195454 - DNA, 8 bp, Unknown
  misc_feature (1)..( 8): Result.006 file - promoters50/4915804
ggctttca

SEQ ID NO: 195455 - DNA, 11 bp, Unknown
  misc_feature (1)..( 11): Result.006 file - promoters50/4915804
atttactaggt

SEQ ID NO: 195456 - DNA, 11 bp, Unknown
  misc_feature (1)..( 11): Result.006 file - promoters50/4915804
attgactattg

SEQ ID NO: 195457 - DNA, 11 bp, Unknown
  misc_feature (1)..( 11): Result.006 file - promoters50/4915804
tctgaatattg

SEQ ID NO: 195458 - DNA, 7 bp, Unknown
  misc_feature (1)..( 7): Result.006 file - promoters50/4915804
ttacaaa

SEQ ID NO: 195459 - DNA, 7 bp, Unknown
  misc_feature (1)..( 7): Result.006 file - promoters50/4915804
ttataaa

SEQ ID NO: 195460 - DNA, 7 bp, Unknown
  misc_feature (1)..( 7): Result.006 file - promoters50/4915804
atataaa

SEQ ID NO: 195461 - DNA, 8 bp, Unknown
  misc_feature (1)..( 8): Result.006 file - promoters50/4915804
ttatctta

SEQ ID NO: 195462 - DNA, 8 bp, Unknown
  misc_feature (1)..( 8): Result.006 file - promoters50/4915804
atatcttt

SEQ ID NO: 195463 - DNA, 8 bp, Unknown
  misc_feature (1)..( 8): Result.006 file - promoters50/4915816
atatgttt

SEQ ID NO: 195464 - DNA, 14 bp, Unknown
  misc_feature (1)..( 14): Result.006 file - promoters50/4915816
cgaatttgtttgag

SEQ ID NO: 195465 - DNA, 14 bp, Unknown
  misc_feature (1)..( 14): Result.006 file - promoters50/4915816
tatatttctttaaa

SEQ ID NO: 195466 - DNA, 14 bp, Unknown
  misc_feature (1)..( 14): Result.006 file - promoters50/4915816
gatgtttctttgtc

SEQ ID NO: 195467 - DNA, 14 bp, Unknown
  misc_feature (1)..( 14): Result.006 file - promoters50/4915816
gaaattgaaagaga

SEQ ID NO: 195468 - DNA, 14 bp, Unknown
  misc_feature (1)..( 14): Result.006 file - promoters50/4915816
agtttttattttta

SEQ ID NO: 195469 - DNA, 14 bp, Unknown
  misc_feature (1)..( 14): Result.006 file - promoters50/4915819
atcaaatcttcaaa

SEQ ID NO: 195470 - DNA, 10 bp, Unknown
  misc_feature (1)..( 10): Result.006 file - promoters50/4915819
aaatttaaga

SEQ ID NO: 195471 - DNA, 10 bp, Unknown
  misc_feature (1)..( 10): Result.006 file - promoters50/4915819
gaatctaatt

SEQ ID NO: 195472 - DNA, 10 bp, Unknown
  misc_feature (1)..( 10): Result.006 file - promoters50/4915819
aaattcaagt

SEQ ID NO: 195473 - DNA, 11 bp, Unknown
  misc_feature (1)..( 11): Result.006 file - promoters50/4915819
ttgctttcaga

SEQ ID NO: 195474 - DNA, 10 bp, Unknown
  misc_feature (1)..( 10): Result.006 file - promoters50/4915819
atattcaacg

SEQ ID NO: 195475 - DNA, 11 bp, Unknown
  misc_feature (1)..( 11): Result.006 file - promoters50/4921122
ttatactcatg

SEQ ID NO: 195476 - DNA, 15 bp, Unknown
  misc_feature (1)..( 15): Result.006 file - promoters50/4921122
gtgttataatttttt

SEQ ID NO: 195477 - DNA, 15 bp, Unknown
  misc_feature (1)..( 15): Result.006 file - promoters50/4921122
gggttacaatttttt

SEQ ID NO: 195478 - DNA, 15 bp, Unknown
  misc_feature (1)..( 15): Result.006 file - promoters50/4921122
tcgttatgatttctt

SEQ ID NO: 195479 - DNA, 15 bp, Unknown
  misc_feature (1)..( 15): Result.006 file - promoters50/4921122
ctcttactattgaag

SEQ ID NO: 195480 - DNA, 15 bp, Unknown
  misc_feature (1)..( 15): Result.006 file - promoters50/4921373
tcgctattccaccat

SEQ ID NO: 195481 - DNA, 7 bp, Unknown
  misc_feature (1)..( 7): Result.006 file - promoters50/4921373
gattata

SEQ ID NO: 195482 - DNA, 7 bp, Unknown
  misc_feature (1)..( 7): Result.006 file - promoters50/4921373
aattata

SEQ ID NO: 195483 - DNA, 7 bp, Unknown
  misc_feature (1)..( 7): Result.006 file - promoters50/4921373
gattata

SEQ ID NO: 195484 - DNA, 7 bp, Unknown
  misc_feature (1)..( 7): Result.006 file - promoters50/4921373
aataata

SEQ ID NO: 195485 - DNA, 10 bp, Unknown
  misc_feature (1)..( 10): Result.006 file - promoters50/4921373
aaagattata

SEQ ID NO: 195486 - DNA, 10 bp, Unknown
  misc_feature (1)..( 10): Result.006 file - promoters50/4921373
aaagcttaga

SEQ ID NO: 195487 - DNA, 10 bp, Unknown
  misc_feature (1)..( 10): Result.006 file - promoters50/4921373
tttgattata

SEQ ID NO: 195488 - DNA, 10 bp, Unknown
  misc_feature (1)..( 10): Result.006 file - promoters50/4921373
caagatttgt

SEQ ID NO: 195489 - DNA, 11 bp, Unknown
  misc_feature (1)..( 11): Result.006 file - promoters50/4921373
aagttaatttc

SEQ ID NO: 195490 - DNA, 11 bp, Unknown
  misc_feature (1)..( 11): Result.006 file - promoters50/4921373
gagttgattat

SEQ ID NO: 195491 - DNA, 11 bp, Unknown
  misc_feature (1)..( 11): Result.006 file - promoters50/4921373
gagttgtgtgg

SEQ ID NO: 195492 - DNA, 11 bp, Unknown
  misc_feature (1)..( 11): Result.006 file - promoters50/4921433
acagtgatttg

SEQ ID NO: 195493 - DNA, 12 bp, Unknown
  misc_feature (1)..( 12): Result.006 file - promoters50/4921433
tttgatttgagt

SEQ ID NO: 195494 - DNA, 12 bp, Unknown
  misc_feature (1)..( 12): Result.006 file - promoters50/4921433
aatgatgtgatg

SEQ ID NO: 195495 - DNA, 12 bp, Unknown
  misc_feature (1)..( 12): Result.006 file - promoters50/4921433
tttgttttgtag

SEQ ID NO: 195496 - DNA, 12 bp, Unknown
  misc_feature (1)..( 12): Result.006 file - promoters50/4921433
aaaagtttgagc

SEQ ID NO: 195497 - DNA, 12 bp, Unknown
  misc_feature (1)..( 12): Result.006 file - promoters50/4921433
tttgtttttttt

SEQ ID NO: 195498 - DNA, 12 bp, Unknown
  misc_feature (1)..( 12): Result.006 file - promoters50/4921433
taagatttagta

SEQ ID NO: 195499 - DNA, 16 bp, Unknown
  misc_feature (1)..( 16): Result.006 file - promoters50/4921433
cgagaattttgggaat

SEQ ID NO: 195500 - DNA, 16 bp, Unknown
  misc_feature (1)..( 16): Result.006 file - promoters50/4921433
gatgaatttaaagctt

SEQ ID NO: 195501 - DNA, 16 bp, Unknown
  misc_feature (1)..( 16): Result.006 file - promoters50/4921433
aaacaattttgctaca

SEQ ID NO: 195502 - DNA, 16 bp, Unknown
  misc_feature (1)..( 16): Result.006 file - promoters50/4921433
gataaattacggccat

SEQ ID NO: 195503 - DNA, 16 bp, Unknown
  misc_feature (1)..( 16): Result.006 file - promoters50/4921433
taaaaattgaaacttt

SEQ ID NO: 195504 - DNA, 16 bp, Unknown
  misc_feature (1)..( 16): Result.006 file - promoters50/4921447
tccatattaaaaatga

SEQ ID NO: 195505 - DNA, 14 bp, Unknown
  misc_feature (1)..( 14): Result.006 file - promoters50/4921447
ttgagttaacagtt

SEQ ID NO: 195506 - DNA, 14 bp, Unknown
  misc_feature (1)..( 14): Result.006 file - promoters50/4921447
tttttttaacaaga

SEQ ID NO: 195507 - DNA, 14 bp, Unknown
  misc_feature (1)..( 14): Result.006 file - promoters50/4921447
tgaacctaacagat

SEQ ID NO: 195508 - DNA, 13 bp, Unknown
  misc_feature (1)..( 13): Result.006 file - promoters50/4921447
agtactaacaaga

SEQ ID NO: 195509 - DNA, 14 bp, Unknown
  misc_feature (1)..( 14): Result.006 file - promoters50/4921447
aagctttaaccccc

SEQ ID NO: 195510 - DNA, 14 bp, Unknown
  misc_feature (1)..( 14): Result.006 file - promoters50/4921447
tgtatttgacagac

SEQ ID NO: 195511 - DNA, 14 bp, Unknown
  misc_feature (1)..( 14): Result.006 file - promoters50/4921447
tcggttttaccacg

SEQ ID NO: 195512 - DNA, 14 bp, Unknown
  misc_feature (1)..( 14): Result.006 file - promoters50/4921447
aagttttaaggtga

SEQ ID NO: 195513 - DNA, 12 bp, Unknown
  misc_feature (1)..( 12): Result.006 file - promoters50/4921447
cttgaaaaagag

SEQ ID NO: 195514 - DNA, 12 bp, Unknown
  misc_feature (1)..( 12): Result.006 file - promoters50/4921447
ttggtgaaagag

SEQ ID NO: 195515 - DNA, 12 bp, Unknown
  misc_feature (1)..( 12): Result.006 file - promoters50/4921447
gtataaaaagaa

SEQ ID NO: 195516 - DNA, 12 bp, Unknown
  misc_feature (1)..( 12): Result.006 file - promoters50/4921447
ttgatgaatgag

SEQ ID NO: 195517 - DNA, 12 bp, Unknown
  misc_feature (1)..( 12): Result.006 file - promoters50/4921447
acgatgaaatcg

SEQ ID NO: 195518 - DNA, 12 bp, Unknown
  misc_feature (1)..( 12): Result.006 file - promoters50/4921447
tatatcaaaatt

SEQ ID NO: 195519 - DNA, 12 bp, Unknown
  misc_feature (1)..( 12): Result.006 file - promoters50/4921447
tcgatgatactt

SEQ ID NO: 195520 - DNA, 14 bp, Unknown
  misc_feature (1)..( 14): Result.006 file - promoters50/4921447
gaaagatgaacatg

SEQ ID NO: 195521 - DNA, 14 bp, Unknown
  misc_feature (1)..( 14): Result.006 file - promoters50/4921447
tgttgatgaatgag

SEQ ID NO: 195522 - DNA, 14 bp, Unknown
  misc_feature (1)..( 14): Result.006 file - promoters50/4921447
tgacgatgaaatcg

SEQ ID NO: 195523 - DNA, 14 bp, Unknown
  misc_feature (1)..( 14): Result.006 file - promoters50/4921447
ttttggtgaaagag

SEQ ID NO: 195524 - DNA, 14 bp, Unknown
  misc_feature (1)..( 14): Result.006 file - promoters50/4921447
ttttggtcttaatc

SEQ ID NO: 195525 - DNA, 14 bp, Unknown
  misc_feature (1)..( 14): Result.006 file - promoters50/4921447
aatcgatgatactt

SEQ ID NO: 195526 - DNA, 9 bp, Unknown
  misc_feature (1)..( 9): Result.006 file - promoters50/4921447
agattaaag

SEQ ID NO: 195527 - DNA, 9 bp, Unknown
  misc_feature (1)..( 9): Result.006 file - promoters50/4921447
tgattaacg

SEQ ID NO: 195528 - DNA, 9 bp, Unknown
  misc_feature (1)..( 9): Result.006 file - promoters50/4921447
atattaaag

SEQ ID NO: 195529 - DNA, 9 bp, Unknown
  misc_feature (1)..( 9): Result.006 file - promoters50/4921447
aaattaaac

SEQ ID NO: 195530 - DNA, 9 bp, Unknown
  misc_feature (1)..( 9): Result.006 file - promoters50/4921447
atatcaaaa

SEQ ID NO: 195531 - DNA, 9 bp, Unknown
  misc_feature (1)..( 9): Result.006 file - promoters50/4922491
gtataaaaa

SEQ ID NO: 195532 - DNA, 10 bp, Unknown
  misc_feature (1)..( 10): Result.006 file - promoters50/4922491
aacatcatct

SEQ ID NO: 195533 - DNA, 10 bp, Unknown
  misc_feature (1)..( 10): Result.006 file - promoters50/4922491
aaaatcttct

SEQ ID NO: 195534 - DNA, 10 bp, Unknown
  misc_feature (1)..( 10): Result.006 file - promoters50/4934904
aaagtcttta

SEQ ID NO: 195535 - DNA, 13 bp, Unknown
  misc_feature (1)..( 13): Result.006 file - promoters50/4934904
tctgggaaatcgg

SEQ ID NO: 195536 - DNA, 13 bp, Unknown
  misc_feature (1)..( 13): Result.006 file - promoters50/4934904
tctggggaatcgg

SEQ ID NO: 195537 - DNA, 13 bp, Unknown
  misc_feature (1)..( 13): Result.006 file - promoters50/4934904
atgcggaaattaa

SEQ ID NO: 195538 - DNA, 6 bp, Unknown
  misc_feature (1)..( 6): Result.006 file - promoters50/4934904
tttcaa

SEQ ID NO: 195539 - DNA, 6 bp, Unknown
  misc_feature (1)..( 6): Result.006 file - promoters50/4934904
tttcaa

SEQ ID NO: 195540 - DNA, 6 bp, Unknown
  misc_feature (1)..( 6): Result.006 file - promoters50/4934904
tttcaa

SEQ ID NO: 195541 - DNA, 8 bp, Unknown
  misc_feature (1)..( 8): Result.006 file - promoters50/4934904
gtatctca

SEQ ID NO: 195542 - DNA, 8 bp, Unknown
  misc_feature (1)..( 8): Result.006 file - promoters50/4934904
acatctca

SEQ ID NO: 195543 - DNA, 8 bp, Unknown
  misc_feature (1)..( 8): Result.006 file - promoters50/4934904
acagctct

SEQ ID NO: 195544 - DNA, 7 bp, Unknown
  misc_feature (1)..( 7): Result.006 file - promoters50/4934904
ttctctg

SEQ ID NO: 195545 - DNA, 7 bp, Unknown
  misc_feature (1)..( 7): Result.006 file - promoters50/4934904
ttctctc

SEQ ID NO: 195546 - DNA, 7 bp, Unknown
  misc_feature (1)..( 7): Result.006 file - promoters50/4934904
ctctctc

SEQ ID NO: 195547 - DNA, 8 bp, Unknown
  misc_feature (1)..( 8): Result.006 file - promoters50/4934904
cagctctc

SEQ ID NO: 195548 - DNA, 8 bp, Unknown
  misc_feature (1)..( 8): Result.006 file - promoters50/4934904
gagctctc

SEQ ID NO: 195549 - DNA, 8 bp, Unknown
  misc_feature (1)..( 8): Result.006 file - promoters50/4938731
gagctccg

SEQ ID NO: 195550 - DNA, 18 bp, Unknown
  misc_feature (1)..( 18): Result.006 file - promoters50/4938731
aaacaaaaaaaatagaca

SEQ ID NO: 195551 - DNA, 18 bp, Unknown
  misc_feature (1)..( 18): Result.006 file - promoters50/4938731
ttgatgatcaaatagcat

SEQ ID NO: 195552 - DNA, 18 bp, Unknown
  misc_feature (1)..( 18): Result.006 file - promoters50/4938731
tataaccaaaaataatag

SEQ ID NO: 195553 - DNA, 18 bp, Unknown
  misc_feature (1)..( 18): Result.006 file - promoters50/4938731
actttatgaaaacagacg

SEQ ID NO: 195554 - DNA, 18 bp, Unknown
  misc_feature (1)..( 18): Result.006 file - promoters50/4938731
tcttggaagcaatagctg

SEQ ID NO: 195555 - DNA, 18 bp, Unknown
  misc_feature (1)..( 18): Result.006 file - promoters50/4938731
tataacccaaaattgacc

SEQ ID NO: 195556 - DNA, 18 bp, Unknown
  misc_feature (1)..( 18): Result.006 file - promoters50/4938731
tgagtttcgaaataaatg

SEQ ID NO: 195557 - DNA, 11 bp, Unknown
  misc_feature (1)..( 11): Result.006 file - promoters50/4938731
taaattatgag

SEQ ID NO: 195558 - DNA, 11 bp, Unknown
  misc_feature (1)..( 11): Result.006 file - promoters50/4938731
taaattaacaa

SEQ ID NO: 195559 - DNA, 11 bp, Unknown
  misc_feature (1)..( 11): Result.006 file - promoters50/4938731
taaatttaaaa

SEQ ID NO: 195560 - DNA, 11 bp, Unknown
  misc_feature (1)..( 11): Result.006 file - promoters50/4938731
tgaattaccaa

SEQ ID NO: 195561 - DNA, 11 bp, Unknown
  misc_feature (1)..( 11): Result.006 file - promoters50/4938731
ctaattaacct

SEQ ID NO: 195562 - DNA, 11 bp, Unknown
  misc_feature (1)..( 11): Result.006 file - promoters50/4938731
taaatttatta

SEQ ID NO: 195563 - DNA, 16 bp, Unknown
  misc_feature (1)..( 16): Result.006 file - promoters50/4938731
acttattccattaaac

SEQ ID NO: 195564 - DNA, 16 bp, Unknown
  misc_feature (1)..( 16): Result.006 file - promoters50/4938731
ttttatttcattaaat

SEQ ID NO: 195565 - DNA, 16 bp, Unknown
  misc_feature (1)..( 16): Result.006 file - promoters50/4938731
gctcggtacatgaaag

SEQ ID NO: 195566 - DNA, 16 bp, Unknown
  misc_feature (1)..( 16): Result.006 file - promoters50/4938731
actgatttttcattaa

SEQ ID NO: 195567 - DNA, 16 bp, Unknown
  misc_feature (1)..( 16): Result.006 file - promoters50/4938731
atttactctgttaaac

SEQ ID NO: 195568 - DNA, 16 bp, Unknown
  misc_feature (1)..( 16): Result.006 file - promoters50/4943425
atgtttttgattcagg

SEQ ID NO: 195569 - DNA, 11 bp, Unknown
  misc_feature (1)..( 11): Result.006 file - promoters50/4943425
ggtttattcat

SEQ ID NO: 195570 - DNA, 11 bp, Unknown
  misc_feature (1)..( 11): Result.006 file - promoters50/4943425
agtttattatt

SEQ ID NO: 195571 - DNA, 11 bp, Unknown
  misc_feature (1)..( 11): Result.006 file - promoters50/4943425
ggtttattttt

SEQ ID NO: 195572 - DNA, 11 bp, Unknown
  misc_feature (1)..( 11): Result.006 file - promoters50/4943425
tttttgttcat

SEQ ID NO: 195573 - DNA, 11 bp, Unknown
  misc_feature (1)..( 11): Result.006 file - promoters50/4943425
attttatttta

SEQ ID NO: 195574 - DNA, 14 bp, Unknown
  misc_feature (1)..( 14): Result.006 file - promoters50/4943425
ttgtgtttttattt

SEQ ID NO: 195575 - DNA, 14 bp, Unknown
  misc_feature (1)..( 14): Result.006 file - promoters50/4943425
cgacaatttgattc

SEQ ID NO: 195576 - DNA, 14 bp, Unknown
  misc_feature (1)..( 14): Result.006 file - promoters50/4943425
ttttttttttatat

SEQ ID NO: 195577 - DNA, 14 bp, Unknown
  misc_feature (1)..( 14): Result.006 file - promoters50/4943425
tgatgttttaattt

SEQ ID NO: 195578 - DNA, 14 bp, Unknown
  misc_feature (1)..( 14): Result.006 file - promoters50/4943425
tgtagttttcattt

SEQ ID NO: 195579 - DNA, 16 bp, Unknown
  misc_feature (1)..( 16): Result.006 file - promoters50/4943425
attctattaagccatt

SEQ ID NO: 195580 - DNA, 16 bp, Unknown
  misc_feature (1)..( 16): Result.006 file - promoters50/4943425
attttataaagatcct

SEQ ID NO: 195581 - DNA, 16 bp, Unknown
  misc_feature (1)..( 16): Result.006 file - promoters50/4943425
gtagtataaatatcct

SEQ ID NO: 195582 - DNA, 16 bp, Unknown
  misc_feature (1)..( 16): Result.006 file - promoters50/4943425
tttgtataaaatccca

SEQ ID NO: 195583 - DNA, 16 bp, Unknown
  misc_feature (1)..( 16): Result.006 file - promoters50/4943637
acaacataaagcttga

SEQ ID NO: 195584 - DNA, 13 bp, Unknown
  misc_feature (1)..( 13): Result.006 file - promoters50/4943637
tttagtttgttct

SEQ ID NO: 195585 - DNA, 14 bp, Unknown
  misc_feature (1)..( 14): Result.006 file - promoters50/4943637
tattagtttggtct

SEQ ID NO: 195586 - DNA, 14 bp, Unknown
  misc_feature (1)..( 14): Result.006 file - promoters50/4943637
cagaggtttgtacc

SEQ ID NO: 195587 - DNA, 14 bp, Unknown
  misc_feature (1)..( 14): Result.006 file - promoters50/4943637
tatgagtataacaa

SEQ ID NO: 195588 - DNA, 8 bp, Unknown
  misc_feature (1)..( 8): Result.006 file - promoters50/4943637
tgagaaaa

SEQ ID NO: 195589 - DNA, 8 bp, Unknown
  misc_feature (1)..( 8): Result.006 file - promoters50/4943637
tgagaaag

SEQ ID NO: 195590 - DNA, 8 bp, Unknown
  misc_feature (1)..( 8): Result.006 file - promoters50/4943637
caagaaaa

SEQ ID NO: 195591 - DNA, 8 bp, Unknown
  misc_feature (1)..( 8): Result.006 file - promoters50/4974495
aaagaaag

SEQ ID NO: 195592 - DNA, 11 bp, Unknown
  misc_feature (1)..( 11): Result.006 file - promoters50/4974495
ttaagatttct

SEQ ID NO: 195593 - DNA, 11 bp, Unknown
  misc_feature (1)..( 11): Result.006 file - promoters50/4974495
ttaggatgcag

SEQ ID NO: 195594 - DNA, 11 bp, Unknown
  misc_feature (1)..( 11): Result.006 file - promoters50/4978201
cgaggaagcag

SEQ ID NO: 195595 - DNA, 13 bp, Unknown
  misc_feature (1)..( 13): Result.006 file - promoters50/4978201
tatgcttgcttaa

SEQ ID NO: 195596 - DNA, 13 bp, Unknown
  misc_feature (1)..( 13): Result.006 file - promoters50/4978201
gatgtttgattaa

SEQ ID NO: 195597 - DNA, 13 bp, Unknown
  misc_feature (1)..( 13): Result.006 file - promoters50/4978201
gtctcttgctgct

SEQ ID NO: 195598 - DNA, 13 bp, Unknown
  misc_feature (1)..( 13): Result.006 file - promoters50/4978201
actgcttgtatcc

SEQ ID NO: 195599 - DNA, 13 bp, Unknown
  misc_feature (1)..( 13): Result.006 file - promoters50/4978201
agagttggatagc

SEQ ID NO: 195600 - DNA, 13 bp, Unknown
  misc_feature (1)..( 13): Result.006 file - promoters50/4978201
acttcttagtacg

SEQ ID NO: 195601 - DNA, 16 bp, Unknown
  misc_feature (1)..( 16): Result.006 file - promoters50/4978201
aattcaaaaagcaaaa

SEQ ID NO: 195602 - DNA, 16 bp, Unknown
  misc_feature (1)..( 16): Result.006 file - promoters50/4978201
tgttcaaaaaaatatt

SEQ ID NO: 195603 - DNA, 16 bp, Unknown
  misc_feature (1)..( 16): Result.006 file - promoters50/4978201
aattccaaattttgaa

SEQ ID NO: 195604 - DNA, 16 bp, Unknown
  misc_feature (1)..( 16): Result.006 file - promoters50/4978201
aaaaaaaaaaggaaaa

SEQ ID NO: 195605 - DNA, 16 bp, Unknown
  misc_feature (1)..( 16): Result.006 file - promoters50/4978201
tattcaactatacata

SEQ ID NO: 195606 - DNA, 16 bp, Unknown
  misc_feature (1)..( 16): Result.006 file - promoters50/4992383
aaagccatatttgggc

SEQ ID NO: 195607 - DNA, 10 bp, Unknown
  misc_feature (1)..( 10): Result.006 file - promoters50/4992383
tttgtataaa

SEQ ID NO: 195608 - DNA, 10 bp, Unknown
  misc_feature (1)..( 10): Result.006 file - promoters50/4992383
ataatataaa

SEQ ID NO: 195609 - DNA, 10 bp, Unknown
  misc_feature (1)..( 10): Result.006 file - promoters50/4992383
tttgtttaag

SEQ ID NO: 195610 - DNA, 10 bp, Unknown
  misc_feature (1)..( 10): Result.006 file - promoters50/4992383
cacttttaga

SEQ ID NO: 195611 - DNA, 9 bp, Unknown
  misc_feature (1)..( 9): Result.006 file - promoters50/4992383
tttgctttg

SEQ ID NO: 195612 - DNA, 9 bp, Unknown
  misc_feature (1)..( 9): Result.006 file - promoters50/4992383
tttgatttg

SEQ ID NO: 195613 - DNA, 10 bp, Unknown
  misc_feature (1)..( 10): Result.006 file - promoters50/4992383
tttcgatgta

SEQ ID NO: 195614 - DNA, 10 bp, Unknown
  misc_feature (1)..( 10): Result.006 file - promoters50/4992383
ttttgatttg

SEQ ID NO: 195615 - DNA, 10 bp, Unknown
  misc_feature (1)..( 10): Result.006 file - promoters50/4992383
atttcattta

SEQ ID NO: 195616 - DNA, 12 bp, Unknown
  misc_feature (1)..( 12): Result.006 file - promoters50/4992383
tgttttgttttc

SEQ ID NO: 195617 - DNA, 12 bp, Unknown
  misc_feature (1)..( 12): Result.006 file - promoters50/4992383
tgttttctttta

SEQ ID NO: 195618 - DNA, 12 bp, Unknown
  misc_feature (1)..( 12): Result.006 file - promoters50/4992383
gcttttgatttg

SEQ ID NO: 195619 - DNA, 12 bp, Unknown
  misc_feature (1)..( 12): Result.006 file - promoters50/4992383
tatttcgatgta

SEQ ID NO: 195620 - DNA, 12 bp, Unknown
  misc_feature (1)..( 12): Result.006 file - promoters50/4992383
atatttcattta

SEQ ID NO: 195621 - DNA, 9 bp, Unknown
  misc_feature (1)..( 9): Result.006 file - promoters50/4992383
ttgtctatg

SEQ ID NO: 195622 - DNA, 9 bp, Unknown
  misc_feature (1)..( 9): Result.006 file - promoters50/4992383
gtttctatg

SEQ ID NO: 195623 - DNA, 9 bp, Unknown
  misc_feature (1)..( 9): Result.006 file - promoters50/4992383
atttttatt

SEQ ID NO: 195624 - DNA, 9 bp, Unknown
  misc_feature (1)..( 9): Result.006 file - promoters50/4992383
ttttctttt

SEQ ID NO: 195625 - DNA, 14 bp, Unknown
  misc_feature (1)..( 14): Result.006 file - promoters50/4992383
aacctttatgtact

SEQ ID NO: 195626 - DNA, 14 bp, Unknown
  misc_feature (1)..( 14): Result.006 file - promoters50/4992383
aacttttaagtaaa

SEQ ID NO: 195627 - DNA, 14 bp, Unknown
  misc_feature (1)..( 14): Result.006 file - promoters50/4992383
ttattttcagtaga

SEQ ID NO: 195628 - DNA, 14 bp, Unknown
  misc_feature (1)..( 14): Result.006 file - promoters50/4992383
accagaccagaaga

SEQ ID NO: 195629 - DNA, 12 bp, Unknown
  misc_feature (1)..( 12): Result.006 file - promoters50/4992383
ttttaactaaca

SEQ ID NO: 195630 - DNA, 12 bp, Unknown
  misc_feature (1)..( 12): Result.006 file - promoters50/4992383
aaccaactaaca

SEQ ID NO: 195631 - DNA, 12 bp, Unknown
  misc_feature (1)..( 12): Result.006 file - promoters50/4992383
ttttcactaatg

SEQ ID NO: 195632 - DNA, 12 bp, Unknown
  misc_feature (1)..( 12): Result.006 file - promoters50/4992383
ttttcaccatca

SEQ ID NO: 195633 - DNA, 13 bp, Unknown
  misc_feature (1)..( 13): Result.006 file - promoters50/4992383
atatttgtcctaa

SEQ ID NO: 195634 - DNA, 13 bp, Unknown
  misc_feature (1)..( 13): Result.006 file - promoters50/4992383
atatttagtttat

SEQ ID NO: 195635 - DNA, 13 bp, Unknown
  misc_feature (1)..( 13): Result.006 file - promoters50/4992383
ctatttttatttt

SEQ ID NO: 195636 - DNA, 13 bp, Unknown
  misc_feature (1)..( 13): Result.006 file - promoters50/4992383
tgtgttttctttt

SEQ ID NO: 195637 - DNA, 9 bp, Unknown
  misc_feature (1)..( 9): Result.006 file - promoters50/4992383
aatttattt

SEQ ID NO: 195638 - DNA, 9 bp, Unknown
  misc_feature (1)..( 9): Result.006 file - promoters50/4992383
agtttattc

SEQ ID NO: 195639 - DNA, 9 bp, Unknown
  misc_feature (1)..( 9): Result.006 file - promoters50/4992383
aatatattt

SEQ ID NO: 195640 - DNA, 9 bp, Unknown
  misc_feature (1)..( 9): Result.006 file - promoters50/4992383
tttttattt

SEQ ID NO: 195641 - DNA, 7 bp, Unknown
  misc_feature (1)..( 7): Result.006 file - promoters50/4992383
aatattt

SEQ ID NO: 195642 - DNA, 7 bp, Unknown
  misc_feature (1)..( 7): Result.006 file - promoters50/4992383
aatgttt

SEQ ID NO: 195643 - DNA, 7 bp, Unknown
  misc_feature (1)..( 7): Result.006 file - promoters50/4992383
aatgttt

SEQ ID NO: 195644 - DNA, 7 bp, Unknown
  misc_feature (1)..( 7): Result.006 file - promoters50/4992383
aatgttt

SEQ ID NO: 195645 - DNA, 13 bp, Unknown
  misc_feature (1)..( 13): Result.006 file - promoters50/4992383
aattatttctaat

SEQ ID NO: 195646 - DNA, 13 bp, Unknown
  misc_feature (1)..( 13): Result.006 file - promoters50/4992383
ttttatttttatc

SEQ ID NO: 195647 - DNA, 13 bp, Unknown
  misc_feature (1)..( 13): Result.006 file - promoters50/4992383
atatatttagttt

SEQ ID NO: 195648 - DNA, 13 bp, Unknown
  misc_feature (1)..( 13): Result.006 file - promoters50/4992452
ttttcttttaatt

SEQ ID NO: 195649 - DNA, 11 bp, Unknown
  misc_feature (1)..( 11): Result.006 file - promoters50/4992452
gattttaccag

SEQ ID NO: 195650 - DNA, 11 bp, Unknown
  misc_feature (1)..( 11): Result.006 file - promoters50/4992452
tattatactaa

SEQ ID NO: 195651 - DNA, 11 bp, Unknown
  misc_feature (1)..( 11): Result.006 file - promoters50/4992452
tataatatcac

SEQ ID NO: 195652 - DNA, 11 bp, Unknown
  misc_feature (1)..( 11): Result.006 file - promoters50/4992452
caatttactat

SEQ ID NO: 195653 - DNA, 10 bp, Unknown
  misc_feature (1)..( 10): Result.006 file - promoters50/4992452
tgttacatcc

SEQ ID NO: 195654 - DNA, 10 bp, Unknown
  misc_feature (1)..( 10): Result.006 file - promoters50/4992452
tgttacaaat

SEQ ID NO: 195655 - DNA, 10 bp, Unknown
  misc_feature (1)..( 10): Result.006 file - promoters50/4992452
gattaaaaat

SEQ ID NO: 195656 - DNA, 10 bp, Unknown
  misc_feature (1)..( 10): Result.006 file - promoters50/4992452
gattataaaa

SEQ ID NO: 195657 - DNA, 13 bp, Unknown
  misc_feature (1)..( 13): Result.006 file - promoters50/4992452
aaatttgttattt

SEQ ID NO: 195658 - DNA, 13 bp, Unknown
  misc_feature (1)..( 13): Result.006 file - promoters50/4992452
aaatctgtatttt

SEQ ID NO: 195659 - DNA, 13 bp, Unknown
  misc_feature (1)..( 13): Result.006 file - promoters50/4992452
aaatttgtaattt

SEQ ID NO: 195660 - DNA, 13 bp, Unknown
  misc_feature (1)..( 13): Result.006 file - promoters50/4992452
aaaactgaactaa

SEQ ID NO: 195661 - DNA, 9 bp, Unknown
  misc_feature (1)..( 9): Result.006 file - promoters50/4992452
taatattat

SEQ ID NO: 195662 - DNA, 9 bp, Unknown
  misc_feature (1)..( 9): Result.006 file - promoters50/4992452
taaaattaa

SEQ ID NO: 195663 - DNA, 9 bp, Unknown
  misc_feature (1)..( 9): Result.006 file - promoters50/4992452
taatcatac

SEQ ID NO: 195664 - DNA, 9 bp, Unknown
  misc_feature (1)..( 9): Result.006 file - promoters50/4992452
aaatattgt

SEQ ID NO: 195665 - DNA, 9 bp, Unknown
  misc_feature (1)..( 9): Result.006 file - promoters50/4992452
taaaattaa

SEQ ID NO: 195666 - DNA, 8 bp, Unknown
  misc_feature (1)..( 8): Result.006 file - promoters50/4992452
tattatta

SEQ ID NO: 195667 - DNA, 8 bp, Unknown
  misc_feature (1)..( 8): Result.006 file - promoters50/4992452
gattttta

SEQ ID NO: 195668 - DNA, 8 bp, Unknown
  misc_feature (1)..( 8): Result.006 file - promoters50/4992452
tattgtta

SEQ ID NO: 195669 - DNA, 8 bp, Unknown
  misc_feature (1)..( 8): Result.006 file - promoters50/4992452
ctttttta

SEQ ID NO: 195670 - DNA, 7 bp, Unknown
  misc_feature (1)..( 7): Result.006 file - promoters50/4992452
attgcat

SEQ ID NO: 195671 - DNA, 7 bp, Unknown
  misc_feature (1)..( 7): Result.006 file - promoters50/4992452
atttcat

SEQ ID NO: 195672 - DNA, 7 bp, Unknown
  misc_feature (1)..( 7): Result.006 file - promoters50/4992452
ttttcat

SEQ ID NO: 195673 - DNA, 7 bp, Unknown
  misc_feature (1)..( 7): Result.006 file - promoters50/5003710
atttcaa

SEQ ID NO: 195674 - DNA, 19 bp, Unknown
  misc_feature (1)..( 19): Result.006 file - promoters50/5003710
tatacaaaatatataatta

SEQ ID NO: 195675 - DNA, 19 bp, Unknown
  misc_feature (1)..( 19): Result.006 file - promoters50/5003710
tattcaaaacataaatcta

SEQ ID NO: 195676 - DNA, 19 bp, Unknown
  misc_feature (1)..( 19): Result.006 file - promoters50/5003710
tcctttaaacattaaattg

SEQ ID NO: 195677 - DNA, 19 bp, Unknown
  misc_feature (1)..( 19): Result.006 file - promoters50/5003710
tatatgaaatataaataaa

SEQ ID NO: 195678 - DNA, 19 bp, Unknown
  misc_feature (1)..( 19): Result.006 file - promoters50/5003710
tttacggtatataattcaa

SEQ ID NO: 195679 - DNA, 19 bp, Unknown
  misc_feature (1)..( 19): Result.006 file - promoters50/5003710
gatatataaacttaatcat

SEQ ID NO: 195680 - DNA, 19 bp, Unknown
  misc_feature (1)..( 19): Result.006 file - promoters50/5003710
cctgccaaaaattgagtta

SEQ ID NO: 195681 - DNA, 11 bp, Unknown
  misc_feature (1)..( 11): Result.006 file - promoters50/5003710
taaaatatggt

SEQ ID NO: 195682 - DNA, 11 bp, Unknown
  misc_feature (1)..( 11): Result.006 file - promoters50/5003710
caaattatcac

SEQ ID NO: 195683 - DNA, 11 bp, Unknown
  misc_feature (1)..( 11): Result.006 file - promoters50/5003710
aaaaatagata

SEQ ID NO: 195684 - DNA, 11 bp, Unknown
  misc_feature (1)..( 11): Result.006 file - promoters50/5003710
taaaagatgat

SEQ ID NO: 195685 - DNA, 11 bp, Unknown
  misc_feature (1)..( 11): Result.006 file - promoters50/5003710
agaaagataca

SEQ ID NO: 195686 - DNA, 11 bp, Unknown
  misc_feature (1)..( 11): Result.006 file - promoters50/5003710
gaaaatatctt

SEQ ID NO: 195687 - DNA, 11 bp, Unknown
  misc_feature (1)..( 11): Result.006 file - promoters50/5003710
taaagaataac

SEQ ID NO: 195688 - DNA, 11 bp, Unknown
  misc_feature (1)..( 11): Result.006 file - promoters50/5003710
aatcagacaca

SEQ ID NO: 195689 - DNA, 13 bp, Unknown
  misc_feature (1)..( 13): Result.006 file - promoters50/5003710
tatactaaataaa

SEQ ID NO: 195690 - DNA, 13 bp, Unknown
  misc_feature (1)..( 13): Result.006 file - promoters50/5003710
gatacaaaatcac

SEQ ID NO: 195691 - DNA, 13 bp, Unknown
  misc_feature (1)..( 13): Result.006 file - promoters50/5003710
aaaactaaagaaa

SEQ ID NO: 195692 - DNA, 13 bp, Unknown
  misc_feature (1)..( 13): Result.006 file - promoters50/5003710
catagaaaaaaac

SEQ ID NO: 195693 - DNA, 13 bp, Unknown
  misc_feature (1)..( 13): Result.006 file - promoters50/5003710
tagacaaaacaac

SEQ ID NO: 195694 - DNA, 13 bp, Unknown
  misc_feature (1)..( 13): Result.006 file - promoters50/5003710
gatgcaaacattt

SEQ ID NO: 195695 - DNA, 12 bp, Unknown
  misc_feature (1)..( 12): Result.006 file - promoters50/5003710
tgatttattaga

SEQ ID NO: 195696 - DNA, 12 bp, Unknown
  misc_feature (1)..( 12): Result.006 file - promoters50/5003710
aattttattttg

SEQ ID NO: 195697 - DNA, 12 bp, Unknown
  misc_feature (1)..( 12): Result.006 file - promoters50/5003710
tgatttattctc

SEQ ID NO: 195698 - DNA, 12 bp, Unknown
  misc_feature (1)..( 12): Result.006 file - promoters50/5003710
atttttcttctc

SEQ ID NO: 195699 - DNA, 10 bp, Unknown
  misc_feature (1)..( 10): Result.006 file - promoters50/5003710
tttcattgta

SEQ ID NO: 195700 - DNA, 13 bp, Unknown
  misc_feature (1)..( 13): Result.006 file - promoters50/5003830
taattttatggac

SEQ ID NO: 195701 - DNA, 9 bp, Unknown
  misc_feature (1)..( 9): Result.006 file - promoters50/5003830
aaaataata

SEQ ID NO: 195702 - DNA, 9 bp, Unknown
  misc_feature (1)..( 9): Result.006 file - promoters50/5003830
aaaagaata

SEQ ID NO: 195703 - DNA, 9 bp, Unknown
  misc_feature (1)..( 9): Result.006 file - promoters50/5003830
taaagaatc

SEQ ID NO: 195704 - DNA, 8 bp, Unknown
  misc_feature (1)..( 8): Result.006 file - promoters50/5003830
caattata

SEQ ID NO: 195705 - DNA, 8 bp, Unknown
  misc_feature (1)..( 8): Result.006 file - promoters50/5003830
gaataata

SEQ ID NO: 195706 - DNA, 8 bp, Unknown
  misc_feature (1)..( 8): Result.006 file - promoters50/5003830
caaatatc

SEQ ID NO: 195707 - DNA, 11 bp, Unknown
  misc_feature (1)..( 11): Result.006 file - promoters50/5003830
tttctcttttt

SEQ ID NO: 195708 - DNA, 11 bp, Unknown
  misc_feature (1)..( 11): Result.006 file - promoters50/5003830
tttcacttttt

SEQ ID NO: 195709 - DNA, 11 bp, Unknown
  misc_feature (1)..( 11): Result.006 file - promoters50/5003830
cttcactccca

SEQ ID NO: 195710 - DNA, 8 bp, Unknown
  misc_feature (1)..( 8): Result.006 file - promoters50/5003830
aagatttt

SEQ ID NO: 195711 - DNA, 8 bp, Unknown
  misc_feature (1)..( 8): Result.006 file - promoters50/5003830
gagaattt

SEQ ID NO: 195712 - DNA, 8 bp, Unknown
  misc_feature (1)..( 8): Result.006 file - promoters50/5662739
gagaatgg

SEQ ID NO: 195713 - DNA, 13 bp, Unknown
  misc_feature (1)..( 13): Result.006 file - promoters50/5662739
ttataaaacaatt

SEQ ID NO: 195714 - DNA, 13 bp, Unknown
  misc_feature (1)..( 13): Result.006 file - promoters50/5662739
agagaaaacaaaa

SEQ ID NO: 195715 - DNA, 13 bp, Unknown
  misc_feature (1)..( 13): Result.006 file - promoters50/5662739
aaaaaaaacattg

SEQ ID NO: 195716 - DNA, 13 bp, Unknown
  misc_feature (1)..( 13): Result.006 file - promoters50/5662739
tacaaaaagaaaa

SEQ ID NO: 195717 - DNA, 13 bp, Unknown
  misc_feature (1)..( 13): Result.006 file - promoters50/5662739
aaggaaaaaaggt

SEQ ID NO: 195718 - DNA, 13 bp, Unknown
  misc_feature (1)..( 13): Result.006 file - promoters50/5662739
acccaaaaaatct

SEQ ID NO: 195719 - DNA, 14 bp, Unknown
  misc_feature (1)..( 14): Result.006 file - promoters50/5662739
taaaaatttacact

SEQ ID NO: 195720 - DNA, 14 bp, Unknown
  misc_feature (1)..( 14): Result.006 file - promoters50/5662739
gaaagattgttagt

SEQ ID NO: 195721 - DNA, 14 bp, Unknown
  misc_feature (1)..( 14): Result.006 file - promoters50/5662739
cttaaattttttaa

SEQ ID NO: 195722 - DNA, 14 bp, Unknown
  misc_feature (1)..( 14): Result.006 file - promoters50/5662739
taaaaaaagatttt

SEQ ID NO: 195723 - DNA, 14 bp, Unknown
  misc_feature (1)..( 14): Result.006 file - promoters50/5662739
tatgtattttttag

SEQ ID NO: 195724 - DNA, 14 bp, Unknown
  misc_feature (1)..( 14): Result.006 file - promoters50/5662739
actttattttatag

SEQ ID NO: 195725 - DNA, 8 bp, Unknown
  misc_feature (1)..( 8): Result.006 file - promoters50/5662739
ttataaaa

SEQ ID NO: 195726 - DNA, 8 bp, Unknown
  misc_feature (1)..( 8): Result.006 file - promoters50/5662739
ttacaaaa

SEQ ID NO: 195727 - DNA, 8 bp, Unknown
  misc_feature (1)..( 8): Result.006 file - promoters50/5662739
ttagaaat

SEQ ID NO: 195728 - DNA, 8 bp, Unknown
  misc_feature (1)..( 8): Result.006 file - promoters50/5662739
ttataaga

SEQ ID NO: 195729 - DNA, 8 bp, Unknown
  misc_feature (1)..( 8): Result.006 file - promoters50/5662739
aaacaaaa

SEQ ID NO: 195730 - DNA, 8 bp, Unknown
  misc_feature (1)..( 8): Result.006 file - promoters50/5662739
ttacaaaa

SEQ ID NO: 195731 - DNA, 9 bp, Unknown
  misc_feature (1)..( 9): Result.006 file - promoters50/5662739
actttaaaa

SEQ ID NO: 195732 - DNA, 9 bp, Unknown
  misc_feature (1)..( 9): Result.006 file - promoters50/5662739
tttttaaag

SEQ ID NO: 195733 - DNA, 10 bp, Unknown
  misc_feature (1)..( 10): Result.006 file - promoters50/5662739
attttataat

SEQ ID NO: 195734 - DNA, 10 bp, Unknown
  misc_feature (1)..( 10): Result.006 file - promoters50/5662739
tctttttaat

SEQ ID NO: 195735 - DNA, 10 bp, Unknown
  misc_feature (1)..( 10): Result.006 file - promoters50/5662739
tagttataac

SEQ ID NO: 195736 - DNA, 10 bp, Unknown
  misc_feature (1)..( 10): Result.006 file - promoters50/5662739
attttatagg

SEQ ID NO: 195737 - DNA, 13 bp, Unknown
  misc_feature (1)..( 13): Result.006 file - promoters50/5662739
taaaaagagaaaa

SEQ ID NO: 195738 - DNA, 13 bp, Unknown
  misc_feature (1)..( 13): Result.006 file - promoters50/5662739
caaaaagaaaaaa

SEQ ID NO: 195739 - DNA, 13 bp, Unknown
  misc_feature (1)..( 13): Result.006 file - promoters50/5662739
gatagagagaagg

SEQ ID NO: 195740 - DNA, 13 bp, Unknown
  misc_feature (1)..( 13): Result.006 file - promoters50/5662739
taaaaattgggtt

SEQ ID NO: 195741 - DNA, 13 bp, Unknown
  misc_feature (1)..( 13): Result.006 file - promoters50/5662739
taagaagaaaaaa

SEQ ID NO: 195742 - DNA, 13 bp, Unknown
  misc_feature (1)..( 13): Result.006 file - promoters50/5662743
tttacccaaaaaa

SEQ ID NO: 195743 - DNA, 10 bp, Unknown
  misc_feature (1)..( 10): Result.006 file - promoters50/5662743
aataagttaa

SEQ ID NO: 195744 - DNA, 10 bp, Unknown
  misc_feature (1)..( 10): Result.006 file - promoters50/5662743
gataagttct

SEQ ID NO: 195745 - DNA, 10 bp, Unknown
  misc_feature (1)..( 10): Result.006 file - promoters50/5662743
cttaagttag

SEQ ID NO: 195746 - DNA, 10 bp, Unknown
  misc_feature (1)..( 10): Result.006 file - promoters50/5662743
attaatttct

SEQ ID NO: 195747 - DNA, 10 bp, Unknown
  misc_feature (1)..( 10): Result.006 file - promoters50/5662743
cttatgtttg

SEQ ID NO: 195748 - DNA, 10 bp, Unknown
  misc_feature (1)..( 10): Result.006 file - promoters50/5662743
attatgtggg

SEQ ID NO: 195749 - DNA, 13 bp, Unknown
  misc_feature (1)..( 13): Result.006 file - promoters50/5662743
atttgagttttta

SEQ ID NO: 195750 - DNA, 13 bp, Unknown
  misc_feature (1)..( 13): Result.006 file - promoters50/5662743
agattctttttta

SEQ ID NO: 195751 - DNA, 13 bp, Unknown
  misc_feature (1)..( 13): Result.006 file - promoters50/5662743
atttgaatttttg

SEQ ID NO: 195752 - DNA, 14 bp, Unknown
  misc_feature (1)..( 14): Result.006 file - promoters50/5662743
tatttgttttctta

SEQ ID NO: 195753 - DNA, 14 bp, Unknown
  misc_feature (1)..( 14): Result.006 file - promoters50/5662743
aattaatcttttta

SEQ ID NO: 195754 - DNA, 14 bp, Unknown
  misc_feature (1)..( 14): Result.006 file - promoters50/5662743
tctataatttgata

SEQ ID NO: 195755 - DNA, 10 bp, Unknown
  misc_feature (1)..( 10): Result.006 file - promoters50/5662743
tattatttag

SEQ ID NO: 195756 - DNA, 10 bp, Unknown
  misc_feature (1)..( 10): Result.006 file - promoters50/5662743
gattcttttt

SEQ ID NO: 195757 - DNA, 10 bp, Unknown
  misc_feature (1)..( 10): Result.006 file - promoters50/5662743
tattatctaa

SEQ ID NO: 195758 - DNA, 10 bp, Unknown
  misc_feature (1)..( 10): Result.006 file - promoters50/5662743
tattcttttc

SEQ ID NO: 195759 - DNA, 10 bp, Unknown
  misc_feature (1)..( 10): Result.006 file - promoters50/5662743
taatcttttt

SEQ ID NO: 195760 - DNA, 10 bp, Unknown
  misc_feature (1)..( 10): Result.006 file - promoters50/5662743
tatgcttgta

SEQ ID NO: 195761 - DNA, 13 bp, Unknown
  misc_feature (1)..( 13): Result.006 file - promoters50/5662743
gatttgagttttt

SEQ ID NO: 195762 - DNA, 13 bp, Unknown
  misc_feature (1)..( 13): Result.006 file - promoters50/5662743
aatttgatatgct

SEQ ID NO: 195763 - DNA, 13 bp, Unknown
  misc_feature (1)..( 13): Result.006 file - promoters50/5662743
catttgaattttt

SEQ ID NO: 195764 - DNA, 13 bp, Unknown
  misc_feature (1)..( 13): Result.006 file - promoters50/5662743
gattagattcttt

SEQ ID NO: 195765 - DNA, 13 bp, Unknown
  misc_feature (1)..( 13): Result.006 file - promoters50/5662743
tttttgggtattt

SEQ ID NO: 195766 - DNA, 13 bp, Unknown
  misc_feature (1)..( 13): Result.006 file - promoters50/5662743
aaattgaatgtgt

SEQ ID NO: 195767 - DNA, 14 bp, Unknown
  misc_feature (1)..( 14): Result.006 file - promoters50/5662743
tttatttgttaaac

SEQ ID NO: 195768 - DNA, 14 bp, Unknown
  misc_feature (1)..( 14): Result.006 file - promoters50/5662743
tttttttggtggac

SEQ ID NO: 195769 - DNA, 14 bp, Unknown
  misc_feature (1)..( 14): Result.006 file - promoters50/5662743
actatttgataaaa

SEQ ID NO: 195770 - DNA, 14 bp, Unknown
  misc_feature (1)..( 14): Result.006 file - promoters50/5662743
attttctggttttt

SEQ ID NO: 195771 - DNA, 14 bp, Unknown
  misc_feature (1)..( 14): Result.006 file - promoters50/5662743
cttttctcaagcat

SEQ ID NO: 195772 - DNA, 14 bp, Unknown
  misc_feature (1)..( 14): Result.006 file - promoters50/5662743
taaatatgataaaa

SEQ ID NO: 195773 - DNA, 10 bp, Unknown
  misc_feature (1)..( 10): Result.006 file - promoters50/5662743
ccaagattta

SEQ ID NO: 195774 - DNA, 10 bp, Unknown
  misc_feature (1)..( 10): Result.006 file - promoters50/5662743
aacagatttc

SEQ ID NO: 195775 - DNA, 10 bp, Unknown
  misc_feature (1)..( 10): Result.006 file - promoters50/5662743
acaaaatttt

SEQ ID NO: 195776 - DNA, 10 bp, Unknown
  misc_feature (1)..( 10): Result.006 file - promoters50/5662743
tgaagattta

SEQ ID NO: 195777 - DNA, 10 bp, Unknown
  misc_feature (1)..( 10): Result.006 file - promoters50/5662743
ctatgatttc

SEQ ID NO: 195778 - DNA, 10 bp, Unknown
  misc_feature (1)..( 10): Result.006 file - promoters50/5662749
acacaatttt

SEQ ID NO: 195779 - DNA, 10 bp, Unknown
  misc_feature (1)..( 10): Result.006 file - promoters50/5662749
gaaaatgatc

SEQ ID NO: 195780 - DNA, 10 bp, Unknown
  misc_feature (1)..( 10): Result.006 file - promoters50/5662749
taaaatgcga

SEQ ID NO: 195781 - DNA, 10 bp, Unknown
  misc_feature (1)..( 10): Result.006 file - promoters50/5662749
taaaataatc

SEQ ID NO: 195782 - DNA, 10 bp, Unknown
  misc_feature (1)..( 10): Result.006 file - promoters50/5662749
aaaaataaga

SEQ ID NO: 195783 - DNA, 10 bp, Unknown
  misc_feature (1)..( 10): Result.006 file - promoters50/5662749
taaagtaatt

SEQ ID NO: 195784 - DNA, 10 bp, Unknown
  misc_feature (1)..( 10): Result.006 file - promoters50/5662749
aaaaataaac

SEQ ID NO: 195785 - DNA, 10 bp, Unknown
  misc_feature (1)..( 10): Result.006 file - promoters50/5662749
taaaatattc

SEQ ID NO: 195786 - DNA, 13 bp, Unknown
  misc_feature (1)..( 13): Result.006 file - promoters50/5662749
aagggaaaattct

SEQ ID NO: 195787 - DNA, 13 bp, Unknown
  misc_feature (1)..( 13): Result.006 file - promoters50/5662749
acaaaaaaaatct

SEQ ID NO: 195788 - DNA, 13 bp, Unknown
  misc_feature (1)..( 13): Result.006 file - promoters50/5662749
tttgttaaagtct

SEQ ID NO: 195789 - DNA, 13 bp, Unknown
  misc_feature (1)..( 13): Result.006 file - promoters50/5662749
ttgtcaaaattca

SEQ ID NO: 195790 - DNA, 13 bp, Unknown
  misc_feature (1)..( 13): Result.006 file - promoters50/5662749
taaacaaaaaaca

SEQ ID NO: 195791 - DNA, 13 bp, Unknown
  misc_feature (1)..( 13): Result.006 file - promoters50/5662749
ttgtcaacatttt

SEQ ID NO: 195792 - DNA, 13 bp, Unknown
  misc_feature (1)..( 13): Result.006 file - promoters50/5662763
ttgacaacaaacg

SEQ ID NO: 195793 - DNA, 8 bp, Unknown
  misc_feature (1)..( 8): Result.006 file - promoters50/5662763
ttttaata

SEQ ID NO: 195794 - DNA, 8 bp, Unknown
  misc_feature (1)..( 8): Result.006 file - promoters50/5662763
ttttaaaa

SEQ ID NO: 195795 - DNA, 8 bp, Unknown
  misc_feature (1)..( 8): Result.006 file - promoters50/5662763
ttttaata

SEQ ID NO: 195796 - DNA, 9 bp, Unknown
  misc_feature (1)..( 9): Result.006 file - promoters50/5662763
ggagttttt

SEQ ID NO: 195797 - DNA, 9 bp, Unknown
  misc_feature (1)..( 9): Result.006 file - promoters50/5662763
tttgttttt

SEQ ID NO: 195798 - DNA, 9 bp, Unknown
  misc_feature (1)..( 9): Result.006 file - promoters50/5662763
tttgttttg

SEQ ID NO: 195799 - DNA, 9 bp, Unknown
  misc_feature (1)..( 9): Result.006 file - promoters50/5662763
atgattttg

SEQ ID NO: 195800 - DNA, 9 bp, Unknown
  misc_feature (1)..( 9): Result.006 file - promoters50/5662763
atgaatttg

SEQ ID NO: 195801 - DNA, 9 bp, Unknown
  misc_feature (1)..( 9): Result.006 file - promoters50/5662763
cggattttc

SEQ ID NO: 195802 - DNA, 11 bp, Unknown
  misc_feature (1)..( 11): Result.006 file - promoters50/5662763
aatttgtttga

SEQ ID NO: 195803 - DNA, 11 bp, Unknown
  misc_feature (1)..( 11): Result.006 file - promoters50/5662763
aatatgtttta

SEQ ID NO: 195804 - DNA, 11 bp, Unknown
  misc_feature (1)..( 11): Result.006 file - promoters50/5662763
tcattgtatga

SEQ ID NO: 195805 - DNA, 8 bp, Unknown
  misc_feature (1)..( 8): Result.006 file - promoters50/5662763
atagtttt

SEQ ID NO: 195806 - DNA, 8 bp, Unknown
  misc_feature (1)..( 8): Result.006 file - promoters50/5662763
ataattta

SEQ ID NO: 195807 - DNA, 8 bp, Unknown
  misc_feature (1)..( 8): Result.006 file - promoters50/5662763
gtaattta

SEQ ID NO: 195808 - DNA, 10 bp, Unknown
  misc_feature (1)..( 10): Result.006 file - promoters50/5662763
ttttctgttt

SEQ ID NO: 195809 - DNA, 10 bp, Unknown
  misc_feature (1)..( 10): Result.006 file - promoters50/5662763
atttttgttt

SEQ ID NO: 195810 - DNA, 10 bp, Unknown
  misc_feature (1)..( 10): Result.006 file - promoters50/5662763
ttttctgttt

SEQ ID NO: 195811 - DNA, 10 bp, Unknown
  misc_feature (1)..( 10): Result.006 file - promoters50/5662763
atttttgcaa

SEQ ID NO: 195812 - DNA, 8 bp, Unknown
  misc_feature (1)..( 8): Result.006 file - promoters50/5662763
taacaaca

SEQ ID NO: 195813 - DNA, 8 bp, Unknown
  misc_feature (1)..( 8): Result.006 file - promoters50/5662763
taacaaaa

SEQ ID NO: 195814 - DNA, 8 bp, Unknown
  misc_feature (1)..( 8): Result.006 file - promoters50/5662763
taaaaaaa

SEQ ID NO: 195815 - DNA, 8 bp, Unknown
  misc_feature (1)..( 8): Result.006 file - promoters50/5662763
taatataa

SEQ ID NO: 195816 - DNA, 8 bp, Unknown
  misc_feature (1)..( 8): Result.006 file - promoters50/5662763
taatttaa

SEQ ID NO: 195817 - DNA, 8 bp, Unknown
  misc_feature (1)..( 8): Result.006 file - promoters50/5662763
taatataa

SEQ ID NO: 195818 - DNA, 8 bp, Unknown
  misc_feature (1)..( 8): Result.006 file - promoters50/5662763
taatttta

SEQ ID NO: 195819 - DNA, 10 bp, Unknown
  misc_feature (1)..( 10): Result.006 file - promoters50/5662763
ttttgaattg

SEQ ID NO: 195820 - DNA, 10 bp, Unknown
  misc_feature (1)..( 10): Result.006 file - promoters50/5662763
tttggaattg

SEQ ID NO: 195821 - DNA, 10 bp, Unknown
  misc_feature (1)..( 10): Result.006 file - promoters50/5662765
ttttgaattg

SEQ ID NO: 195822 - DNA, 10 bp, Unknown
  misc_feature (1)..( 10): Result.006 file - promoters50/5662765
attgttttaa

SEQ ID NO: 195823 - DNA, 10 bp, Unknown
  misc_feature (1)..( 10): Result.006 file - promoters50/5662765
tttgtattat

SEQ ID NO: 195824 - DNA, 10 bp, Unknown
  misc_feature (1)..( 10): Result.006 file - promoters50/5662765
atttttttct

SEQ ID NO: 195825 - DNA, 10 bp, Unknown
  misc_feature (1)..( 10): Result.006 file - promoters50/5662765
ctatgatttc

SEQ ID NO: 195826 - DNA, 10 bp, Unknown
  misc_feature (1)..( 10): Result.006 file - promoters50/5662765
acctgatttt

SEQ ID NO: 195827 - DNA, 10 bp, Unknown
  misc_feature (1)..( 10): Result.006 file - promoters50/5662765
atttgtctgt

SEQ ID NO: 195828 - DNA, 10 bp, Unknown
  misc_feature (1)..( 10): Result.006 file - promoters50/5662765
aatttattct

SEQ ID NO: 195829 - DNA, 12 bp, Unknown
  misc_feature (1)..( 12): Result.006 file - promoters50/5662765
aatttgatcatt

SEQ ID NO: 195830 - DNA, 12 bp, Unknown
  misc_feature (1)..( 12): Result.006 file - promoters50/5662765
attttgataatg

SEQ ID NO: 195831 - DNA, 12 bp, Unknown
  misc_feature (1)..( 12): Result.006 file - promoters50/5662765
tttttgatgctt

SEQ ID NO: 195832 - DNA, 12 bp, Unknown
  misc_feature (1)..( 12): Result.006 file - promoters50/5662765
aatctgaacatt

SEQ ID NO: 195833 - DNA, 12 bp, Unknown
  misc_feature (1)..( 12): Result.006 file - promoters50/5662765
ttttttatataa

SEQ ID NO: 195834 - DNA, 12 bp, Unknown
  misc_feature (1)..( 12): Result.006 file - promoters50/5662765
aaattggtaata

SEQ ID NO: 195835 - DNA, 12 bp, Unknown
  misc_feature (1)..( 12): Result.006 file - promoters50/5662765
attattatattt

SEQ ID NO: 195836 - DNA, 11 bp, Unknown
  misc_feature (1)..( 11): Result.006 file - promoters50/5662765
aatataatgga

SEQ ID NO: 195837 - DNA, 11 bp, Unknown
  misc_feature (1)..( 11): Result.006 file - promoters50/5662765
catataaccaa

SEQ ID NO: 195838 - DNA, 11 bp, Unknown
  misc_feature (1)..( 11): Result.006 file - promoters50/5662765
tatatgatgga

SEQ ID NO: 195839 - DNA, 11 bp, Unknown
  misc_feature (1)..( 11): Result.006 file - promoters50/5662765
tatttgaaatc

SEQ ID NO: 195840 - DNA, 11 bp, Unknown
  misc_feature (1)..( 11): Result.006 file - promoters50/5662765
catttgatcac

SEQ ID NO: 195841 - DNA, 11 bp, Unknown
  misc_feature (1)..( 11): Result.006 file - promoters50/5662765
aatttgagcgg

SEQ ID NO: 195842 - DNA, 12 bp, Unknown
  misc_feature (1)..( 12): Result.006 file - promoters50/5662765
tagttttgatgt

SEQ ID NO: 195843 - DNA, 12 bp, Unknown
  misc_feature (1)..( 12): Result.006 file - promoters50/5662765
tgattttgacta

SEQ ID NO: 195844 - DNA, 12 bp, Unknown
  misc_feature (1)..( 12): Result.006 file - promoters50/5662765
attttttgttgt

SEQ ID NO: 195845 - DNA, 12 bp, Unknown
  misc_feature (1)..( 12): Result.006 file - promoters50/5662765
atattttgcata

SEQ ID NO: 195846 - DNA, 12 bp, Unknown
  misc_feature (1)..( 12): Result.006 file - promoters50/5662765
atattttatatt

SEQ ID NO: 195847 - DNA, 12 bp, Unknown
  misc_feature (1)..( 12): Result.006 file - promoters50/5662765
cacttttccatc

SEQ ID NO: 195848 - DNA, 12 bp, Unknown
  misc_feature (1)..( 12): Result.006 file - promoters50/5662765
tgtgtttgacat

SEQ ID NO: 195849 - DNA, 13 bp, Unknown
  misc_feature (1)..( 13): Result.006 file - promoters50/5662765
tgttttcactttt

SEQ ID NO: 195850 - DNA, 13 bp, Unknown
  misc_feature (1)..( 13): Result.006 file - promoters50/5662765
atatttaactttt

SEQ ID NO: 195851 - DNA, 13 bp, Unknown
  misc_feature (1)..( 13): Result.006 file - promoters50/5662765
tgttttaagtttc

SEQ ID NO: 195852 - DNA, 13 bp, Unknown
  misc_feature (1)..( 13): Result.006 file - promoters50/5662765
ttttttaattatt

SEQ ID NO: 195853 - DNA, 13 bp, Unknown
  misc_feature (1)..( 13): Result.006 file - promoters50/5662765
tcatttaaggaca

SEQ ID NO: 195854 - DNA, 13 bp, Unknown
  misc_feature (1)..( 13): Result.006 file - promoters50/5662765
ttttttagtattt

SEQ ID NO: 195855 - DNA, 17 bp, Unknown
  misc_feature (1)..( 17): Result.006 file - promoters50/5662765
tgtcttattaaacaaga

SEQ ID NO: 195856 - DNA, 17 bp, Unknown
  misc_feature (1)..( 17): Result.006 file - promoters50/5662765
aacccatagaaacaaac

SEQ ID NO: 195857 - DNA, 17 bp, Unknown
  misc_feature (1)..( 17): Result.006 file - promoters50/5662765
aaagaagaaaaagaaga

SEQ ID NO: 195858 - DNA, 17 bp, Unknown
  misc_feature (1)..( 17): Result.006 file - promoters50/5662765
atcaataggaaacaaaa

SEQ ID NO: 195859 - DNA, 17 bp, Unknown
  misc_feature (1)..( 17): Result.006 file - promoters50/5662765
tgtctaattatacaact

SEQ ID NO: 195860 - DNA, 17 bp, Unknown
  misc_feature (1)..( 17): Result.006 file - promoters50/5662765
cagctaataatagaatt

SEQ ID NO: 195861 - DNA, 10 bp, Unknown
  misc_feature (1)..( 10): Result.006 file - promoters50/5662765
ataggcccaa

SEQ ID NO: 195862 - DNA, 10 bp, Unknown
  misc_feature (1)..( 10): Result.006 file - promoters50/5662765
taaagcccaa

SEQ ID NO: 195863 - DNA, 10 bp, Unknown
  misc_feature (1)..( 10): Result.006 file - promoters50/5662765
aaaggcccat

SEQ ID NO: 195864 - DNA, 10 bp, Unknown
  misc_feature (1)..( 10): Result.006 file - promoters50/5662765
cctggcccat

SEQ ID NO: 195865 - DNA, 10 bp, Unknown
  misc_feature (1)..( 10): Result.006 file - promoters50/5662765
ttcggcccat

SEQ ID NO: 195866 - DNA, 10 bp, Unknown
  misc_feature (1)..( 10): Result.006 file - promoters50/5662765
taaggcccaa

SEQ ID NO: 195867 - DNA, 15 bp, Unknown
  misc_feature (1)..( 15): Result.006 file - promoters50/5662765
tgtcttattaaacaa

SEQ ID NO: 195868 - DNA, 15 bp, Unknown
  misc_feature (1)..( 15): Result.006 file - promoters50/5662765
attctaattgcagct

SEQ ID NO: 195869 - DNA, 15 bp, Unknown
  misc_feature (1)..( 15): Result.006 file - promoters50/5662765
tgtctaattatacaa

SEQ ID NO: 195870 - DNA, 15 bp, Unknown
  misc_feature (1)..( 15): Result.006 file - promoters50/5662765
tttttaattgatgaa

SEQ ID NO: 195871 - DNA, 15 bp, Unknown
  misc_feature (1)..( 15): Result.006 file - promoters50/5662765
gatttaattcaaaaa

SEQ ID NO: 195872 - DNA, 15 bp, Unknown
  misc_feature (1)..( 15): Result.006 file - promoters50/5662769
cctttgatttgaatt

SEQ ID NO: 195873 - DNA, 7 bp, Unknown
  misc_feature (1)..( 7): Result.006 file - promoters50/5662769
taataaa

SEQ ID NO: 195874 - DNA, 7 bp, Unknown
  misc_feature (1)..( 7): Result.006 file - promoters50/5662769
taacaaa

SEQ ID NO: 195875 - DNA, 7 bp, Unknown
  misc_feature (1)..( 7): Result.006 file - promoters50/5662769
aaataaa

SEQ ID NO: 195876 - DNA, 9 bp, Unknown
  misc_feature (1)..( 9): Result.006 file - promoters50/5662769
gagttttgc

SEQ ID NO: 195877 - DNA, 9 bp, Unknown
  misc_feature (1)..( 9): Result.006 file - promoters50/5662769
ttgttttgc

SEQ ID NO: 195878 - DNA, 9 bp, Unknown
  misc_feature (1)..( 9): Result.006 file - promoters50/5662779
ttgatttga

SEQ ID NO: 195879 - DNA, 13 bp, Unknown
  misc_feature (1)..( 13): Result.006 file - promoters50/5662779
aaaggataattga

SEQ ID NO: 195880 - DNA, 13 bp, Unknown
  misc_feature (1)..( 13): Result.006 file - promoters50/5662779
aaaagattaatgt

SEQ ID NO: 195881 - DNA, 13 bp, Unknown
  misc_feature (1)..( 13): Result.006 file - promoters50/5662779
aaaaaattgatgt

SEQ ID NO: 195882 - DNA, 13 bp, Unknown
  misc_feature (1)..( 13): Result.006 file - promoters50/5662779
aaataaagcacac

SEQ ID NO: 195883 - DNA, 14 bp, Unknown
  misc_feature (1)..( 14): Result.006 file - promoters50/5662779
ttgcaaatgagccc

SEQ ID NO: 195884 - DNA, 14 bp, Unknown
  misc_feature (1)..( 14): Result.006 file - promoters50/5662779
ttgcaaaagaggca

SEQ ID NO: 195885 - DNA, 14 bp, Unknown
  misc_feature (1)..( 14): Result.006 file - promoters50/5662779
aagaagaagacgca

SEQ ID NO: 195886 - DNA, 13 bp, Unknown
  misc_feature (1)..( 13): Result.006 file - promoters50/5662779
ggataattgagct

SEQ ID NO: 195887 - DNA, 13 bp, Unknown
  misc_feature (1)..( 13): Result.006 file - promoters50/5662779
aaaaaattgatgt

SEQ ID NO: 195888 - DNA, 13 bp, Unknown
  misc_feature (1)..( 13): Result.006 file - promoters50/5662779
aaaagattaatgt

SEQ ID NO: 195889 - DNA, 11 bp, Unknown
  misc_feature (1)..( 11): Result.006 file - promoters50/5662779
agtcaaagaaa

SEQ ID NO: 195890 - DNA, 11 bp, Unknown
  misc_feature (1)..( 11): Result.006 file - promoters50/5662779
agttaaataaa

SEQ ID NO: 195891 - DNA, 11 bp, Unknown
  misc_feature (1)..( 11): Result.006 file - promoters50/5662779
cgttaaattat

SEQ ID NO: 195892 - DNA, 15 bp, Unknown
  misc_feature (1)..( 15): Result.006 file - promoters50/5662779
aaaagattaatgtaa

SEQ ID NO: 195893 - DNA, 15 bp, Unknown
  misc_feature (1)..( 15): Result.006 file - promoters50/5662779
cactctttaatataa

SEQ ID NO: 195894 - DNA, 15 bp, Unknown
  misc_feature (1)..( 15): Result.006 file - promoters50/5662779
aaaaaattgatgtcg

SEQ ID NO: 195895 - DNA, 8 bp, Unknown
  misc_feature (1)..( 8): Result.006 file - promoters50/5662779
agtgaaga

SEQ ID NO: 195896 - DNA, 8 bp, Unknown
  misc_feature (1)..( 8): Result.006 file - promoters50/5662779
agtgaaca

SEQ ID NO: 195897 - DNA, 8 bp, Unknown
  misc_feature (1)..( 8): Result.006 file - promoters50/5662783
agtgcaca

SEQ ID NO: 195898 - DNA, 15 bp, Unknown
  misc_feature (1)..( 15): Result.006 file - promoters50/5662783
aatcacttaatcacc

SEQ ID NO: 195899 - DNA, 15 bp, Unknown
  misc_feature (1)..( 15): Result.006 file - promoters50/5662783
aatgacttaatccgc

SEQ ID NO: 195900 - DNA, 15 bp, Unknown
  misc_feature (1)..( 15): Result.006 file - promoters50/5662783
gataaattattcaca

SEQ ID NO: 195901 - DNA, 15 bp, Unknown
  misc_feature (1)..( 15): Result.006 file - promoters50/5662783
agaaactgaatttcg

SEQ ID NO: 195902 - DNA, 15 bp, Unknown
  misc_feature (1)..( 15): Result.006 file - promoters50/5662783
tgagatttaatcgga

SEQ ID NO: 195903 - DNA, 15 bp, Unknown
  misc_feature (1)..( 15): Result.006 file - promoters50/5662783
gtttttgtaataatt

SEQ ID NO: 195904 - DNA, 10 bp, Unknown
  misc_feature (1)..( 10): Result.006 file - promoters50/5662783
agaaaattat

SEQ ID NO: 195905 - DNA, 10 bp, Unknown
  misc_feature (1)..( 10): Result.006 file - promoters50/5662783
ttaaaattta

SEQ ID NO: 195906 - DNA, 10 bp, Unknown
  misc_feature (1)..( 10): Result.006 file - promoters50/5662783
caaaaattca

SEQ ID NO: 195907 - DNA, 10 bp, Unknown
  misc_feature (1)..( 10): Result.006 file - promoters50/5662783
ttacaatgtt

SEQ ID NO: 195908 - DNA, 10 bp, Unknown
  misc_feature (1)..( 10): Result.006 file - promoters50/5662783
agtaaattcg

SEQ ID NO: 195909 - DNA, 10 bp, Unknown
  misc_feature (1)..( 10): Result.006 file - promoters50/5662783
atcaaactcg

SEQ ID NO: 195910 - DNA, 13 bp, Unknown
  misc_feature (1)..( 13): Result.006 file - promoters50/5662783
tctcaaattgttt

SEQ ID NO: 195911 - DNA, 13 bp, Unknown
  misc_feature (1)..( 13): Result.006 file - promoters50/5662783
tatcatatttttg

SEQ ID NO: 195912 - DNA, 13 bp, Unknown
  misc_feature (1)..( 13): Result.006 file - promoters50/5662783
gaataaatagttt

SEQ ID NO: 195913 - DNA, 13 bp, Unknown
  misc_feature (1)..( 13): Result.006 file - promoters50/5662783
tctgaaaatttta

SEQ ID NO: 195914 - DNA, 13 bp, Unknown
  misc_feature (1)..( 13): Result.006 file - promoters50/5662783
tcttaaacacttg

SEQ ID NO: 195915 - DNA, 13 bp, Unknown
  misc_feature (1)..( 13): Result.006 file - promoters50/5662785
tatcctataattg

SEQ ID NO: 195916 - DNA, 10 bp, Unknown
  misc_feature (1)..( 10): Result.006 file - promoters50/5662785
aatgtgtaat

SEQ ID NO: 195917 - DNA, 10 bp, Unknown
  misc_feature (1)..( 10): Result.006 file - promoters50/5662785
attgtttaat

SEQ ID NO: 195918 - DNA, 10 bp, Unknown
  misc_feature (1)..( 10): Result.006 file - promoters50/5662785
attgttttct

SEQ ID NO: 195919 - DNA, 8 bp, Unknown
  misc_feature (1)..( 8): Result.006 file - promoters50/5662785
ttttcttt

SEQ ID NO: 195920 - DNA, 8 bp, Unknown
  misc_feature (1)..( 8): Result.006 file - promoters50/5662785
atttctta

SEQ ID NO: 195921 - DNA, 8 bp, Unknown
  misc_feature (1)..( 8): Result.006 file - promoters50/5662805
attgctta

SEQ ID NO: 195922 - DNA, 11 bp, Unknown
  misc_feature (1)..( 11): Result.006 file - promoters50/5662805
tttgttttctc

SEQ ID NO: 195923 - DNA, 11 bp, Unknown
  misc_feature (1)..( 11): Result.006 file - promoters50/5662805
gatgttttttt

SEQ ID NO: 195924 - DNA, 11 bp, Unknown
  misc_feature (1)..( 11): Result.006 file - promoters50/5662805
tttggtttctc

SEQ ID NO: 195925 - DNA, 11 bp, Unknown
  misc_feature (1)..( 11): Result.006 file - promoters50/5662805
tttggtcatct

SEQ ID NO: 195926 - DNA, 10 bp, Unknown
  misc_feature (1)..( 10): Result.006 file - promoters50/5662805
tttttacttt

SEQ ID NO: 195927 - DNA, 10 bp, Unknown
  misc_feature (1)..( 10): Result.006 file - promoters50/5662805
tttttatata

SEQ ID NO: 195928 - DNA, 10 bp, Unknown
  misc_feature (1)..( 10): Result.006 file - promoters50/5662805
aatttaataa

SEQ ID NO: 195929 - DNA, 10 bp, Unknown
  misc_feature (1)..( 10): Result.006 file - promoters50/5662805
tctttcatat

SEQ ID NO: 195930 - DNA, 11 bp, Unknown
  misc_feature (1)..( 11): Result.006 file - promoters50/5662805
atttgttttct

SEQ ID NO: 195931 - DNA, 11 bp, Unknown
  misc_feature (1)..( 11): Result.006 file - promoters50/5662805
attagttgtga

SEQ ID NO: 195932 - DNA, 12 bp, Unknown
  misc_feature (1)..( 12): Result.006 file - promoters50/5662805
ttttggtttctc

SEQ ID NO: 195933 - DNA, 12 bp, Unknown
  misc_feature (1)..( 12): Result.006 file - promoters50/5662805
cgttagatgttt

SEQ ID NO: 195934 - DNA, 12 bp, Unknown
  misc_feature (1)..( 12): Result.006 file - promoters50/5662805
atttggtcatct

SEQ ID NO: 195935 - DNA, 17 bp, Unknown
  misc_feature (1)..( 17): Result.006 file - promoters50/5662805
tactatataatggtagc

SEQ ID NO: 195936 - DNA, 17 bp, Unknown
  misc_feature (1)..( 17): Result.006 file - promoters50/5662805
gcctatataaacattac

SEQ ID NO: 195937 - DNA, 17 bp, Unknown
  misc_feature (1)..( 17): Result.006 file - promoters50/5662805
ctctatataatagtagc

SEQ ID NO: 195938 - DNA, 17 bp, Unknown
  misc_feature (1)..( 17): Result.006 file - promoters50/5662809
tactatataaacaccaa

SEQ ID NO: 195939 - DNA, 11 bp, Unknown
  misc_feature (1)..( 11): Result.006 file - promoters50/5662809
acctttgttat

SEQ ID NO: 195940 - DNA, 11 bp, Unknown
  misc_feature (1)..( 11): Result.006 file - promoters50/5662809
tttttttttag

SEQ ID NO: 195941 - DNA, 11 bp, Unknown
  misc_feature (1)..( 11): Result.006 file - promoters50/5662809
aaatttgatat

SEQ ID NO: 195942 - DNA, 12 bp, Unknown
  misc_feature (1)..( 12): Result.006 file - promoters50/5662809
attttattttat

SEQ ID NO: 195943 - DNA, 12 bp, Unknown
  misc_feature (1)..( 12): Result.006 file - promoters50/5662809
ctttcttttaat

SEQ ID NO: 195944 - DNA, 12 bp, Unknown
  misc_feature (1)..( 12): Result.006 file - promoters50/5662809
gtgtctttccca

SEQ ID NO: 195945 - DNA, 8 bp, Unknown
  misc_feature (1)..( 8): Result.006 file - promoters50/5662809
cttttata

SEQ ID NO: 195946 - DNA, 8 bp, Unknown
  misc_feature (1)..( 8): Result.006 file - promoters50/5662809
cttttaaa

SEQ ID NO: 195947 - DNA, 8 bp, Unknown
  misc_feature (1)..( 8): Result.006 file - promoters50/5662809
gttttatt

SEQ ID NO: 195948 - DNA, 8 bp, Unknown
  misc_feature (1)..( 8): Result.006 file - promoters50/5662809
ttttcatt

SEQ ID NO: 195949 - DNA, 8 bp, Unknown
  misc_feature (1)..( 8): Result.006 file - promoters50/5662809
ttttgtca

SEQ ID NO: 195950 - DNA, 8 bp, Unknown
  misc_feature (1)..( 8): Result.006 file - promoters50/5662828
aattcatt

SEQ ID NO: 195951 - DNA, 11 bp, Unknown
  misc_feature (1)..( 11): Result.006 file - promoters50/5662828
tttataagtat

SEQ ID NO: 195952 - DNA, 11 bp, Unknown
  misc_feature (1)..( 11): Result.006 file - promoters50/5662828
tttgtaacttc

SEQ ID NO: 195953 - DNA, 11 bp, Unknown
  misc_feature (1)..( 11): Result.006 file - promoters50/5662828
cttataattat

SEQ ID NO: 195954 - DNA, 11 bp, Unknown
  misc_feature (1)..( 11): Result.006 file - promoters50/5662828
tttaaaagtaa

SEQ ID NO: 195955 - DNA, 11 bp, Unknown
  misc_feature (1)..( 11): Result.006 file - promoters50/5662828
tttttaaattt

SEQ ID NO: 195956 - DNA, 11 bp, Unknown
  misc_feature (1)..( 11): Result.006 file - promoters50/5662828
tttgaaaagag

SEQ ID NO: 195957 - DNA, 17 bp, Unknown
  misc_feature (1)..( 17): Result.006 file - promoters50/5662828
aatcttttgattctaaa

SEQ ID NO: 195958 - DNA, 17 bp, Unknown
  misc_feature (1)..( 17): Result.006 file - promoters50/5662828
taaattttgaaataatt

SEQ ID NO: 195959 - DNA, 17 bp, Unknown
  misc_feature (1)..( 17): Result.006 file - promoters50/5662828
ttgatttagataccgga

SEQ ID NO: 195960 - DNA, 17 bp, Unknown
  misc_feature (1)..( 17): Result.006 file - promoters50/5662828
tgtgttttgaaaagagt

SEQ ID NO: 195961 - DNA, 17 bp, Unknown
  misc_feature (1)..( 17): Result.006 file - promoters50/5662828
taaattttaaaattatt

SEQ ID NO: 195962 - DNA, 17 bp, Unknown
  misc_feature (1)..( 17): Result.006 file - promoters50/5662828
aattttttaaaatatat

SEQ ID NO: 195963 - DNA, 17 bp, Unknown
  misc_feature (1)..( 17): Result.006 file - promoters50/5662828
aaaatgttagataggaa

SEQ ID NO: 195964 - DNA, 17 bp, Unknown
  misc_feature (1)..( 17): Result.006 file - promoters50/5662828
ttgattctaaaatattg

SEQ ID NO: 195965 - DNA, 17 bp, Unknown
  misc_feature (1)..( 17): Result.006 file - promoters50/5662828
ccgggtctaaaactccg

SEQ ID NO: 195966 - DNA, 17 bp, Unknown
  misc_feature (1)..( 17): Result.006 file - promoters50/5662828
taaattttaaaattatt

SEQ ID NO: 195967 - DNA, 17 bp, Unknown
  misc_feature (1)..( 17): Result.006 file - promoters50/5662828
aattttttaaaatatat

SEQ ID NO: 195968 - DNA, 17 bp, Unknown
  misc_feature (1)..( 17): Result.006 file - promoters50/5662828
taaattttgaaataatt

SEQ ID NO: 195969 - DNA, 17 bp, Unknown
  misc_feature (1)..( 17): Result.006 file - promoters50/5662832
tttccataaaaatgtta

SEQ ID NO: 195970 - DNA, 8 bp, Unknown
  misc_feature (1)..( 8): Result.006 file - promoters50/5662832
tttggttc

SEQ ID NO: 195971 - DNA, 8 bp, Unknown
  misc_feature (1)..( 8): Result.006 file - promoters50/5662832
cttgtttc

SEQ ID NO: 195972 - DNA, 8 bp, Unknown
  misc_feature (1)..( 8): Result.006 file - promoters50/5662832
tttggttg

SEQ ID NO: 195973 - DNA, 8 bp, Unknown
  misc_feature (1)..( 8): Result.006 file - promoters50/5662832
attattta

SEQ ID NO: 195974 - DNA, 8 bp, Unknown
  misc_feature (1)..( 8): Result.006 file - promoters50/5662832
attcttta

SEQ ID NO: 195975 - DNA, 8 bp, Unknown
  misc_feature (1)..( 8): Result.006 file - promoters50/5662832
attttttg

SEQ ID NO: 195976 - DNA, 14 bp, Unknown
  misc_feature (1)..( 14): Result.006 file - promoters50/5662832
gattcttggagttg

SEQ ID NO: 195977 - DNA, 14 bp, Unknown
  misc_feature (1)..( 14): Result.006 file - promoters50/5662832
gattctcgcacgaa

SEQ ID NO: 195978 - DNA, 14 bp, Unknown
  misc_feature (1)..( 14): Result.006 file - promoters50/5662835
tattttcgctcgaa

SEQ ID NO: 195979 - DNA, 10 bp, Unknown
  misc_feature (1)..( 10): Result.006 file - promoters50/5662835
aaacaaattt

SEQ ID NO: 195980 - DNA, 10 bp, Unknown
  misc_feature (1)..( 10): Result.006 file - promoters50/5662835
agacacattc

SEQ ID NO: 195981 - DNA, 10 bp, Unknown
  misc_feature (1)..( 10): Result.006 file - promoters50/5662835
gttcaatttt

SEQ ID NO: 195982 - DNA, 10 bp, Unknown
  misc_feature (1)..( 10): Result.006 file - promoters50/5662835
tgacaaatct

SEQ ID NO: 195983 - DNA, 10 bp, Unknown
  misc_feature (1)..( 10): Result.006 file - promoters50/5662843
aaaaaaattt

SEQ ID NO: 195984 - DNA, 10 bp, Unknown
  misc_feature (1)..( 10): Result.006 file - promoters50/5662843
tgtcaaaaat

SEQ ID NO: 195985 - DNA, 10 bp, Unknown
  misc_feature (1)..( 10): Result.006 file - promoters50/5662843
aatcataaat

SEQ ID NO: 195986 - DNA, 10 bp, Unknown
  misc_feature (1)..( 10): Result.006 file - promoters50/5662846
aatcatagtc

SEQ ID NO: 195987 - DNA, 11 bp, Unknown
  misc_feature (1)..( 11): Result.006 file - promoters50/5662846
tttcttttatg

SEQ ID NO: 195988 - DNA, 11 bp, Unknown
  misc_feature (1)..( 11): Result.006 file - promoters50/5662846
atttttttata

SEQ ID NO: 195989 - DNA, 11 bp, Unknown
  misc_feature (1)..( 11): Result.006 file - promoters50/5662846
tttcttttatt

SEQ ID NO: 195990 - DNA, 11 bp, Unknown
  misc_feature (1)..( 11): Result.006 file - promoters50/5662846
tcggtttaatt

SEQ ID NO: 195991 - DNA, 12 bp, Unknown
  misc_feature (1)..( 12): Result.006 file - promoters50/5662846
ataaaatataaa

SEQ ID NO: 195992 - DNA, 12 bp, Unknown
  misc_feature (1)..( 12): Result.006 file - promoters50/5662846
ataaaatataaa

SEQ ID NO: 195993 - DNA, 12 bp, Unknown
  misc_feature (1)..( 12): Result.006 file - promoters50/5662846
ataaattggaac

SEQ ID NO: 195994 - DNA, 8 bp, Unknown
  misc_feature (1)..( 8): Result.006 file - promoters50/5662846
tttcgaaa

SEQ ID NO: 195995 - DNA, 8 bp, Unknown
  misc_feature (1)..( 8): Result.006 file - promoters50/5662846
tttctaaa

SEQ ID NO: 195996 - DNA, 8 bp, Unknown
  misc_feature (1)..( 8): Result.006 file - promoters50/5662846
ttttgaag

SEQ ID NO: 195997 - DNA, 7 bp, Unknown
  misc_feature (1)..( 7): Result.006 file - promoters50/5662846
taaaaaa

SEQ ID NO: 195998 - DNA, 7 bp, Unknown
  misc_feature (1)..( 7): Result.006 file - promoters50/5662846
taaaaaa

SEQ ID NO: 195999 - DNA, 7 bp, Unknown
  misc_feature (1)..( 7): Result.006 file - promoters50/5662846
caaaaac

SEQ ID NO: 196000 - DNA, 16 bp, Unknown
  misc_feature (1)..( 16): Result.006 file - promoters50/5662846
aaaataattaccaaat

SEQ ID NO: 196001 - DNA, 16 bp, Unknown
  misc_feature (1)..( 16): Result.006 file - promoters50/5662846
aaaataataacctgga

SEQ ID NO: 196002 - DNA, 16 bp, Unknown
  misc_feature (1)..( 16): Result.006 file - promoters50/5662846
tttatgattacctaat

SEQ ID NO: 196003 - DNA, 9 bp, Unknown
  misc_feature (1)..( 9): Result.006 file - promoters50/5662846
tcaaaaaaa

SEQ ID NO: 196004 - DNA, 9 bp, Unknown
  misc_feature (1)..( 9): Result.006 file - promoters50/5662846
tcaaaaata

SEQ ID NO: 196005 - DNA, 9 bp, Unknown
  misc_feature (1)..( 9): Result.006 file - promoters50/5662846
ttaaaaata

SEQ ID NO: 196006 - DNA, 11 bp, Unknown
  misc_feature (1)..( 11): Result.006 file - promoters50/5662846
taaaacacaaa

SEQ ID NO: 196007 - DNA, 11 bp, Unknown
  misc_feature (1)..( 11): Result.006 file - promoters50/5662846
aaaaatacaaa

SEQ ID NO: 196008 - DNA, 11 bp, Unknown
  misc_feature (1)..( 11): Result.006 file - promoters50/5662850
aaaaatagctc

SEQ ID NO: 196009 - DNA, 8 bp, Unknown
  misc_feature (1)..( 8): Result.006 file - promoters50/5662850
gcaaattt

SEQ ID NO: 196010 - DNA, 8 bp, Unknown
  misc_feature (1)..( 8): Result.006 file - promoters50/5662850
tcaaattg

SEQ ID NO: 196011 - DNA, 8 bp, Unknown
  misc_feature (1)..( 8): Result.006 file - promoters50/5662850
tcaatttt

SEQ ID NO: 196012 - DNA, 8 bp, Unknown
  misc_feature (1)..( 8): Result.006 file - promoters50/5662850
gcaaatac

SEQ ID NO: 196013 - DNA, 15 bp, Unknown
  misc_feature (1)..( 15): Result.006 file - promoters50/5662850
aataaaggaaaaata

SEQ ID NO: 196014 - DNA, 15 bp, Unknown
  misc_feature (1)..( 15): Result.006 file - promoters50/5662850
aataagggaacaatc

SEQ ID NO: 196015 - DNA, 15 bp, Unknown
  misc_feature (1)..( 15): Result.006 file - promoters50/5662850
tctctatataaaata

SEQ ID NO: 196016 - DNA, 11 bp, Unknown
  misc_feature (1)..( 11): Result.006 file - promoters50/5662850
cgtagctaaag

SEQ ID NO: 196017 - DNA, 11 bp, Unknown
  misc_feature (1)..( 11): Result.006 file - promoters50/5662850
cgtatctaaag

SEQ ID NO: 196018 - DNA, 11 bp, Unknown
  misc_feature (1)..( 11): Result.006 file - promoters50/5662850
cttatctaaac

SEQ ID NO: 196019 - DNA, 12 bp, Unknown
  misc_feature (1)..( 12): Result.006 file - promoters50/5662850
aaatttaaacac

SEQ ID NO: 196020 - DNA, 12 bp, Unknown
  misc_feature (1)..( 12): Result.006 file - promoters50/5662850
taatttatatgt

SEQ ID NO: 196021 - DNA, 12 bp, Unknown
  misc_feature (1)..( 12): Result.006 file - promoters50/5662850
taacttatttgt

SEQ ID NO: 196022 - DNA, 14 bp, Unknown
  misc_feature (1)..( 14): Result.006 file - promoters50/5662850
ctaaaaatatgttt

SEQ ID NO: 196023 - DNA, 14 bp, Unknown
  misc_feature (1)..( 14): Result.006 file - promoters50/5662850
taatttatatgttt

SEQ ID NO: 196024 - DNA, 14 bp, Unknown
  misc_feature (1)..( 14): Result.006 file - promoters50/5662850
taacttatttgtgg

SEQ ID NO: 196025 - DNA, 8 bp, Unknown
  misc_feature (1)..( 8): Result.006 file - promoters50/5662850
tcttcttt

SEQ ID NO: 196026 - DNA, 8 bp, Unknown
  misc_feature (1)..( 8): Result.006 file - promoters50/5662850
tcttcttt

SEQ ID NO: 196027 - DNA, 9 bp, Unknown
  misc_feature (1)..( 9): Result.006 file - promoters50/5662850
tcttcattt

SEQ ID NO: 196028 - DNA, 8 bp, Unknown
  misc_feature (1)..( 8): Result.006 file - promoters50/5662850
cttttctt

SEQ ID NO: 196029 - DNA, 8 bp, Unknown
  misc_feature (1)..( 8): Result.006 file - promoters50/5662850
tttttctt

SEQ ID NO: 196030 - DNA, 9 bp, Unknown
  misc_feature (1)..( 9): Result.006 file - promoters50/5662850
tttattctt

SEQ ID NO: 196031 - DNA, 10 bp, Unknown
  misc_feature (1)..( 10): Result.006 file - promoters50/5662850
ctttgttctt

SEQ ID NO: 196032 - DNA, 10 bp, Unknown
  misc_feature (1)..( 10): Result.006 file - promoters50/5662850
ctttattctt

SEQ ID NO: 196033 - DNA, 10 bp, Unknown
  misc_feature (1)..( 10): Result.006 file - promoters50/5662850
ttttcttctt

SEQ ID NO: 196034 - DNA, 9 bp, Unknown
  misc_feature (1)..( 9): Result.006 file - promoters50/5662850
agaataaaa

SEQ ID NO: 196035 - DNA, 9 bp, Unknown
  misc_feature (1)..( 9): Result.006 file - promoters50/5662850
tatataaaa

SEQ ID NO: 196036 - DNA, 9 bp, Unknown
  misc_feature (1)..( 9): Result.006 file - promoters50/5662850
tatataaat

SEQ ID NO: 196037 - DNA, 9 bp, Unknown
  misc_feature (1)..( 9): Result.006 file - promoters50/5662850
ataatatct

SEQ ID NO: 196038 - DNA, 9 bp, Unknown
  misc_feature (1)..( 9): Result.006 file - promoters50/5662850
ataatactt

SEQ ID NO: 196039 - DNA, 9 bp, Unknown
  misc_feature (1)..( 9): Result.006 file - promoters50/5662850
ataaaactt

SEQ ID NO: 196040 - DNA, 7 bp, Unknown
  misc_feature (1)..( 7): Result.006 file - promoters50/5662850
tttaggg

SEQ ID NO: 196041 - DNA, 7 bp, Unknown
  misc_feature (1)..( 7): Result.006 file - promoters50/5662850
ttttggg

SEQ ID NO: 196042 - DNA, 8 bp, Unknown
  misc_feature (1)..( 8): Result.006 file - promoters50/5662893
cttacggg

SEQ ID NO: 196043 - DNA, 9 bp, Unknown
  misc_feature (1)..( 9): Result.006 file - promoters50/5662893
tttgtattc

SEQ ID NO: 196044 - DNA, 9 bp, Unknown
  misc_feature (1)..( 9): Result.006 file - promoters50/5662893
tttggattt

SEQ ID NO: 196045 - DNA, 9 bp, Unknown
  misc_feature (1)..( 9): Result.006 file - promoters50/5662893
tttttattg

SEQ ID NO: 196046 - DNA, 9 bp, Unknown
  misc_feature (1)..( 9): Result.006 file - promoters50/5662893
tttttagtg

SEQ ID NO: 196047 - DNA, 9 bp, Unknown
  misc_feature (1)..( 9): Result.006 file - promoters50/5662893
ttttttttt

SEQ ID NO: 196048 - DNA, 9 bp, Unknown
  misc_feature (1)..( 9): Result.006 file - promoters50/5662893
gtttgatta

SEQ ID NO: 196049 - DNA, 11 bp, Unknown
  misc_feature (1)..( 11): Result.006 file - promoters50/5662893
agaaaaaaaaa

SEQ ID NO: 196050 - DNA, 11 bp, Unknown
  misc_feature (1)..( 11): Result.006 file - promoters50/5662893
agaaaaaaaaa

SEQ ID NO: 196051 - DNA, 11 bp, Unknown
  misc_feature (1)..( 11): Result.006 file - promoters50/5662893
agacaaataga

SEQ ID NO: 196052 - DNA, 11 bp, Unknown
  misc_feature (1)..( 11): Result.006 file - promoters50/5662893
tgacaaaaaaa

SEQ ID NO: 196053 - DNA, 11 bp, Unknown
  misc_feature (1)..( 11): Result.006 file - promoters50/5662893
tgacaaaccaa

SEQ ID NO: 196054 - DNA, 11 bp, Unknown
  misc_feature (1)..( 11): Result.006 file - promoters50/5662893
agaaacaatgt

SEQ ID NO: 196055 - DNA, 11 bp, Unknown
  misc_feature (1)..( 11): Result.006 file - promoters50/5662893
gatattatagg

SEQ ID NO: 196056 - DNA, 11 bp, Unknown
  misc_feature (1)..( 11): Result.006 file - promoters50/5662893
aaaattatatc

SEQ ID NO: 196057 - DNA, 11 bp, Unknown
  misc_feature (1)..( 11): Result.006 file - promoters50/5662893
cgtatcataaa

SEQ ID NO: 196058 - DNA, 11 bp, Unknown
  misc_feature (1)..( 11): Result.006 file - promoters50/5662893
aaaattatacc

SEQ ID NO: 196059 - DNA, 11 bp, Unknown
  misc_feature (1)..( 11): Result.006 file - promoters50/5662893
caaagtatctt

SEQ ID NO: 196060 - DNA, 11 bp, Unknown
  misc_feature (1)..( 11): Result.006 file - promoters50/5662895
tatttcaaaaa

SEQ ID NO: 196061 - DNA, 11 bp, Unknown
  misc_feature (1)..( 11): Result.006 file - promoters50/5662895
tttttcttact

SEQ ID NO: 196062 - DNA, 11 bp, Unknown
  misc_feature (1)..( 11): Result.006 file - promoters50/5662895
accttcttagt

SEQ ID NO: 196063 - DNA, 11 bp, Unknown
  misc_feature (1)..( 11): Result.006 file - promoters50/5662895
atattcttaac

SEQ ID NO: 196064 - DNA, 11 bp, Unknown
  misc_feature (1)..( 11): Result.006 file - promoters50/5662895
atattcgtaac

SEQ ID NO: 196065 - DNA, 11 bp, Unknown
  misc_feature (1)..( 11): Result.006 file - promoters50/5662895
aaaattttgca

SEQ ID NO: 196066 - DNA, 11 bp, Unknown
  misc_feature (1)..( 11): Result.006 file - promoters50/5662895
aaaatttttag

SEQ ID NO: 196067 - DNA, 12 bp, Unknown
  misc_feature (1)..( 12): Result.006 file - promoters50/5662895
tatattcttaac

SEQ ID NO: 196068 - DNA, 12 bp, Unknown
  misc_feature (1)..( 12): Result.006 file - promoters50/5662895
aatattcgtaac

SEQ ID NO: 196069 - DNA, 7 bp, Unknown
  misc_feature (1)..( 7): Result.006 file - promoters50/5662895
ataaaaa

SEQ ID NO: 196070 - DNA, 7 bp, Unknown
  misc_feature (1)..( 7): Result.006 file - promoters50/5662895
ataaaaa

SEQ ID NO: 196071 - DNA, 8 bp, Unknown
  misc_feature (1)..( 8): Result.006 file - promoters50/5662895
gtaacaaa

SEQ ID NO: 196072 - DNA, 8 bp, Unknown
  misc_feature (1)..( 8): Result.006 file - promoters50/5662902
atataaaa

SEQ ID NO: 196073 - DNA, 12 bp, Unknown
  misc_feature (1)..( 12): Result.006 file - promoters50/5662902
tgaagatggacg

SEQ ID NO: 196074 - DNA, 12 bp, Unknown
  misc_feature (1)..( 12): Result.006 file - promoters50/5662902
agaaaatgttct

SEQ ID NO: 196075 - DNA, 12 bp, Unknown
  misc_feature (1)..( 12): Result.006 file - promoters50/5662902
tttagatggatt

SEQ ID NO: 196076 - DNA, 12 bp, Unknown
  misc_feature (1)..( 12): Result.006 file - promoters50/5662902
agaagataataa

SEQ ID NO: 196077 - DNA, 12 bp, Unknown
  misc_feature (1)..( 12): Result.006 file - promoters50/5662902
ttttgatgtgta

SEQ ID NO: 196078 - DNA, 12 bp, Unknown
  misc_feature (1)..( 12): Result.006 file - promoters50/5662906
atttgatactaa

SEQ ID NO: 196079 - DNA, 9 bp, Unknown
  misc_feature (1)..( 9): Result.006 file - promoters50/5662906
taaaagaaa

SEQ ID NO: 196080 - DNA, 9 bp, Unknown
  misc_feature (1)..( 9): Result.006 file - promoters50/5662906
acaaaaaaa

SEQ ID NO: 196081 - DNA, 9 bp, Unknown
  misc_feature (1)..( 9): Result.006 file - promoters50/5662906
acataaaat

SEQ ID NO: 196082 - DNA, 8 bp, Unknown
  misc_feature (1)..( 8): Result.006 file - promoters50/5662906
ataaaaca

SEQ ID NO: 196083 - DNA, 8 bp, Unknown
  misc_feature (1)..( 8): Result.006 file - promoters50/5662906
ataaaatt

SEQ ID NO: 196084 - DNA, 8 bp, Unknown
  misc_feature (1)..( 8): Result.006 file - promoters50/5662910
acaaaaaa

SEQ ID NO: 196085 - DNA, 12 bp, Unknown
  misc_feature (1)..( 12): Result.006 file - promoters50/5662910
gagagagaaaga

SEQ ID NO: 196086 - DNA, 12 bp, Unknown
  misc_feature (1)..( 12): Result.006 file - promoters50/5662910
atatgagaaaat

SEQ ID NO: 196087 - DNA, 12 bp, Unknown
  misc_feature (1)..( 12): Result.006 file - promoters50/5662910
ctgtgaaaaaaa

SEQ ID NO: 196088 - DNA, 12 bp, Unknown
  misc_feature (1)..( 12): Result.006 file - promoters50/5662910
tttttagaaaat

SEQ ID NO: 196089 - DNA, 12 bp, Unknown
  misc_feature (1)..( 12): Result.006 file - promoters50/5662910
ttttgaaaatat

SEQ ID NO: 196090 - DNA, 12 bp, Unknown
  misc_feature (1)..( 12): Result.006 file - promoters50/5662910
taatgttaaatt

SEQ ID NO: 196091 - DNA, 13 bp, Unknown
  misc_feature (1)..( 13): Result.006 file - promoters50/5662910
ttcctaattgtaa

SEQ ID NO: 196092 - DNA, 13 bp, Unknown
  misc_feature (1)..( 13): Result.006 file - promoters50/5662910
aaattaaatgttg

SEQ ID NO: 196093 - DNA, 13 bp, Unknown
  misc_feature (1)..( 13): Result.006 file - promoters50/5662910
aaattaattgata

SEQ ID NO: 196094 - DNA, 13 bp, Unknown
  misc_feature (1)..( 13): Result.006 file - promoters50/5662910
aaattaaatatat

SEQ ID NO: 196095 - DNA, 13 bp, Unknown
  misc_feature (1)..( 13): Result.006 file - promoters50/5662910
cacataaatcaaa

SEQ ID NO: 196096 - DNA, 13 bp, Unknown
  misc_feature (1)..( 13): Result.006 file - promoters50/5662910
gaaaacaatgaaa

SEQ ID NO: 196097 - DNA, 10 bp, Unknown
  misc_feature (1)..( 10): Result.006 file - promoters50/5662910
aagaagatag

SEQ ID NO: 196098 - DNA, 10 bp, Unknown
  misc_feature (1)..( 10): Result.006 file - promoters50/5662910
gtgaaaataa

SEQ ID NO: 196099 - DNA, 10 bp, Unknown
  misc_feature (1)..( 10): Result.006 file - promoters50/5662910
cagaatatat

SEQ ID NO: 196100 - DNA, 10 bp, Unknown
  misc_feature (1)..( 10): Result.006 file - promoters50/5662910
aaaaaaatta

SEQ ID NO: 196101 - DNA, 10 bp, Unknown
  misc_feature (1)..( 10): Result.006 file - promoters50/5662910
ataaatttat

SEQ ID NO: 196102 - DNA, 10 bp, Unknown
  misc_feature (1)..( 10): Result.006 file - promoters50/5662914
ttgaatattt

SEQ ID NO: 196103 - DNA, 10 bp, Unknown
  misc_feature (1)..( 10): Result.006 file - promoters50/5662914
atgaagttga

SEQ ID NO: 196104 - DNA, 10 bp, Unknown
  misc_feature (1)..( 10): Result.006 file - promoters50/5662914
aagaagttga

SEQ ID NO: 196105 - DNA, 10 bp, Unknown
  misc_feature (1)..( 10): Result.006 file - promoters50/5662914
gagaaattga

SEQ ID NO: 196106 - DNA, 10 bp, Unknown
  misc_feature (1)..( 10): Result.006 file - promoters50/5662914
gacaagtagt

SEQ ID NO: 196107 - DNA, 10 bp, Unknown
  misc_feature (1)..( 10): Result.006 file - promoters50/5662914
aagaagtgtg

SEQ ID NO: 196108 - DNA, 10 bp, Unknown
  misc_feature (1)..( 10): Result.006 file - promoters50/5662914
aagaagaaga

SEQ ID NO: 196109 - DNA, 10 bp, Unknown
  misc_feature (1)..( 10): Result.006 file - promoters50/5662914
tttattgaaa

SEQ ID NO: 196110 - DNA, 10 bp, Unknown
  misc_feature (1)..( 10): Result.006 file - promoters50/5662914
tttattacgt

SEQ ID NO: 196111 - DNA, 10 bp, Unknown
  misc_feature (1)..( 10): Result.006 file - promoters50/5662914
tttattaaaa

SEQ ID NO: 196112 - DNA, 10 bp, Unknown
  misc_feature (1)..( 10): Result.006 file - promoters50/5662914
tttagaaaac

SEQ ID NO: 196113 - DNA, 10 bp, Unknown
  misc_feature (1)..( 10): Result.006 file - promoters50/5662914
acaattaaac

SEQ ID NO: 196114 - DNA, 10 bp, Unknown
  misc_feature (1)..( 10): Result.006 file - promoters50/5662921
tattttaaaa

SEQ ID NO: 196115 - DNA, 11 bp, Unknown
  misc_feature (1)..( 11): Result.006 file - promoters50/5662921
ttaatttcaat

SEQ ID NO: 196116 - DNA, 11 bp, Unknown
  misc_feature (1)..( 11): Result.006 file - promoters50/5662921
aaaatttcaaa

SEQ ID NO: 196117 - DNA, 11 bp, Unknown
  misc_feature (1)..( 11): Result.006 file - promoters50/5662921
ctaatttccaa

SEQ ID NO: 196118 - DNA, 11 bp, Unknown
  misc_feature (1)..( 11): Result.006 file - promoters50/5662921
ctattttccaa

SEQ ID NO: 196119 - DNA, 11 bp, Unknown
  misc_feature (1)..( 11): Result.006 file - promoters50/5662921
atcatttcaca

SEQ ID NO: 196120 - DNA, 11 bp, Unknown
  misc_feature (1)..( 11): Result.006 file - promoters50/5662945
ctcattccaaa

SEQ ID NO: 196121 - DNA, 7 bp, Unknown
  misc_feature (1)..( 7): Result.006 file - promoters50/5662945
aattgat

SEQ ID NO: 196122 - DNA, 7 bp, Unknown
  misc_feature (1)..( 7): Result.006 file - promoters50/5662945
aattgag

SEQ ID NO: 196123 - DNA, 7 bp, Unknown
  misc_feature (1)..( 7): Result.006 file - promoters50/5662945
cattgat

SEQ ID NO: 196124 - DNA, 7 bp, Unknown
  misc_feature (1)..( 7): Result.006 file - promoters50/5662945
ccaagat

SEQ ID NO: 196125 - DNA, 7 bp, Unknown
  misc_feature (1)..( 7): Result.006 file - promoters50/5662945
ccaagaa

SEQ ID NO: 196126 - DNA, 7 bp, Unknown
  misc_feature (1)..( 7): Result.006 file - promoters50/5662945
ccaagaa

SEQ ID NO: 196127 - DNA, 8 bp, Unknown
  misc_feature (1)..( 8): Result.006 file - promoters50/5662945
tttgtttg

SEQ ID NO: 196128 - DNA, 8 bp, Unknown
  misc_feature (1)..( 8): Result.006 file - promoters50/5662945
attgtttg

SEQ ID NO: 196129 - DNA, 8 bp, Unknown
  misc_feature (1)..( 8): Result.006 file - promoters50/5662948
attatttg

SEQ ID NO: 196130 - DNA, 17 bp, Unknown
  misc_feature (1)..( 17): Result.006 file - promoters50/5662948
gactattgtggttttgt

SEQ ID NO: 196131 - DNA, 17 bp, Unknown
  misc_feature (1)..( 17): Result.006 file - promoters50/5662948
tgggccgatggttttgt

SEQ ID NO: 196132 - DNA, 17 bp, Unknown
  misc_feature (1)..( 17): Result.006 file - promoters50/5662948
cacagatgtagttggcc

SEQ ID NO: 196133 - DNA, 17 bp, Unknown
  misc_feature (1)..( 17): Result.006 file - promoters50/5662948
atttgatgttgtttgtt

SEQ ID NO: 196134 - DNA, 17 bp, Unknown
  misc_feature (1)..( 17): Result.006 file - promoters50/5662948
aacttatgtcgttggtg

SEQ ID NO: 196135 - DNA, 17 bp, Unknown
  misc_feature (1)..( 17): Result.006 file - promoters50/5662948
tggttgggtagttttat

SEQ ID NO: 196136 - DNA, 17 bp, Unknown
  misc_feature (1)..( 17): Result.006 file - promoters50/5662963
attggatattggttatt

SEQ ID NO: 196137 - DNA, 7 bp, Unknown
  misc_feature (1)..( 7): Result.006 file - promoters50/5662963
tttgtag

SEQ ID NO: 196138 - DNA, 7 bp, Unknown
  misc_feature (1)..( 7): Result.006 file - promoters50/5662963
tttgtat

SEQ ID NO: 196139 - DNA, 7 bp, Unknown
  misc_feature (1)..( 7): Result.006 file - promoters50/5662967
tttgtat

SEQ ID NO: 196140 - DNA, 15 bp, Unknown
  misc_feature (1)..( 15): Result.006 file - promoters50/5662967
gttgttaataaattt

SEQ ID NO: 196141 - DNA, 15 bp, Unknown
  misc_feature (1)..( 15): Result.006 file - promoters50/5662967
tccactaagaaacat

SEQ ID NO: 196142 - DNA, 15 bp, Unknown
  misc_feature (1)..( 15): Result.006 file - promoters50/5662967
gttgataataaagat

SEQ ID NO: 196143 - DNA, 15 bp, Unknown
  misc_feature (1)..( 15): Result.006 file - promoters50/5662967
taaattaacaaaaca

SEQ ID NO: 196144 - DNA, 15 bp, Unknown
  misc_feature (1)..( 15): Result.006 file - promoters50/5662967
aaaaataagaatgtc

SEQ ID NO: 196145 - DNA, 15 bp, Unknown
  misc_feature (1)..( 15): Result.006 file - promoters50/5662967
atagataagacgaag

SEQ ID NO: 196146 - DNA, 15 bp, Unknown
  misc_feature (1)..( 15): Result.006 file - promoters50/5662967
attcgtgacaaaaca

SEQ ID NO: 196147 - DNA, 11 bp, Unknown
  misc_feature (1)..( 11): Result.006 file - promoters50/5662967
aatatattgaa

SEQ ID NO: 196148 - DNA, 11 bp, Unknown
  misc_feature (1)..( 11): Result.006 file - promoters50/5662967
ggtatattatt

SEQ ID NO: 196149 - DNA, 11 bp, Unknown
  misc_feature (1)..( 11): Result.006 file - promoters50/5662967
aatacatttca

SEQ ID NO: 196150 - DNA, 11 bp, Unknown
  misc_feature (1)..( 11): Result.006 file - promoters50/5662967
aatataatatg

SEQ ID NO: 196151 - DNA, 11 bp, Unknown
  misc_feature (1)..( 11): Result.006 file - promoters50/5662967
gataaaatgta

SEQ ID NO: 196152 - DNA, 11 bp, Unknown
  misc_feature (1)..( 11): Result.006 file - promoters50/5662967
cctataatatg

SEQ ID NO: 196153 - DNA, 14 bp, Unknown
  misc_feature (1)..( 14): Result.006 file - promoters50/5662967
ctattaaagtcaca

SEQ ID NO: 196154 - DNA, 14 bp, Unknown
  misc_feature (1)..( 14): Result.006 file - promoters50/5662967
taaacaaaatcaaa

SEQ ID NO: 196155 - DNA, 14 bp, Unknown
  misc_feature (1)..( 14): Result.006 file - promoters50/5662967
caagaaaactcatt

SEQ ID NO: 196156 - DNA, 14 bp, Unknown
  misc_feature (1)..( 14): Result.006 file - promoters50/5662967
aaaaaaaaaacaaa

SEQ ID NO: 196157 - DNA, 14 bp, Unknown
  misc_feature (1)..( 14): Result.006 file - promoters50/5662967
ccaacaaacaacca

SEQ ID NO: 196158 - DNA, 14 bp, Unknown
  misc_feature (1)..( 14): Result.006 file - promoters50/5662967
tcaaaaaaaaaaaa

SEQ ID NO: 196159 - DNA, 10 bp, Unknown
  misc_feature (1)..( 10): Result.006 file - promoters50/5662967
ttataaacac

SEQ ID NO: 196160 - DNA, 10 bp, Unknown
  misc_feature (1)..( 10): Result.006 file - promoters50/5662967
atctaaacac

SEQ ID NO: 196161 - DNA, 10 bp, Unknown
  misc_feature (1)..( 10): Result.006 file - promoters50/5662967
aagtaaacaa

SEQ ID NO: 196162 - DNA, 10 bp, Unknown
  misc_feature (1)..( 10): Result.006 file - promoters50/5662967
aaataaaact

SEQ ID NO: 196163 - DNA, 10 bp, Unknown
  misc_feature (1)..( 10): Result.006 file - promoters50/5662967
aaagaaacgg

SEQ ID NO: 196164 - DNA, 10 bp, Unknown
  misc_feature (1)..( 10): Result.006 file - promoters50/5662967
aaaaaaaaaa

SEQ ID NO: 196165 - DNA, 10 bp, Unknown
  misc_feature (1)..( 10): Result.006 file - promoters50/5662967
aaataacgca

SEQ ID NO: 196166 - DNA, 10 bp, Unknown
  misc_feature (1)..( 10): Result.006 file - promoters50/5662967
taataaaaat

SEQ ID NO: 196167 - DNA, 10 bp, Unknown
  misc_feature (1)..( 10): Result.006 file - promoters50/5662967
cgttaaaaat

SEQ ID NO: 196168 - DNA, 10 bp, Unknown
  misc_feature (1)..( 10): Result.006 file - promoters50/5662967
aaattaaaat

SEQ ID NO: 196169 - DNA, 10 bp, Unknown
  misc_feature (1)..( 10): Result.006 file - promoters50/5662967
agataaaatg

SEQ ID NO: 196170 - DNA, 10 bp, Unknown
  misc_feature (1)..( 10): Result.006 file - promoters50/5662967
aaattaatag

SEQ ID NO: 196171 - DNA, 10 bp, Unknown
  misc_feature (1)..( 10): Result.006 file - promoters50/5662967
cagtaaaaag

SEQ ID NO: 196172 - DNA, 14 bp, Unknown
  misc_feature (1)..( 14): Result.006 file - promoters50/5662967
aaccggtaaactca

SEQ ID NO: 196173 - DNA, 14 bp, Unknown
  misc_feature (1)..( 14): Result.006 file - promoters50/5662967
atttattaaactat

SEQ ID NO: 196174 - DNA, 14 bp, Unknown
  misc_feature (1)..( 14): Result.006 file - promoters50/5662967
tatatataaaacat

SEQ ID NO: 196175 - DNA, 14 bp, Unknown
  misc_feature (1)..( 14): Result.006 file - promoters50/5662967
tttatttattcggg

SEQ ID NO: 196176 - DNA, 14 bp, Unknown
  misc_feature (1)..( 14): Result.006 file - promoters50/5662967
attatatatagaaa

SEQ ID NO: 196177 - DNA, 14 bp, Unknown
  misc_feature (1)..( 14): Result.006 file - promoters50/5662992
gccatataaataga

SEQ ID NO: 196178 - DNA, 12 bp, Unknown
  misc_feature (1)..( 12): Result.006 file - promoters50/5662992
taactaatttaa

SEQ ID NO: 196179 - DNA, 12 bp, Unknown
  misc_feature (1)..( 12): Result.006 file - promoters50/5662992
aaacaaatgtaa

SEQ ID NO: 196180 - DNA, 12 bp, Unknown
  misc_feature (1)..( 12): Result.006 file - promoters50/5662992
ttcacaatttac

SEQ ID NO: 196181 - DNA, 12 bp, Unknown
  misc_feature (1)..( 12): Result.006 file - promoters50/5662992
aaagaaacaata

SEQ ID NO: 196182 - DNA, 9 bp, Unknown
  misc_feature (1)..( 9): Result.006 file - promoters50/5662992
aaagtaact

SEQ ID NO: 196183 - DNA, 9 bp, Unknown
  misc_feature (1)..( 9): Result.006 file - promoters50/5662992
aatgtaact

SEQ ID NO: 196184 - DNA, 9 bp, Unknown
  misc_feature (1)..( 9): Result.006 file - promoters50/5662992
aaagaaaca

SEQ ID NO: 196185 - DNA, 7 bp, Unknown
  misc_feature (1)..( 7): Result.006 file - promoters50/5662992
cgaaaat

SEQ ID NO: 196186 - DNA, 7 bp, Unknown
  misc_feature (1)..( 7): Result.006 file - promoters50/5662992
cgaaaaa

SEQ ID NO: 196187 - DNA, 7 bp, Unknown
  misc_feature (1)..( 7): Result.006 file - promoters50/5662992
tgaaaat

SEQ ID NO: 196188 - DNA, 8 bp, Unknown
  misc_feature (1)..( 8): Result.006 file - promoters50/5662992
gaaaatat

SEQ ID NO: 196189 - DNA, 8 bp, Unknown
  misc_feature (1)..( 8): Result.006 file - promoters50/5662992
caaattat

SEQ ID NO: 196190 - DNA, 8 bp, Unknown
  misc_feature (1)..( 8): Result.006 file - promoters50/5662992
gaaaattt

SEQ ID NO: 196191 - DNA, 7 bp, Unknown
  misc_feature (1)..( 7): Result.006 file - promoters50/5662992
ttatata

SEQ ID NO: 196192 - DNA, 7 bp, Unknown
  misc_feature (1)..( 7): Result.006 file - promoters50/5662992
atatata

SEQ ID NO: 196193 - DNA, 7 bp, Unknown
  misc_feature (1)..( 7): Result.006 file - promoters50/5662992
ttatata

SEQ ID NO: 196194 - DNA, 13 bp, Unknown
  misc_feature (1)..( 13): Result.006 file - promoters50/5662992
taattcgaaataa

SEQ ID NO: 196195 - DNA, 13 bp, Unknown
  misc_feature (1)..( 13): Result.006 file - promoters50/5662992
taattagaaaaaa

SEQ ID NO: 196196 - DNA, 13 bp, Unknown
  misc_feature (1)..( 13): Result.006 file - promoters50/5662992
atcttaaaaaaaa

SEQ ID NO: 196197 - DNA, 8 bp, Unknown
  misc_feature (1)..( 8): Result.006 file - promoters50/5662992
gttttaaa

SEQ ID NO: 196198 - DNA, 8 bp, Unknown
  misc_feature (1)..( 8): Result.006 file - promoters50/5662992
attttaaa

SEQ ID NO: 196199 - DNA, 8 bp, Unknown
  misc_feature (1)..( 8): Result.006 file - promoters50/5662992
attttact

SEQ ID NO: 196200 - DNA, 11 bp, Unknown
  misc_feature (1)..( 11): Result.006 file - promoters50/5662992
atactaactag

SEQ ID NO: 196201 - DNA, 11 bp, Unknown
  misc_feature (1)..( 11): Result.006 file - promoters50/5662992
atattaatatc

SEQ ID NO: 196202 - DNA, 11 bp, Unknown
  misc_feature (1)..( 11): Result.006 file - promoters50/5662992
acattaatatc

SEQ ID NO: 196203 - DNA, 11 bp, Unknown
  misc_feature (1)..( 11): Result.006 file - promoters50/5662992
ttcgaaataat

SEQ ID NO: 196204 - DNA, 11 bp, Unknown
  misc_feature (1)..( 11): Result.006 file - promoters50/5662992
ttaaaaaaaat

SEQ ID NO: 196205 - DNA, 11 bp, Unknown
  misc_feature (1)..( 11): Result.006 file - promoters50/5662992
ttagaaaaaag

SEQ ID NO: 196206 - DNA, 10 bp, Unknown
  misc_feature (1)..( 10): Result.006 file - promoters50/5662992
ttctttttca

SEQ ID NO: 196207 - DNA, 10 bp, Unknown
  misc_feature (1)..( 10): Result.006 file - promoters50/5662992
ttcgtttgat

SEQ ID NO: 196208 - DNA, 10 bp, Unknown
  misc_feature (1)..( 10): Result.006 file - promoters50/5663017
aactttttca

SEQ ID NO: 196209 - DNA, 7 bp, Unknown
  misc_feature (1)..( 7): Result.006 file - promoters50/5663017
catgaag

SEQ ID NO: 196210 - DNA, 7 bp, Unknown
  misc_feature (1)..( 7): Result.006 file - promoters50/5663017
catgaaa

SEQ ID NO: 196211 - DNA, 7 bp, Unknown
  misc_feature (1)..( 7): Result.006 file - promoters50/5663017
catcaag

SEQ ID NO: 196212 - DNA, 9 bp, Unknown
  misc_feature (1)..( 9): Result.006 file - promoters50/5663017
cagaattta

SEQ ID NO: 196213 - DNA, 9 bp, Unknown
  misc_feature (1)..( 9): Result.006 file - promoters50/5663017
accaattta

SEQ ID NO: 196214 - DNA, 9 bp, Unknown
  misc_feature (1)..( 9): Result.006 file - promoters50/5663017
cagacttta

SEQ ID NO: 196215 - DNA, 10 bp, Unknown
  misc_feature (1)..( 10): Result.006 file - promoters50/5663017
gatgatcgaa

SEQ ID NO: 196216 - DNA, 10 bp, Unknown
  misc_feature (1)..( 10): Result.006 file - promoters50/5663017
gcagatggaa

SEQ ID NO: 196217 - DNA, 10 bp, Unknown
  misc_feature (1)..( 10): Result.006 file - promoters50/5663028
tgggattttt

SEQ ID NO: 196218 - DNA, 7 bp, Unknown
  misc_feature (1)..( 7): Result.006 file - promoters50/5663028
tcaaaaa

SEQ ID NO: 196219 - DNA, 7 bp, Unknown
  misc_feature (1)..( 7): Result.006 file - promoters50/5663028
acaaaaa

SEQ ID NO: 196220 - DNA, 7 bp, Unknown
  misc_feature (1)..( 7): Result.006 file - promoters50/5663030
acacaaa

SEQ ID NO: 196221 - DNA, 9 bp, Unknown
  misc_feature (1)..( 9): Result.006 file - promoters50/5663030
gattgcttt

SEQ ID NO: 196222 - DNA, 9 bp, Unknown
  misc_feature (1)..( 9): Result.006 file - promoters50/5663030
gcttgcttt

SEQ ID NO: 196223 - DNA, 9 bp, Unknown
  misc_feature (1)..( 9): Result.006 file - promoters50/5663030
gcttccttc

SEQ ID NO: 196224 - DNA, 9 bp, Unknown
  misc_feature (1)..( 9): Result.006 file - promoters50/5663030
aagaaaatc

SEQ ID NO: 196225 - DNA, 9 bp, Unknown
  misc_feature (1)..( 9): Result.006 file - promoters50/5663030
aagaaaccg

SEQ ID NO: 196226 - DNA, 9 bp, Unknown
  misc_feature (1)..( 9): Result.006 file - promoters50/5663034
tagataccg

SEQ ID NO: 196227 - DNA, 14 bp, Unknown
  misc_feature (1)..( 14): Result.006 file - promoters50/5663034
aactcattttctta

SEQ ID NO: 196228 - DNA, 14 bp, Unknown
  misc_feature (1)..( 14): Result.006 file - promoters50/5663034
ctctctttttatta

SEQ ID NO: 196229 - DNA, 14 bp, Unknown
  misc_feature (1)..( 14): Result.006 file - promoters50/5663034
aactgattgacacg

SEQ ID NO: 196230 - DNA, 10 bp, Unknown
  misc_feature (1)..( 10): Result.006 file - promoters50/5663034
aattttaggt

SEQ ID NO: 196231 - DNA, 10 bp, Unknown
  misc_feature (1)..( 10): Result.006 file - promoters50/5663034
aatcttatct

SEQ ID NO: 196232 - DNA, 10 bp, Unknown
  misc_feature (1)..( 10): Result.006 file - promoters50/5663034
tgtttttggt

SEQ ID NO: 196233 - DNA, 8 bp, Unknown
  misc_feature (1)..( 8): Result.006 file - promoters50/5663034
attttgtt

SEQ ID NO: 196234 - DNA, 8 bp, Unknown
  misc_feature (1)..( 8): Result.006 file - promoters50/5663034
gttttgta

SEQ ID NO: 196235 - DNA, 8 bp, Unknown
  misc_feature (1)..( 8): Result.006 file - promoters50/5663050
attttgtt

SEQ ID NO: 196236 - DNA, 8 bp, Unknown
  misc_feature (1)..( 8): Result.006 file - promoters50/5663050
ctcaaatt

SEQ ID NO: 196237 - DNA, 8 bp, Unknown
  misc_feature (1)..( 8): Result.006 file - promoters50/5663050
ctcacatt

SEQ ID NO: 196238 - DNA, 8 bp, Unknown
  misc_feature (1)..( 8): Result.006 file - promoters50/5663050
aacaaatt

SEQ ID NO: 196239 - DNA, 8 bp, Unknown
  misc_feature (1)..( 8): Result.006 file - promoters50/5663050
atcagatt

SEQ ID NO: 196240 - DNA, 8 bp, Unknown
  misc_feature (1)..( 8): Result.006 file - promoters50/5663050
cttaatta

SEQ ID NO: 196241 - DNA, 8 bp, Unknown
  misc_feature (1)..( 8): Result.006 file - promoters50/5663050
cttattta

SEQ ID NO: 196242 - DNA, 8 bp, Unknown
  misc_feature (1)..( 8): Result.006 file - promoters50/5663050
cttttttc

SEQ ID NO: 196243 - DNA, 7 bp, Unknown
  misc_feature (1)..( 7): Result.006 file - promoters50/5663050
tatttaa

SEQ ID NO: 196244 - DNA, 7 bp, Unknown
  misc_feature (1)..( 7): Result.006 file - promoters50/5663050
tatttat

SEQ ID NO: 196245 - DNA, 7 bp, Unknown
  misc_feature (1)..( 7): Result.006 file - promoters50/5663054
catttat

SEQ ID NO: 196246 - DNA, 9 bp, Unknown
  misc_feature (1)..( 9): Result.006 file - promoters50/5663054
ttcacaaat

SEQ ID NO: 196247 - DNA, 9 bp, Unknown
  misc_feature (1)..( 9): Result.006 file - promoters50/5663054
gcaacaaat

SEQ ID NO: 196248 - DNA, 9 bp, Unknown
  misc_feature (1)..( 9): Result.006 file - promoters50/5663054
ttcacaaaa

SEQ ID NO: 196249 - DNA, 12 bp, Unknown
  misc_feature (1)..( 12): Result.006 file - promoters50/5663054
aaactcactgtt

SEQ ID NO: 196250 - DNA, 12 bp, Unknown
  misc_feature (1)..( 12): Result.006 file - promoters50/5663054
aaattcaaagat

SEQ ID NO: 196251 - DNA, 12 bp, Unknown
  misc_feature (1)..( 12): Result.006 file - promoters50/5663054
ttattcaaagat

SEQ ID NO: 196252 - DNA, 8 bp, Unknown
  misc_feature (1)..( 8): Result.006 file - promoters50/5663054
aaatatga

SEQ ID NO: 196253 - DNA, 8 bp, Unknown
  misc_feature (1)..( 8): Result.006 file - promoters50/5663054
aaagatga

SEQ ID NO: 196254 - DNA, 8 bp, Unknown
  misc_feature (1)..( 8): Result.006 file - promoters50/5663054
aaagattt

SEQ ID NO: 196255 - DNA, 7 bp, Unknown
  misc_feature (1)..( 7): Result.006 file - promoters50/5663054
ttaatta

SEQ ID NO: 196256 - DNA, 7 bp, Unknown
  misc_feature (1)..( 7): Result.006 file - promoters50/5663054
ataatta

SEQ ID NO: 196257 - DNA, 7 bp, Unknown
  misc_feature (1)..( 7): Result.006 file - promoters50/5663054
ttaatta

SEQ ID NO: 196258 - DNA, 7 bp, Unknown
  misc_feature (1)..( 7): Result.006 file - promoters50/5663054
ataattc

SEQ ID NO: 196259 - DNA, 10 bp, Unknown
  misc_feature (1)..( 10): Result.006 file - promoters50/5663054
gatttaaaga

SEQ ID NO: 196260 - DNA, 10 bp, Unknown
  misc_feature (1)..( 10): Result.006 file - promoters50/5663054
gatttatgta

SEQ ID NO: 196261 - DNA, 10 bp, Unknown
  misc_feature (1)..( 10): Result.006 file - promoters50/5663054
aatttctgta

SEQ ID NO: 196262 - DNA, 7 bp, Unknown
  misc_feature (1)..( 7): Result.006 file - promoters50/5663054
ccctatt

SEQ ID NO: 196263 - DNA, 7 bp, Unknown
  misc_feature (1)..( 7): Result.006 file - promoters50/5663054
ccctata

SEQ ID NO: 196264 - DNA, 7 bp, Unknown
  misc_feature (1)..( 7): Result.006 file - promoters50/5663054
gcctata

SEQ ID NO: 196265 - DNA, 11 bp, Unknown
  misc_feature (1)..( 11): Result.006 file - promoters50/5663054
cattatcaaaa

SEQ ID NO: 196266 - DNA, 11 bp, Unknown
  misc_feature (1)..( 11): Result.006 file - promoters50/5663054
cattatgaaat

SEQ ID NO: 196267 - DNA, 11 bp, Unknown
  misc_feature (1)..( 11): Result.006 file - promoters50/5663054
aattagcaaaa

SEQ ID NO: 196268 - DNA, 8 bp, Unknown
  misc_feature (1)..( 8): Result.006 file - promoters50/5663054
tttaacat

SEQ ID NO: 196269 - DNA, 8 bp, Unknown
  misc_feature (1)..( 8): Result.006 file - promoters50/5663054
ttttacag

SEQ ID NO: 196270 - DNA, 8 bp, Unknown
  misc_feature (1)..( 8): Result.006 file - promoters50/5663054
ctttccag

SEQ ID NO: 196271 - DNA, 10 bp, Unknown
  misc_feature (1)..( 10): Result.006 file - promoters50/5663054
aacattcaaa

SEQ ID NO: 196272 - DNA, 10 bp, Unknown
  misc_feature (1)..( 10): Result.006 file - promoters50/5663054
gttattaaaa

SEQ ID NO: 196273 - DNA, 10 bp, Unknown
  misc_feature (1)..( 10): Result.006 file - promoters50/5663054
aactttcacg

SEQ ID NO: 196274 - DNA, 9 bp, Unknown
  misc_feature (1)..( 9): Result.006 file - promoters50/5663054
tctataaaa

SEQ ID NO: 196275 - DNA, 9 bp, Unknown
  misc_feature (1)..( 9): Result.006 file - promoters50/5663054
cctataaaa

SEQ ID NO: 196276 - DNA, 9 bp, Unknown
  misc_feature (1)..( 9): Result.006 file - promoters50/5663061
cctatatta

SEQ ID NO: 196277 - DNA, 12 bp, Unknown
  misc_feature (1)..( 12): Result.006 file - promoters50/5663061
gagttcttcaca

SEQ ID NO: 196278 - DNA, 12 bp, Unknown
  misc_feature (1)..( 12): Result.006 file - promoters50/5663061
gagtttttctgt

SEQ ID NO: 196279 - DNA, 12 bp, Unknown
  misc_feature (1)..( 12): Result.006 file - promoters50/5663069
cttatctccaca

SEQ ID NO: 196280 - DNA, 11 bp, Unknown
  misc_feature (1)..( 11): Result.006 file - promoters50/5663069
ttttcgaaaaa

SEQ ID NO: 196281 - DNA, 11 bp, Unknown
  misc_feature (1)..( 11): Result.006 file - promoters50/5663069
ttttcgaaaaa

SEQ ID NO: 196282 - DNA, 11 bp, Unknown
  misc_feature (1)..( 11): Result.006 file - promoters50/5663069
ctttcgacatt

SEQ ID NO: 196283 - DNA, 10 bp, Unknown
  misc_feature (1)..( 10): Result.006 file - promoters50/5663069
gtccaaaaat

SEQ ID NO: 196284 - DNA, 10 bp, Unknown
  misc_feature (1)..( 10): Result.006 file - promoters50/5663069
gtctaaaaac

SEQ ID NO: 196285 - DNA, 10 bp, Unknown
  misc_feature (1)..( 10): Result.006 file - promoters50/5663093
ataaaaaaat

SEQ ID NO: 196286 - DNA, 12 bp, Unknown
  misc_feature (1)..( 12): Result.006 file - promoters50/5663093
gtttatcaacct

SEQ ID NO: 196287 - DNA, 12 bp, Unknown
  misc_feature (1)..( 12): Result.006 file - promoters50/5663093
gttgatctttca

SEQ ID NO: 196288 - DNA, 12 bp, Unknown
  misc_feature (1)..( 12): Result.006 file - promoters50/5663093
attgatgtttca

SEQ ID NO: 196289 - DNA, 7 bp, Unknown
  misc_feature (1)..( 7): Result.006 file - promoters50/5663093
aaagttg

SEQ ID NO: 196290 - DNA, 7 bp, Unknown
  misc_feature (1)..( 7): Result.006 file - promoters50/5663093
aaagtta

SEQ ID NO: 196291 - DNA, 7 bp, Unknown
  misc_feature (1)..( 7): Result.006 file - promoters50/5663093
aaatttg

SEQ ID NO: 196292 - DNA, 8 bp, Unknown
  misc_feature (1)..( 8): Result.006 file - promoters50/5663093
gttactta

SEQ ID NO: 196293 - DNA, 8 bp, Unknown
  misc_feature (1)..( 8): Result.006 file - promoters50/5663093
attacttg

SEQ ID NO: 196294 - DNA, 8 bp, Unknown
  misc_feature (1)..( 8): Result.006 file - promoters50/5663093
attccttg

SEQ ID NO: 196295 - DNA, 10 bp, Unknown
  misc_feature (1)..( 10): Result.006 file - promoters50/5663093
atttatggtt

SEQ ID NO: 196296 - DNA, 10 bp, Unknown
  misc_feature (1)..( 10): Result.006 file - promoters50/5663093
atttatgtgt

SEQ ID NO: 196297 - DNA, 10 bp, Unknown
  misc_feature (1)..( 10): Result.006 file - promoters50/5663093
aattaagtgt

SEQ ID NO: 196298 - DNA, 7 bp, Unknown
  misc_feature (1)..( 7): Result.006 file - promoters50/5663093
tgacaat

SEQ ID NO: 196299 - DNA, 7 bp, Unknown
  misc_feature (1)..( 7): Result.006 file - promoters50/5663093
tgaaaat

SEQ ID NO: 196300 - DNA, 7 bp, Unknown
  misc_feature (1)..( 7): Result.006 file - promoters50/5663093
ggaaaat

SEQ ID NO: 196301 - DNA, 12 bp, Unknown
  misc_feature (1)..( 12): Result.006 file - promoters50/5663093
ttaagagtacac

SEQ ID NO: 196302 - DNA, 12 bp, Unknown
  misc_feature (1)..( 12): Result.006 file - promoters50/5663093
ttaagtgtaaac

SEQ ID NO: 196303 - DNA, 12 bp, Unknown
  misc_feature (1)..( 12): Result.006 file - promoters50/5663093
accggtggaaac

SEQ ID NO: 196304 - DNA, 12 bp, Unknown
  misc_feature (1)..( 12): Result.006 file - promoters50/5663093
ttatgtgtcttc

SEQ ID NO: 196305 - DNA, 7 bp, Unknown
  misc_feature (1)..( 7): Result.006 file - promoters50/5663093
atgatgt

SEQ ID NO: 196306 - DNA, 7 bp, Unknown
  misc_feature (1)..( 7): Result.006 file - promoters50/5663093
atgatgc

SEQ ID NO: 196307 - DNA, 7 bp, Unknown
  misc_feature (1)..( 7): Result.006 file - promoters50/5663093
ttgatgt

SEQ ID NO: 196308 - DNA, 8 bp, Unknown
  misc_feature (1)..( 8): Result.006 file - promoters50/5663093
tgggattt

SEQ ID NO: 196309 - DNA, 8 bp, Unknown
  misc_feature (1)..( 8): Result.006 file - promoters50/5663093
tggaattg

SEQ ID NO: 196310 - DNA, 8 bp, Unknown
  misc_feature (1)..( 8): Result.006 file - promoters50/5663093
tgggcttt

SEQ ID NO: 196311 - DNA, 7 bp, Unknown
  misc_feature (1)..( 7): Result.006 file - promoters50/5663093
acattgc

SEQ ID NO: 196312 - DNA, 7 bp, Unknown
  misc_feature (1)..( 7): Result.006 file - promoters50/5663093
ccattgc

SEQ ID NO: 196313 - DNA, 7 bp, Unknown
  misc_feature (1)..( 7): Result.006 file - promoters50/5663097
acattga

SEQ ID NO: 196314 - DNA, 7 bp, Unknown
  misc_feature (1)..( 7): Result.006 file - promoters50/5663097
ataaact

SEQ ID NO: 196315 - DNA, 7 bp, Unknown
  misc_feature (1)..( 7): Result.006 file - promoters50/5663097
ataaacg

SEQ ID NO: 196316 - DNA, 7 bp, Unknown
  misc_feature (1)..( 7): Result.006 file - promoters50/5663097
ataaaaa

SEQ ID NO: 196317 - DNA, 15 bp, Unknown
  misc_feature (1)..( 15): Result.006 file - promoters50/5663097
ctcctatatataaag

SEQ ID NO: 196318 - DNA, 15 bp, Unknown
  misc_feature (1)..( 15): Result.006 file - promoters50/5663097
aacgtatatataaag

SEQ ID NO: 196319 - DNA, 15 bp, Unknown
  misc_feature (1)..( 15): Result.006 file - promoters50/5663116
ctcatataaatacat

SEQ ID NO: 196320 - DNA, 13 bp, Unknown
  misc_feature (1)..( 13): Result.006 file - promoters50/5663116
ttttcattttatc

SEQ ID NO: 196321 - DNA, 13 bp, Unknown
  misc_feature (1)..( 13): Result.006 file - promoters50/5663116
cattcgtttagtc

SEQ ID NO: 196322 - DNA, 13 bp, Unknown
  misc_feature (1)..( 13): Result.006 file - promoters50/5663116
cattagtttcctg

SEQ ID NO: 196323 - DNA, 13 bp, Unknown
  misc_feature (1)..( 13): Result.006 file - promoters50/5663116
cccaagtgtccta

SEQ ID NO: 196324 - DNA, 11 bp, Unknown
  misc_feature (1)..( 11): Result.006 file - promoters50/5663116
ttaatttcctg

SEQ ID NO: 196325 - DNA, 13 bp, Unknown
  misc_feature (1)..( 13): Result.006 file - promoters50/5663116
atttactttggaa

SEQ ID NO: 196326 - DNA, 11 bp, Unknown
  misc_feature (1)..( 11): Result.006 file - promoters50/5663116
tttaattaatt

SEQ ID NO: 196327 - DNA, 11 bp, Unknown
  misc_feature (1)..( 11): Result.006 file - promoters50/5663116
ttaaatgaata

SEQ ID NO: 196328 - DNA, 11 bp, Unknown
  misc_feature (1)..( 11): Result.006 file - promoters50/5663116
tgtaatttatt

SEQ ID NO: 196329 - DNA, 11 bp, Unknown
  misc_feature (1)..( 11): Result.006 file - promoters50/5663116
actaattatgt

SEQ ID NO: 196330 - DNA, 11 bp, Unknown
  misc_feature (1)..( 11): Result.006 file - promoters50/5663116
ttttattattc

SEQ ID NO: 196331 - DNA, 11 bp, Unknown
  misc_feature (1)..( 11): Result.006 file - promoters50/5663116
cataattttat

SEQ ID NO: 196332 - DNA, 14 bp, Unknown
  misc_feature (1)..( 14): Result.006 file - promoters50/5663116
ccaaatttatggtt

SEQ ID NO: 196333 - DNA, 14 bp, Unknown
  misc_feature (1)..( 14): Result.006 file - promoters50/5663116
tgagatttatgttg

SEQ ID NO: 196334 - DNA, 14 bp, Unknown
  misc_feature (1)..( 14): Result.006 file - promoters50/5663116
agaattttctggtt

SEQ ID NO: 196335 - DNA, 14 bp, Unknown
  misc_feature (1)..( 14): Result.006 file - promoters50/5663116
ttaaatttacgctc

SEQ ID NO: 196336 - DNA, 14 bp, Unknown
  misc_feature (1)..( 14): Result.006 file - promoters50/5663116
aaagatgtatatca

SEQ ID NO: 196337 - DNA, 14 bp, Unknown
  misc_feature (1)..( 14): Result.006 file - promoters50/5663134
aaaaatgacaactt

SEQ ID NO: 196338 - DNA, 10 bp, Unknown
  misc_feature (1)..( 10): Result.006 file - promoters50/5663134
ttaaaataaa

SEQ ID NO: 196339 - DNA, 10 bp, Unknown
  misc_feature (1)..( 10): Result.006 file - promoters50/5663134
agaaaataaa

SEQ ID NO: 196340 - DNA, 10 bp, Unknown
  misc_feature (1)..( 10): Result.006 file - promoters50/5663138
ttataatagc

SEQ ID NO: 196341 - DNA, 14 bp, Unknown
  misc_feature (1)..( 14): Result.006 file - promoters50/5663138
acatcagaaaagat

SEQ ID NO: 196342 - DNA, 14 bp, Unknown
  misc_feature (1)..( 14): Result.006 file - promoters50/5663138
tttttctaaaagat

SEQ ID NO: 196343 - DNA, 14 bp, Unknown
  misc_feature (1)..( 14): Result.006 file - promoters50/5663138
tctactcaaaagag

SEQ ID NO: 196344 - DNA, 14 bp, Unknown
  misc_feature (1)..( 14): Result.006 file - promoters50/5663138
atcaggaaaaagaa

SEQ ID NO: 196345 - DNA, 14 bp, Unknown
  misc_feature (1)..( 14): Result.006 file - promoters50/5663138
gctaaacaaaaact

SEQ ID NO: 196346 - DNA, 14 bp, Unknown
  misc_feature (1)..( 14): Result.006 file - promoters50/5663138
gaaaaacaaaatgg

SEQ ID NO: 196347 - DNA, 16 bp, Unknown
  misc_feature (1)..( 16): Result.006 file - promoters50/5663138
gcaatttaatattcat

SEQ ID NO: 196348 - DNA, 16 bp, Unknown
  misc_feature (1)..( 16): Result.006 file - promoters50/5663138
ttgaatcaatatttta

SEQ ID NO: 196349 - DNA, 16 bp, Unknown
  misc_feature (1)..( 16): Result.006 file - promoters50/5663138
aggctataacattacc

SEQ ID NO: 196350 - DNA, 16 bp, Unknown
  misc_feature (1)..( 16): Result.006 file - promoters50/5663138
ttgattcaaaattctc

SEQ ID NO: 196351 - DNA, 16 bp, Unknown
  misc_feature (1)..( 16): Result.006 file - promoters50/5663138
cagacttaaaatctac

SEQ ID NO: 196352 - DNA, 16 bp, Unknown
  misc_feature (1)..( 16): Result.006 file - promoters50/5663142
tatatgtaatatcatt

SEQ ID NO: 196353 - DNA, 8 bp, Unknown
  misc_feature (1)..( 8): Result.006 file - promoters50/5663142
gaataatg

SEQ ID NO: 196354 - DNA, 8 bp, Unknown
  misc_feature (1)..( 8): Result.006 file - promoters50/5663142
taatgatg

SEQ ID NO: 196355 - DNA, 8 bp, Unknown
  misc_feature (1)..( 8): Result.006 file - promoters50/5663142
taatgacg

SEQ ID NO: 196356 - DNA, 8 bp, Unknown
  misc_feature (1)..( 8): Result.006 file - promoters50/5663142
aaataatt

SEQ ID NO: 196357 - DNA, 8 bp, Unknown
  misc_feature (1)..( 8): Result.006 file - promoters50/5663142
aaataacc

SEQ ID NO: 196358 - DNA, 8 bp, Unknown
  misc_feature (1)..( 8): Result.006 file - promoters50/5663142
aaataaaa

SEQ ID NO: 196359 - DNA, 11 bp, Unknown
  misc_feature (1)..( 11): Result.006 file - promoters50/5663142
tcatataacaa

SEQ ID NO: 196360 - DNA, 11 bp, Unknown
  misc_feature (1)..( 11): Result.006 file - promoters50/5663142
atatataataa

SEQ ID NO: 196361 - DNA, 11 bp, Unknown
  misc_feature (1)..( 11): Result.006 file - promoters50/5663142
tcatataatta

SEQ ID NO: 196362 - DNA, 11 bp, Unknown
  misc_feature (1)..( 11): Result.006 file - promoters50/5663142
tcaaatatggt

SEQ ID NO: 196363 - DNA, 11 bp, Unknown
  misc_feature (1)..( 11): Result.006 file - promoters50/5663142
aaaaataaata

SEQ ID NO: 196364 - DNA, 11 bp, Unknown
  misc_feature (1)..( 11): Result.006 file - promoters50/5663142
cagaataaaaa

SEQ ID NO: 196365 - DNA, 14 bp, Unknown
  misc_feature (1)..( 14): Result.006 file - promoters50/5663142
taaaataaggaatt

SEQ ID NO: 196366 - DNA, 14 bp, Unknown
  misc_feature (1)..( 14): Result.006 file - promoters50/5663142
acttataatgaatt

SEQ ID NO: 196367 - DNA, 14 bp, Unknown
  misc_feature (1)..( 14): Result.006 file - promoters50/5663142
actcataataaata

SEQ ID NO: 196368 - DNA, 14 bp, Unknown
  misc_feature (1)..( 14): Result.006 file - promoters50/5663142
tcatataatagtaa

SEQ ID NO: 196369 - DNA, 14 bp, Unknown
  misc_feature (1)..( 14): Result.006 file - promoters50/5663142
atttataatataat

SEQ ID NO: 196370 - DNA, 14 bp, Unknown
  misc_feature (1)..( 14): Result.006 file - promoters50/5663142
tcttttaattttct

SEQ ID NO: 196371 - DNA, 10 bp, Unknown
  misc_feature (1)..( 10): Result.006 file - promoters50/5663142
ataataaata

SEQ ID NO: 196372 - DNA, 10 bp, Unknown
  misc_feature (1)..( 10): Result.006 file - promoters50/5663142
ataaaaaata

SEQ ID NO: 196373 - DNA, 10 bp, Unknown
  misc_feature (1)..( 10): Result.006 file - promoters50/5663142
ttaataacaa

SEQ ID NO: 196374 - DNA, 10 bp, Unknown
  misc_feature (1)..( 10): Result.006 file - promoters50/5663142
caaataacca

SEQ ID NO: 196375 - DNA, 10 bp, Unknown
  misc_feature (1)..( 10): Result.006 file - promoters50/5663142
aaaatataat

SEQ ID NO: 196376 - DNA, 10 bp, Unknown
  misc_feature (1)..( 10): Result.006 file - promoters50/5663148
ggaaaaaatg

SEQ ID NO: 196377 - DNA, 10 bp, Unknown
  misc_feature (1)..( 10): Result.006 file - promoters50/5663148
tataagtgtt

SEQ ID NO: 196378 - DNA, 10 bp, Unknown
  misc_feature (1)..( 10): Result.006 file - promoters50/5663148
aagaagagtt

SEQ ID NO: 196379 - DNA, 10 bp, Unknown
  misc_feature (1)..( 10): Result.006 file - promoters50/5663148
tattagtgtt

SEQ ID NO: 196380 - DNA, 9 bp, Unknown
  misc_feature (1)..( 9): Result.006 file - promoters50/5663148
tctctaata

SEQ ID NO: 196381 - DNA, 9 bp, Unknown
  misc_feature (1)..( 9): Result.006 file - promoters50/5663148
tctcttata

SEQ ID NO: 196382 - DNA, 9 bp, Unknown
  misc_feature (1)..( 9): Result.006 file - promoters50/5663148
tatcttata

SEQ ID NO: 196383 - DNA, 8 bp, Unknown
  misc_feature (1)..( 8): Result.006 file - promoters50/5663148
tttatgca

SEQ ID NO: 196384 - DNA, 8 bp, Unknown
  misc_feature (1)..( 8): Result.006 file - promoters50/5663148
attaggca

SEQ ID NO: 196385 - DNA, 8 bp, Unknown
  misc_feature (1)..( 8): Result.006 file - promoters50/5663148
tttatggg

SEQ ID NO: 196386 - DNA, 10 bp, Unknown
  misc_feature (1)..( 10): Result.006 file - promoters50/5663148
caggtttatg

SEQ ID NO: 196387 - DNA, 10 bp, Unknown
  misc_feature (1)..( 10): Result.006 file - promoters50/5663148
cagatttatt

SEQ ID NO: 196388 - DNA, 10 bp, Unknown
  misc_feature (1)..( 10): Result.006 file - promoters50/5663151
tttctttatt

SEQ ID NO: 196389 - DNA, 10 bp, Unknown
  misc_feature (1)..( 10): Result.006 file - promoters50/5663151
aagaaatgat

SEQ ID NO: 196390 - DNA, 10 bp, Unknown
  misc_feature (1)..( 10): Result.006 file - promoters50/5663151
aagaaacgaa

SEQ ID NO: 196391 - DNA, 10 bp, Unknown
  misc_feature (1)..( 10): Result.006 file - promoters50/5663151
tagatatgat

SEQ ID NO: 196392 - DNA, 9 bp, Unknown
  misc_feature (1)..( 9): Result.006 file - promoters50/5663151
aaaacgcaa

SEQ ID NO: 196393 - DNA, 9 bp, Unknown
  misc_feature (1)..( 9): Result.006 file - promoters50/5663151
caaacccaa

SEQ ID NO: 196394 - DNA, 9 bp, Unknown
  misc_feature (1)..( 9): Result.006 file - promoters50/5663154
caaacctga

SEQ ID NO: 196395 - DNA, 11 bp, Unknown
  misc_feature (1)..( 11): Result.006 file - promoters50/5663154
ttttacttatt

SEQ ID NO: 196396 - DNA, 11 bp, Unknown
  misc_feature (1)..( 11): Result.006 file - promoters50/5663154
cttttctttgc

SEQ ID NO: 196397 - DNA, 11 bp, Unknown
  misc_feature (1)..( 11): Result.006 file - promoters50/5663154
ttttcctttat

SEQ ID NO: 196398 - DNA, 11 bp, Unknown
  misc_feature (1)..( 11): Result.006 file - promoters50/5663154
aactacatatt

SEQ ID NO: 196399 - DNA, 11 bp, Unknown
  misc_feature (1)..( 11): Result.006 file - promoters50/5663154
ataaacatatt

SEQ ID NO: 196400 - DNA, 11 bp, Unknown
  misc_feature (1)..( 11): Result.006 file - promoters50/5663154
ccaaaaataag

SEQ ID NO: 196401 - DNA, 10 bp, Unknown
  misc_feature (1)..( 10): Result.006 file - promoters50/5663154
ggatataatg

SEQ ID NO: 196402 - DNA, 10 bp, Unknown
  misc_feature (1)..( 10): Result.006 file - promoters50/5663154
aaatataaat

SEQ ID NO: 196403 - DNA, 10 bp, Unknown
  misc_feature (1)..( 10): Result.006 file - promoters50/5663154
aaagataaca

SEQ ID NO: 196404 - DNA, 11 bp, Unknown
  misc_feature (1)..( 11): Result.006 file - promoters50/5663154
ctttattaata

SEQ ID NO: 196405 - DNA, 11 bp, Unknown
  misc_feature (1)..( 11): Result.006 file - promoters50/5663154
acatgataact

SEQ ID NO: 196406 - DNA, 11 bp, Unknown
  misc_feature (1)..( 11): Result.006 file - promoters50/5663154
ttttcttaaac

SEQ ID NO: 196407 - DNA, 12 bp, Unknown
  misc_feature (1)..( 12): Result.006 file - promoters50/5663154
aaatgtgtgtac

SEQ ID NO: 196408 - DNA, 12 bp, Unknown
  misc_feature (1)..( 12): Result.006 file - promoters50/5663154
aaatgtttgttt

SEQ ID NO: 196409 - DNA, 12 bp, Unknown
  misc_feature (1)..( 12): Result.006 file - promoters50/5663154
gaatctttaaaa

SEQ ID NO: 196410 - DNA, 12 bp, Unknown
  misc_feature (1)..( 12): Result.006 file - promoters50/5663154
aaatttttaata

SEQ ID NO: 196411 - DNA, 12 bp, Unknown
  misc_feature (1)..( 12): Result.006 file - promoters50/5663154
acacttttgttt

SEQ ID NO: 196412 - DNA, 12 bp, Unknown
  misc_feature (1)..( 12): Result.006 file - promoters50/5663154
aattgtttaacg

SEQ ID NO: 196413 - DNA, 10 bp, Unknown
  misc_feature (1)..( 10): Result.006 file - promoters50/5663154
taattctttt

SEQ ID NO: 196414 - DNA, 10 bp, Unknown
  misc_feature (1)..( 10): Result.006 file - promoters50/5663154
gtattttttt

SEQ ID NO: 196415 - DNA, 10 bp, Unknown
  misc_feature (1)..( 10): Result.006 file - promoters50/5663154
atattttttt

SEQ ID NO: 196416 - DNA, 10 bp, Unknown
  misc_feature (1)..( 10): Result.006 file - promoters50/5663154
gaattcttta

SEQ ID NO: 196417 - DNA, 10 bp, Unknown
  misc_feature (1)..( 10): Result.006 file - promoters50/5663154
taattatttt

SEQ ID NO: 196418 - DNA, 10 bp, Unknown
  misc_feature (1)..( 10): Result.006 file - promoters50/5663162
atattattag

SEQ ID NO: 196419 - DNA, 8 bp, Unknown
  misc_feature (1)..( 8): Result.006 file - promoters50/5663162
ctcaatat

SEQ ID NO: 196420 - DNA, 8 bp, Unknown
  misc_feature (1)..( 8): Result.006 file - promoters50/5663162
ctcattat

SEQ ID NO: 196421 - DNA, 7 bp, Unknown
  misc_feature (1)..( 7): Result.006 file - promoters50/5663162
tcagtat

SEQ ID NO: 196422 - DNA, 12 bp, Unknown
  misc_feature (1)..( 12): Result.006 file - promoters50/5663162
taattaaaatta

SEQ ID NO: 196423 - DNA, 12 bp, Unknown
  misc_feature (1)..( 12): Result.006 file - promoters50/5663162
taatgaaagtta

SEQ ID NO: 196424 - DNA, 12 bp, Unknown
  misc_feature (1)..( 12): Result.006 file - promoters50/5663162
ttattcaaactt

SEQ ID NO: 196425 - DNA, 8 bp, Unknown
  misc_feature (1)..( 8): Result.006 file - promoters50/5663162
aaatctat

SEQ ID NO: 196426 - DNA, 8 bp, Unknown
  misc_feature (1)..( 8): Result.006 file - promoters50/5663162
aaatcttg

SEQ ID NO: 196427 - DNA, 8 bp, Unknown
  misc_feature (1)..( 8): Result.006 file - promoters50/5663162
aaagctat

SEQ ID NO: 196428 - DNA, 10 bp, Unknown
  misc_feature (1)..( 10): Result.006 file - promoters50/5663162
tcaaaaaaac

SEQ ID NO: 196429 - DNA, 10 bp, Unknown
  misc_feature (1)..( 10): Result.006 file - promoters50/5663162
ttaaaataac

SEQ ID NO: 196430 - DNA, 10 bp, Unknown
  misc_feature (1)..( 10): Result.006 file - promoters50/5663162
ttaagatata

SEQ ID NO: 196431 - DNA, 7 bp, Unknown
  misc_feature (1)..( 7): Result.006 file - promoters50/5663162
ttaaaaa

SEQ ID NO: 196432 - DNA, 7 bp, Unknown
  misc_feature (1)..( 7): Result.006 file - promoters50/5663162
ttaaaat

SEQ ID NO: 196433 - DNA, 7 bp, Unknown
  misc_feature (1)..( 7): Result.006 file - promoters50/5663162
ataaaaa

SEQ ID NO: 196434 - DNA, 7 bp, Unknown
  misc_feature (1)..( 7): Result.006 file - promoters50/5663162
tattaaa

SEQ ID NO: 196435 - DNA, 7 bp, Unknown
  misc_feature (1)..( 7): Result.006 file - promoters50/5663162
aattaaa

SEQ ID NO: 196436 - DNA, 7 bp, Unknown
  misc_feature (1)..( 7): Result.006 file - promoters50/5663170
aattaat

SEQ ID NO: 196437 - DNA, 10 bp, Unknown
  misc_feature (1)..( 10): Result.006 file - promoters50/5663170
ataagaataa

SEQ ID NO: 196438 - DNA, 10 bp, Unknown
  misc_feature (1)..( 10): Result.006 file - promoters50/5663170
ataacaataa

SEQ ID NO: 196439 - DNA, 10 bp, Unknown
  misc_feature (1)..( 10): Result.006 file - promoters50/5663170
ctaagcatat

SEQ ID NO: 196440 - DNA, 7 bp, Unknown
  misc_feature (1)..( 7): Result.006 file - promoters50/5663170
taaataa

SEQ ID NO: 196441 - DNA, 7 bp, Unknown
  misc_feature (1)..( 7): Result.006 file - promoters50/5663170
taagtaa

SEQ ID NO: 196442 - DNA, 7 bp, Unknown
  misc_feature (1)..( 7): Result.006 file - promoters50/5663170
taactaa

SEQ ID NO: 196443 - DNA, 9 bp, Unknown
  misc_feature (1)..( 9): Result.006 file - promoters50/5663170
aagagttta

SEQ ID NO: 196444 - DNA, 9 bp, Unknown
  misc_feature (1)..( 9): Result.006 file - promoters50/5663170
aagaattta

SEQ ID NO: 196445 - DNA, 9 bp, Unknown
  misc_feature (1)..( 9): Result.006 file - promoters50/5663174
attaattca

SEQ ID NO: 196446 - DNA, 7 bp, Unknown
  misc_feature (1)..( 7): Result.006 file - promoters50/5663174
aaacgat

SEQ ID NO: 196447 - DNA, 7 bp, Unknown
  misc_feature (1)..( 7): Result.006 file - promoters50/5663174
aaaagat

SEQ ID NO: 196448 - DNA, 7 bp, Unknown
  misc_feature (1)..( 7): Result.006 file - promoters50/5663182
caaagat

SEQ ID NO: 196449 - DNA, 9 bp, Unknown
  misc_feature (1)..( 9): Result.006 file - promoters50/5663182
aaaatgtaa

SEQ ID NO: 196450 - DNA, 9 bp, Unknown
  misc_feature (1)..( 9): Result.006 file - promoters50/5663182
tgaatctaa

SEQ ID NO: 196451 - DNA, 10 bp, Unknown
  misc_feature (1)..( 10): Result.006 file - promoters50/5663182
aaaattgttg

SEQ ID NO: 196452 - DNA, 8 bp, Unknown
  misc_feature (1)..( 8): Result.006 file - promoters50/5663182
aaaaaaaa

SEQ ID NO: 196453 - DNA, 8 bp, Unknown
  misc_feature (1)..( 8): Result.006 file - promoters50/5663182
aaataaat

SEQ ID NO: 196454 - DNA, 8 bp, Unknown
  misc_feature (1)..( 8): Result.006 file - promoters50/5663182
tcataaat

SEQ ID NO: 196455 - DNA, 6 bp, Unknown
  misc_feature (1)..( 6): Result.006 file - promoters50/5663182
ataaat

SEQ ID NO: 196456 - DNA, 6 bp, Unknown
  misc_feature (1)..( 6): Result.006 file - promoters50/5663182
ataaat

SEQ ID NO: 196457 - DNA, 6 bp, Unknown
  misc_feature (1)..( 6): Result.006 file - promoters50/5663182
ataaat

SEQ ID NO: 196458 - DNA, 9 bp, Unknown
  misc_feature (1)..( 9): Result.006 file - promoters50/5663182
ttttggttt

SEQ ID NO: 196459 - DNA, 9 bp, Unknown
  misc_feature (1)..( 9): Result.006 file - promoters50/5663182
tttcggttc

SEQ ID NO: 196460 - DNA, 9 bp, Unknown
  misc_feature (1)..( 9): Result.006 file - promoters50/5663186
cgtcgattc

SEQ ID NO: 196461 - DNA, 8 bp, Unknown
  misc_feature (1)..( 8): Result.006 file - promoters50/5663186
ataaatac

SEQ ID NO: 196462 - DNA, 8 bp, Unknown
  misc_feature (1)..( 8): Result.006 file - promoters50/5663186
caaaatac

SEQ ID NO: 196463 - DNA, 8 bp, Unknown
  misc_feature (1)..( 8): Result.006 file - promoters50/5663197
ataaatag

SEQ ID NO: 196464 - DNA, 9 bp, Unknown
  misc_feature (1)..( 9): Result.006 file - promoters50/5663197
ccggtgatg

SEQ ID NO: 196465 - DNA, 9 bp, Unknown
  misc_feature (1)..( 9): Result.006 file - promoters50/5663197
gaggtgatg

SEQ ID NO: 196466 - DNA, 9 bp, Unknown
  misc_feature (1)..( 9): Result.006 file - promoters50/5663197
gagctgagg

SEQ ID NO: 196467 - DNA, 7 bp, Unknown
  misc_feature (1)..( 7): Result.006 file - promoters50/5663197
gaagaag

SEQ ID NO: 196468 - DNA, 7 bp, Unknown
  misc_feature (1)..( 7): Result.006 file - promoters50/5663197
gaacaag

SEQ ID NO: 196469 - DNA, 7 bp, Unknown
  misc_feature (1)..( 7): Result.006 file - promoters50/5663197
gaagaaa

SEQ ID NO: 196470 - DNA, 10 bp, Unknown
  misc_feature (1)..( 10): Result.006 file - promoters50/5663197
ttttccctct

SEQ ID NO: 196471 - DNA, 10 bp, Unknown
  misc_feature (1)..( 10): Result.006 file - promoters50/5663197
ctttccttct

SEQ ID NO: 196472 - DNA, 10 bp, Unknown
  misc_feature (1)..( 10): Result.006 file - promoters50/5663221
ctttcctgtt

SEQ ID NO: 196473 - DNA, 12 bp, Unknown
  misc_feature (1)..( 12): Result.006 file - promoters50/5663221
tttagacccgac

SEQ ID NO: 196474 - DNA, 12 bp, Unknown
  misc_feature (1)..( 12): Result.006 file - promoters50/5663221
ataagacccgtt

SEQ ID NO: 196475 - DNA, 12 bp, Unknown
  misc_feature (1)..( 12): Result.006 file - promoters50/5663221
tttaggcccaca

SEQ ID NO: 196476 - DNA, 12 bp, Unknown
  misc_feature (1)..( 12): Result.006 file - promoters50/5663221
gacagaaccgtt

SEQ ID NO: 196477 - DNA, 12 bp, Unknown
  misc_feature (1)..( 12): Result.006 file - promoters50/5663221
taaagaccctaa

SEQ ID NO: 196478 - DNA, 12 bp, Unknown
  misc_feature (1)..( 12): Result.006 file - promoters50/5663224
aaaccaacggtt

SEQ ID NO: 196479 - DNA, 11 bp, Unknown
  misc_feature (1)..( 11): Result.006 file - promoters50/5663224
gtcatttatcg

SEQ ID NO: 196480 - DNA, 11 bp, Unknown
  misc_feature (1)..( 11): Result.006 file - promoters50/5663224
actatttatga

SEQ ID NO: 196481 - DNA, 11 bp, Unknown
  misc_feature (1)..( 11): Result.006 file - promoters50/5663224
gctttttatca

SEQ ID NO: 196482 - DNA, 11 bp, Unknown
  misc_feature (1)..( 11): Result.006 file - promoters50/5663224
actatatatat

SEQ ID NO: 196483 - DNA, 11 bp, Unknown
  misc_feature (1)..( 11): Result.006 file - promoters50/5663224
ttcatttgtat

SEQ ID NO: 196484 - DNA, 11 bp, Unknown
  misc_feature (1)..( 11): Result.006 file - promoters50/5663224
ctgatttgttt

SEQ ID NO: 196485 - DNA, 11 bp, Unknown
  misc_feature (1)..( 11): Result.006 file - promoters50/5663224
caaatttgtta

SEQ ID NO: 196486 - DNA, 14 bp, Unknown
  misc_feature (1)..( 14): Result.006 file - promoters50/5663224
ccagcaattttaat

SEQ ID NO: 196487 - DNA, 14 bp, Unknown
  misc_feature (1)..( 14): Result.006 file - promoters50/5663224
actagaattttctg

SEQ ID NO: 196488 - DNA, 14 bp, Unknown
  misc_feature (1)..( 14): Result.006 file - promoters50/5663224
ttcataatattagt

SEQ ID NO: 196489 - DNA, 14 bp, Unknown
  misc_feature (1)..( 14): Result.006 file - promoters50/5663224
atttgaatttttgt

SEQ ID NO: 196490 - DNA, 14 bp, Unknown
  misc_feature (1)..( 14): Result.006 file - promoters50/5663224
cacttcatatgagt

SEQ ID NO: 196491 - DNA, 14 bp, Unknown
  misc_feature (1)..( 14): Result.006 file - promoters50/5663224
ggttgcatttacta

SEQ ID NO: 196492 - DNA, 11 bp, Unknown
  misc_feature (1)..( 11): Result.006 file - promoters50/5663224
cgtttgttgaa

SEQ ID NO: 196493 - DNA, 11 bp, Unknown
  misc_feature (1)..( 11): Result.006 file - promoters50/5663224
actttggtgaa

SEQ ID NO: 196494 - DNA, 11 bp, Unknown
  misc_feature (1)..( 11): Result.006 file - promoters50/5663224
gatttgtttgc

SEQ ID NO: 196495 - DNA, 11 bp, Unknown
  misc_feature (1)..( 11): Result.006 file - promoters50/5663224
tgcttgttggt

SEQ ID NO: 196496 - DNA, 11 bp, Unknown
  misc_feature (1)..( 11): Result.006 file - promoters50/5663224
catttgtatac

SEQ ID NO: 196497 - DNA, 11 bp, Unknown
  misc_feature (1)..( 11): Result.006 file - promoters50/5663224
gattggttggt

SEQ ID NO: 196498 - DNA, 10 bp, Unknown
  misc_feature (1)..( 10): Result.006 file - promoters50/5663224
aattttaatt

SEQ ID NO: 196499 - DNA, 10 bp, Unknown
  misc_feature (1)..( 10): Result.006 file - promoters50/5663224
tctttttatt

SEQ ID NO: 196500 - DNA, 10 bp, Unknown
  misc_feature (1)..( 10): Result.006 file - promoters50/5663224
catttgaatt

SEQ ID NO: 196501 - DNA, 10 bp, Unknown
  misc_feature (1)..( 10): Result.006 file - promoters50/5663224
tcttcttata

SEQ ID NO: 196502 - DNA, 10 bp, Unknown
  misc_feature (1)..( 10): Result.006 file - promoters50/5663224
acttcatatg

SEQ ID NO: 196503 - DNA, 10 bp, Unknown
  misc_feature (1)..( 10): Result.006 file - promoters50/5663224
aattcataat

SEQ ID NO: 196504 - DNA, 10 bp, Unknown
  misc_feature (1)..( 10): Result.006 file - promoters50/5663224
catttttatg

SEQ ID NO: 196505 - DNA, 11 bp, Unknown
  misc_feature (1)..( 11): Result.006 file - promoters50/5663224
ctcaaattagc

SEQ ID NO: 196506 - DNA, 11 bp, Unknown
  misc_feature (1)..( 11): Result.006 file - promoters50/5663224
aacaaattagt

SEQ ID NO: 196507 - DNA, 11 bp, Unknown
  misc_feature (1)..( 11): Result.006 file - promoters50/5663224
atcaatttaga

SEQ ID NO: 196508 - DNA, 11 bp, Unknown
  misc_feature (1)..( 11): Result.006 file - promoters50/5663224
tataaatcatt

SEQ ID NO: 196509 - DNA, 11 bp, Unknown
  misc_feature (1)..( 11): Result.006 file - promoters50/5663224
ttgaatttagt

SEQ ID NO: 196510 - DNA, 11 bp, Unknown
  misc_feature (1)..( 11): Result.006 file - promoters50/5663234
tacaattgaga

SEQ ID NO: 196511 - DNA, 12 bp, Unknown
  misc_feature (1)..( 12): Result.006 file - promoters50/5663234
gccatacaagaa

SEQ ID NO: 196512 - DNA, 12 bp, Unknown
  misc_feature (1)..( 12): Result.006 file - promoters50/5663234
atcataaaagat

SEQ ID NO: 196513 - DNA, 12 bp, Unknown
  misc_feature (1)..( 12): Result.006 file - promoters50/5663234
tacaaaaaaatt

SEQ ID NO: 196514 - DNA, 12 bp, Unknown
  misc_feature (1)..( 12): Result.006 file - promoters50/5663234
agctttaaagat

SEQ ID NO: 196515 - DNA, 12 bp, Unknown
  misc_feature (1)..( 12): Result.006 file - promoters50/5663234
ttttaacaaaag

SEQ ID NO: 196516 - DNA, 11 bp, Unknown
  misc_feature (1)..( 11): Result.006 file - promoters50/5663234
tgagatgttat

SEQ ID NO: 196517 - DNA, 11 bp, Unknown
  misc_feature (1)..( 11): Result.006 file - promoters50/5663234
actattgttat

SEQ ID NO: 196518 - DNA, 11 bp, Unknown
  misc_feature (1)..( 11): Result.006 file - promoters50/5663234
attatttttac

SEQ ID NO: 196519 - DNA, 11 bp, Unknown
  misc_feature (1)..( 11): Result.006 file - promoters50/5663234
attttttttac

SEQ ID NO: 196520 - DNA, 11 bp, Unknown
  misc_feature (1)..( 11): Result.006 file - promoters50/5663234
tatatttttct

SEQ ID NO: 196521 - DNA, 9 bp, Unknown
  misc_feature (1)..( 9): Result.006 file - promoters50/5663234
taaagttat

SEQ ID NO: 196522 - DNA, 9 bp, Unknown
  misc_feature (1)..( 9): Result.006 file - promoters50/5663234
taatgttga

SEQ ID NO: 196523 - DNA, 9 bp, Unknown
  misc_feature (1)..( 9): Result.006 file - promoters50/5663234
ataagttat

SEQ ID NO: 196524 - DNA, 9 bp, Unknown
  misc_feature (1)..( 9): Result.006 file - promoters50/5663234
taaagtaaa

SEQ ID NO: 196525 - DNA, 9 bp, Unknown
  misc_feature (1)..( 9): Result.006 file - promoters50/5663234
aaaaataat

SEQ ID NO: 196526 - DNA, 10 bp, Unknown
  misc_feature (1)..( 10): Result.006 file - promoters50/5663234
gatttaatat

SEQ ID NO: 196527 - DNA, 10 bp, Unknown
  misc_feature (1)..( 10): Result.006 file - promoters50/5663234
tatttaaaat

SEQ ID NO: 196528 - DNA, 10 bp, Unknown
  misc_feature (1)..( 10): Result.006 file - promoters50/5663234
tatttatttc

SEQ ID NO: 196529 - DNA, 10 bp, Unknown
  misc_feature (1)..( 10): Result.006 file - promoters50/5663234
cttttaaaaa

SEQ ID NO: 196530 - DNA, 10 bp, Unknown
  misc_feature (1)..( 10): Result.006 file - promoters50/5663234
catttacaaa

SEQ ID NO: 196531 - DNA, 12 bp, Unknown
  misc_feature (1)..( 12): Result.006 file - promoters50/5663234
tatttatgccac

SEQ ID NO: 196532 - DNA, 12 bp, Unknown
  misc_feature (1)..( 12): Result.006 file - promoters50/5663234
tatatataaata

SEQ ID NO: 196533 - DNA, 12 bp, Unknown
  misc_feature (1)..( 12): Result.006 file - promoters50/5663234
tatatatacaca

SEQ ID NO: 196534 - DNA, 12 bp, Unknown
  misc_feature (1)..( 12): Result.006 file - promoters50/5663234
tataaataaata

SEQ ID NO: 196535 - DNA, 12 bp, Unknown
  misc_feature (1)..( 12): Result.006 file - promoters50/5663249
tatttatttgac

SEQ ID NO: 196536 - DNA, 7 bp, Unknown
  misc_feature (1)..( 7): Result.006 file - promoters50/5663249
attatct

SEQ ID NO: 196537 - DNA, 7 bp, Unknown
  misc_feature (1)..( 7): Result.006 file - promoters50/5663249
attttct

SEQ ID NO: 196538 - DNA, 7 bp, Unknown
  misc_feature (1)..( 7): Result.006 file - promoters50/5663249
tttttct

SEQ ID NO: 196539 - DNA, 8 bp, Unknown
  misc_feature (1)..( 8): Result.006 file - promoters50/5663249
taaattaa

SEQ ID NO: 196540 - DNA, 8 bp, Unknown
  misc_feature (1)..( 8): Result.006 file - promoters50/5663249
taaaataa

SEQ ID NO: 196541 - DNA, 8 bp, Unknown
  misc_feature (1)..( 8): Result.006 file - promoters50/5663249
caaattac

SEQ ID NO: 196542 - DNA, 11 bp, Unknown
  misc_feature (1)..( 11): Result.006 file - promoters50/5663249
tcaaattaatc

SEQ ID NO: 196543 - DNA, 11 bp, Unknown
  misc_feature (1)..( 11): Result.006 file - promoters50/5663249
tcaaagtaatg

SEQ ID NO: 196544 - DNA, 11 bp, Unknown
  misc_feature (1)..( 11): Result.006 file - promoters50/5663249
tctaattgatc

SEQ ID NO: 196545 - DNA, 12 bp, Unknown
  misc_feature (1)..( 12): Result.006 file - promoters50/5663249
tatgtttaattt

SEQ ID NO: 196546 - DNA, 12 bp, Unknown
  misc_feature (1)..( 12): Result.006 file - promoters50/5663249
tatttttcataa

SEQ ID NO: 196547 - DNA, 12 bp, Unknown
  misc_feature (1)..( 12): Result.006 file - promoters50/5663253
tgtttttcttaa

SEQ ID NO: 196548 - DNA, 7 bp, Unknown
  misc_feature (1)..( 7): Result.006 file - promoters50/5663253
gaaggaa

SEQ ID NO: 196549 - DNA, 7 bp, Unknown
  misc_feature (1)..( 7): Result.006 file - promoters50/5663253
gaaggaa

SEQ ID NO: 196550 - DNA, 7 bp, Unknown
  misc_feature (1)..( 7): Result.006 file - promoters50/5663264
aaaggaa

SEQ ID NO: 196551 - DNA, 7 bp, Unknown
  misc_feature (1)..( 7): Result.006 file - promoters50/5663264
aatcggc

SEQ ID NO: 196552 - DNA, 7 bp, Unknown
  misc_feature (1)..( 7): Result.006 file - promoters50/5663264
aatgggc

SEQ ID NO: 196553 - DNA, 7 bp, Unknown
  misc_feature (1)..( 7): Result.006 file - promoters50/5663301
aatgggc

SEQ ID NO: 196554 - DNA, 9 bp, Unknown
  misc_feature (1)..( 9): Result.006 file - promoters50/5663301
aaaatatat

SEQ ID NO: 196555 - DNA, 9 bp, Unknown
  misc_feature (1)..( 9): Result.006 file - promoters50/5663301
aaaacataa

SEQ ID NO: 196556 - DNA, 9 bp, Unknown
  misc_feature (1)..( 9): Result.006 file - promoters50/5663301
aaaatacac

SEQ ID NO: 196557 - DNA, 10 bp, Unknown
  misc_feature (1)..( 10): Result.006 file - promoters50/5663301
aaagatatta

SEQ ID NO: 196558 - DNA, 10 bp, Unknown
  misc_feature (1)..( 10): Result.006 file - promoters50/5663301
aacaacttaa

SEQ ID NO: 196559 - DNA, 10 bp, Unknown
  misc_feature (1)..( 10): Result.006 file - promoters50/5663301
gtaaatacgt

SEQ ID NO: 196560 - DNA, 10 bp, Unknown
  misc_feature (1)..( 10): Result.006 file - promoters50/5663301
taaacaagtt

SEQ ID NO: 196561 - DNA, 10 bp, Unknown
  misc_feature (1)..( 10): Result.006 file - promoters50/5663301
aaaacaaaaa

SEQ ID NO: 196562 - DNA, 11 bp, Unknown
  misc_feature (1)..( 11): Result.006 file - promoters50/5663301
aaagacaatga

SEQ ID NO: 196563 - DNA, 11 bp, Unknown
  misc_feature (1)..( 11): Result.006 file - promoters50/5663301
aaaaaaaaaaa

SEQ ID NO: 196564 - DNA, 11 bp, Unknown
  misc_feature (1)..( 11): Result.006 file - promoters50/5663301
aaaaaaaaaaa

SEQ ID NO: 196565 - DNA, 11 bp, Unknown
  misc_feature (1)..( 11): Result.006 file - promoters50/5663301
ttaaacaaacg

SEQ ID NO: 196566 - DNA, 13 bp, Unknown
  misc_feature (1)..( 13): Result.006 file - promoters50/5663301
tttaaaacctttc

SEQ ID NO: 196567 - DNA, 13 bp, Unknown
  misc_feature (1)..( 13): Result.006 file - promoters50/5663301
agtaaaacaaaac

SEQ ID NO: 196568 - DNA, 13 bp, Unknown
  misc_feature (1)..( 13): Result.006 file - promoters50/5663301
attaatacaattg

SEQ ID NO: 196569 - DNA, 13 bp, Unknown
  misc_feature (1)..( 13): Result.006 file - promoters50/5663301
gttagtacgaggc

SEQ ID NO: 196570 - DNA, 13 bp, Unknown
  misc_feature (1)..( 13): Result.006 file - promoters50/5663301
cccaaaaaaaaaa

SEQ ID NO: 196571 - DNA, 13 bp, Unknown
  misc_feature (1)..( 13): Result.006 file - promoters50/5663301
aagaaaaaaaaaa

SEQ ID NO: 196572 - DNA, 13 bp, Unknown
  misc_feature (1)..( 13): Result.006 file - promoters50/5663301
gattaaacaaacg

SEQ ID NO: 196573 - DNA, 13 bp, Unknown
  misc_feature (1)..( 13): Result.006 file - promoters50/5663301
tctaactagtttt

SEQ ID NO: 196574 - DNA, 13 bp, Unknown
  misc_feature (1)..( 13): Result.006 file - promoters50/5663301
tccaactagggta

SEQ ID NO: 196575 - DNA, 13 bp, Unknown
  misc_feature (1)..( 13): Result.006 file - promoters50/5663301
tcttacttgttta

SEQ ID NO: 196576 - DNA, 13 bp, Unknown
  misc_feature (1)..( 13): Result.006 file - promoters50/5663301
agagacttctttt

SEQ ID NO: 196577 - DNA, 13 bp, Unknown
  misc_feature (1)..( 13): Result.006 file - promoters50/5663301
ttttacttttttt

SEQ ID NO: 196578 - DNA, 13 bp, Unknown
  misc_feature (1)..( 13): Result.006 file - promoters50/5663305
tagtctttgctta

SEQ ID NO: 196579 - DNA, 10 bp, Unknown
  misc_feature (1)..( 10): Result.006 file - promoters50/5663305
tttttatatc

SEQ ID NO: 196580 - DNA, 10 bp, Unknown
  misc_feature (1)..( 10): Result.006 file - promoters50/5663305
gtttaatata

SEQ ID NO: 196581 - DNA, 10 bp, Unknown
  misc_feature (1)..( 10): Result.006 file - promoters50/5663305
tttttattta

SEQ ID NO: 196582 - DNA, 10 bp, Unknown
  misc_feature (1)..( 10): Result.006 file - promoters50/5663305
gtttaagtgg

SEQ ID NO: 196583 - DNA, 11 bp, Unknown
  misc_feature (1)..( 11): Result.006 file - promoters50/5663305
caagtagatat

SEQ ID NO: 196584 - DNA, 11 bp, Unknown
  misc_feature (1)..( 11): Result.006 file - promoters50/5663305
aagagagatat

SEQ ID NO: 196585 - DNA, 11 bp, Unknown
  misc_feature (1)..( 11): Result.006 file - promoters50/5663305
acctgagatag

SEQ ID NO: 196586 - DNA, 11 bp, Unknown
  misc_feature (1)..( 11): Result.006 file - promoters50/5663305
accagagatgg

SEQ ID NO: 196587 - DNA, 10 bp, Unknown
  misc_feature (1)..( 10): Result.006 file - promoters50/5663305
aaatttatat

SEQ ID NO: 196588 - DNA, 10 bp, Unknown
  misc_feature (1)..( 10): Result.006 file - promoters50/5663305
gagtttttat

SEQ ID NO: 196589 - DNA, 10 bp, Unknown
  misc_feature (1)..( 10): Result.006 file - promoters50/5663305
aaattgatac

SEQ ID NO: 196590 - DNA, 10 bp, Unknown
  misc_feature (1)..( 10): Result.006 file - promoters50/5663313
aaactgaaat

SEQ ID NO: 196591 - DNA, 7 bp, Unknown
  misc_feature (1)..( 7): Result.006 file - promoters50/5663313
tgattag

SEQ ID NO: 196592 - DNA, 7 bp, Unknown
  misc_feature (1)..( 7): Result.006 file - promoters50/5663313
ggattag

SEQ ID NO: 196593 - DNA, 7 bp, Unknown
  misc_feature (1)..( 7): Result.006 file - promoters50/5663313
tgattaa

SEQ ID NO: 196594 - DNA, 7 bp, Unknown
  misc_feature (1)..( 7): Result.006 file - promoters50/5663313
aaattgc

SEQ ID NO: 196595 - DNA, 7 bp, Unknown
  misc_feature (1)..( 7): Result.006 file - promoters50/5663313
gaattgc

SEQ ID NO: 196596 - DNA, 7 bp, Unknown
  misc_feature (1)..( 7): Result.006 file - promoters50/5663313
gaattgg

SEQ ID NO: 196597 - DNA, 7 bp, Unknown
  misc_feature (1)..( 7): Result.006 file - promoters50/5663313
tttcttc

SEQ ID NO: 196598 - DNA, 7 bp, Unknown
  misc_feature (1)..( 7): Result.006 file - promoters50/5663313
attcttc

SEQ ID NO: 196599 - DNA, 7 bp, Unknown
  misc_feature (1)..( 7): Result.006 file - promoters50/5663313
attctta

SEQ ID NO: 196600 - DNA, 8 bp, Unknown
  misc_feature (1)..( 8): Result.006 file - promoters50/5663313
ggttttgt

SEQ ID NO: 196601 - DNA, 8 bp, Unknown
  misc_feature (1)..( 8): Result.006 file - promoters50/5663313
ggtgttgg

SEQ ID NO: 196602 - DNA, 8 bp, Unknown
  misc_feature (1)..( 8): Result.006 file - promoters50/5663313
ctcgttgt

SEQ ID NO: 196603 - DNA, 10 bp, Unknown
  misc_feature (1)..( 10): Result.006 file - promoters50/5663313
ctaaattggg

SEQ ID NO: 196604 - DNA, 10 bp, Unknown
  misc_feature (1)..( 10): Result.006 file - promoters50/5663313
tgtaatcggg

SEQ ID NO: 196605 - DNA, 10 bp, Unknown
  misc_feature (1)..( 10): Result.006 file - promoters50/5663327
tgtgatcgaa

SEQ ID NO: 196606 - DNA, 11 bp, Unknown
  misc_feature (1)..( 11): Result.006 file - promoters50/5663327
aacattttttt

SEQ ID NO: 196607 - DNA, 11 bp, Unknown
  misc_feature (1)..( 11): Result.006 file - promoters50/5663327
tacattttatc

SEQ ID NO: 196608 - DNA, 11 bp, Unknown
  misc_feature (1)..( 11): Result.006 file - promoters50/5663327
aatattttttt

SEQ ID NO: 196609 - DNA, 11 bp, Unknown
  misc_feature (1)..( 11): Result.006 file - promoters50/5663327
ttaattctatg

SEQ ID NO: 196610 - DNA, 11 bp, Unknown
  misc_feature (1)..( 11): Result.006 file - promoters50/5663327
tacttttttaa

SEQ ID NO: 196611 - DNA, 11 bp, Unknown
  misc_feature (1)..( 11): Result.006 file - promoters50/5663327
tgggttttttc

SEQ ID NO: 196612 - DNA, 9 bp, Unknown
  misc_feature (1)..( 9): Result.006 file - promoters50/5663327
tgttttttg

SEQ ID NO: 196613 - DNA, 13 bp, Unknown
  misc_feature (1)..( 13): Result.006 file - promoters50/5663327
attataattacat

SEQ ID NO: 196614 - DNA, 13 bp, Unknown
  misc_feature (1)..( 13): Result.006 file - promoters50/5663327
tttaaaatcacat

SEQ ID NO: 196615 - DNA, 14 bp, Unknown
  misc_feature (1)..( 14): Result.006 file - promoters50/5663327
tttataatataaat

SEQ ID NO: 196616 - DNA, 14 bp, Unknown
  misc_feature (1)..( 14): Result.006 file - promoters50/5663327
aatcgaaatcaacc

SEQ ID NO: 196617 - DNA, 14 bp, Unknown
  misc_feature (1)..( 14): Result.006 file - promoters50/5663327
cattcaaatcaagg

SEQ ID NO: 196618 - DNA, 14 bp, Unknown
  misc_feature (1)..( 14): Result.006 file - promoters50/5663327
tttttaattctatg

SEQ ID NO: 196619 - DNA, 11 bp, Unknown
  misc_feature (1)..( 11): Result.006 file - promoters50/5663327
aaattaatttt

SEQ ID NO: 196620 - DNA, 11 bp, Unknown
  misc_feature (1)..( 11): Result.006 file - promoters50/5663327
aaactaattta

SEQ ID NO: 196621 - DNA, 12 bp, Unknown
  misc_feature (1)..( 12): Result.006 file - promoters50/5663327
ttttaaatgtta

SEQ ID NO: 196622 - DNA, 12 bp, Unknown
  misc_feature (1)..( 12): Result.006 file - promoters50/5663327
aatctaaatttt

SEQ ID NO: 196623 - DNA, 12 bp, Unknown
  misc_feature (1)..( 12): Result.006 file - promoters50/5663327
caacttatttta

SEQ ID NO: 196624 - DNA, 12 bp, Unknown
  misc_feature (1)..( 12): Result.006 file - promoters50/5663327
tatctgatgtta

SEQ ID NO: 196625 - DNA, 12 bp, Unknown
  misc_feature (1)..( 12): Result.006 file - promoters50/5663327
aacattttttta

SEQ ID NO: 196626 - DNA, 12 bp, Unknown
  misc_feature (1)..( 12): Result.006 file - promoters50/5663327
ttcgtttttttt

SEQ ID NO: 196627 - DNA, 12 bp, Unknown
  misc_feature (1)..( 12): Result.006 file - promoters50/5663327
ttacttttttaa

SEQ ID NO: 196628 - DNA, 10 bp, Unknown
  misc_feature (1)..( 10): Result.006 file - promoters50/5663327
tgttttttgc

SEQ ID NO: 196629 - DNA, 12 bp, Unknown
  misc_feature (1)..( 12): Result.006 file - promoters50/5663327
tacattttatcc

SEQ ID NO: 196630 - DNA, 12 bp, Unknown
  misc_feature (1)..( 12): Result.006 file - promoters50/5663327
aatatttttttt

SEQ ID NO: 196631 - DNA, 12 bp, Unknown
  misc_feature (1)..( 12): Result.006 file - promoters50/5663327
tgggttttttcc

SEQ ID NO: 196632 - DNA, 14 bp, Unknown
  misc_feature (1)..( 14): Result.006 file - promoters50/5663327
tacattttatcctt

SEQ ID NO: 196633 - DNA, 14 bp, Unknown
  misc_feature (1)..( 14): Result.006 file - promoters50/5663327
aatcggttatccga

SEQ ID NO: 196634 - DNA, 14 bp, Unknown
  misc_feature (1)..( 14): Result.006 file - promoters50/5663327
tcaaacttattctt

SEQ ID NO: 196635 - DNA, 14 bp, Unknown
  misc_feature (1)..( 14): Result.006 file - promoters50/5663327
tgggttttttccgt

SEQ ID NO: 196636 - DNA, 14 bp, Unknown
  misc_feature (1)..( 14): Result.006 file - promoters50/5663327
aatattttttttaa

SEQ ID NO: 196637 - DNA, 14 bp, Unknown
  misc_feature (1)..( 14): Result.006 file - promoters50/5663329
aatatttacttttt

SEQ ID NO: 196638 - DNA, 9 bp, Unknown
  misc_feature (1)..( 9): Result.006 file - promoters50/5663329
gtttgtttt

SEQ ID NO: 196639 - DNA, 9 bp, Unknown
  misc_feature (1)..( 9): Result.006 file - promoters50/5663329
gttggtttt

SEQ ID NO: 196640 - DNA, 9 bp, Unknown
  misc_feature (1)..( 9): Result.006 file - promoters50/5663333
cttggttca

SEQ ID NO: 196641 - DNA, 11 bp, Unknown
  misc_feature (1)..( 11): Result.006 file - promoters50/5663333
cgaccatggat

SEQ ID NO: 196642 - DNA, 11 bp, Unknown
  misc_feature (1)..( 11): Result.006 file - promoters50/5663333
cgatcatcagc

SEQ ID NO: 196643 - DNA, 11 bp, Unknown
  misc_feature (1)..( 11): Result.006 file - promoters50/5663333
tgatcatgaat

SEQ ID NO: 196644 - DNA, 11 bp, Unknown
  misc_feature (1)..( 11): Result.006 file - promoters50/5663333
gaatcaagaat

SEQ ID NO: 196645 - DNA, 8 bp, Unknown
  misc_feature (1)..( 8): Result.006 file - promoters50/5663333
catggata

SEQ ID NO: 196646 - DNA, 8 bp, Unknown
  misc_feature (1)..( 8): Result.006 file - promoters50/5663333
catgaata

SEQ ID NO: 196647 - DNA, 8 bp, Unknown
  misc_feature (1)..( 8): Result.006 file - promoters50/5663333
catgaaga

SEQ ID NO: 196648 - DNA, 8 bp, Unknown
  misc_feature (1)..( 8): Result.006 file - promoters50/5663336
tatgaatc

SEQ ID NO: 196649 - DNA, 15 bp, Unknown
  misc_feature (1)..( 15): Result.006 file - promoters50/5663336
aaatacttaaaccga

SEQ ID NO: 196650 - DNA, 15 bp, Unknown
  misc_feature (1)..( 15): Result.006 file - promoters50/5663336
tattaattaaacttt

SEQ ID NO: 196651 - DNA, 15 bp, Unknown
  misc_feature (1)..( 15): Result.006 file - promoters50/5663336
aaataattaaacatt

SEQ ID NO: 196652 - DNA, 15 bp, Unknown
  misc_feature (1)..( 15): Result.006 file - promoters50/5663336
taatttttaaaaaat

SEQ ID NO: 196653 - DNA, 9 bp, Unknown
  misc_feature (1)..( 9): Result.006 file - promoters50/5663336
taacagaac

SEQ ID NO: 196654 - DNA, 9 bp, Unknown
  misc_feature (1)..( 9): Result.006 file - promoters50/5663336
ctacaaaac

SEQ ID NO: 196655 - DNA, 9 bp, Unknown
  misc_feature (1)..( 9): Result.006 file - promoters50/5663336
taacagata

SEQ ID NO: 196656 - DNA, 9 bp, Unknown
  misc_feature (1)..( 9): Result.006 file - promoters50/5663336
cgctataaa

SEQ ID NO: 196657 - DNA, 12 bp, Unknown
  misc_feature (1)..( 12): Result.006 file - promoters50/5663336
ctaattttttga

SEQ ID NO: 196658 - DNA, 12 bp, Unknown
  misc_feature (1)..( 12): Result.006 file - promoters50/5663336
ctactttcacgc

SEQ ID NO: 196659 - DNA, 13 bp, Unknown
  misc_feature (1)..( 13): Result.006 file - promoters50/5663336
gtaatatttattg

SEQ ID NO: 196660 - DNA, 13 bp, Unknown
  misc_feature (1)..( 13): Result.006 file - promoters50/5663336
cgaatttttttaa

SEQ ID NO: 196661 - DNA, 13 bp, Unknown
  misc_feature (1)..( 13): Result.006 file - promoters50/5663336
cgaagtttattaa

SEQ ID NO: 196662 - DNA, 9 bp, Unknown
  misc_feature (1)..( 9): Result.006 file - promoters50/5663336
aattttttg

SEQ ID NO: 196663 - DNA, 9 bp, Unknown
  misc_feature (1)..( 9): Result.006 file - promoters50/5663336
tatttattg

SEQ ID NO: 196664 - DNA, 9 bp, Unknown
  misc_feature (1)..( 9): Result.006 file - promoters50/5663336
aattttttt

SEQ ID NO: 196665 - DNA, 9 bp, Unknown
  misc_feature (1)..( 9): Result.006 file - promoters50/5663336
agtttatta

SEQ ID NO: 196666 - DNA, 9 bp, Unknown
  misc_feature (1)..( 9): Result.006 file - promoters50/5663336
tgtaagtac

SEQ ID NO: 196667 - DNA, 9 bp, Unknown
  misc_feature (1)..( 9): Result.006 file - promoters50/5663336
tgtaagttt

SEQ ID NO: 196668 - DNA, 9 bp, Unknown
  misc_feature (1)..( 9): Result.006 file - promoters50/5663336
cataagtaa

SEQ ID NO: 196669 - DNA, 9 bp, Unknown
  misc_feature (1)..( 9): Result.006 file - promoters50/5663347
attaattaa

SEQ ID NO: 196670 - DNA, 8 bp, Unknown
  misc_feature (1)..( 8): Result.006 file - promoters50/5663347
tttgtaac

SEQ ID NO: 196671 - DNA, 8 bp, Unknown
  misc_feature (1)..( 8): Result.006 file - promoters50/5663347
gttgtaat

SEQ ID NO: 196672 - DNA, 8 bp, Unknown
  misc_feature (1)..( 8): Result.006 file - promoters50/5663347
tttgtaat

SEQ ID NO: 196673 - DNA, 8 bp, Unknown
  misc_feature (1)..( 8): Result.006 file - promoters50/5663347
gttgcaat

SEQ ID NO: 196674 - DNA, 7 bp, Unknown
  misc_feature (1)..( 7): Result.006 file - promoters50/5663347
tcaaaac

SEQ ID NO: 196675 - DNA, 7 bp, Unknown
  misc_feature (1)..( 7): Result.006 file - promoters50/5663347
tcaaaac

SEQ ID NO: 196676 - DNA, 7 bp, Unknown
  misc_feature (1)..( 7): Result.006 file - promoters50/5663347
tcataac

SEQ ID NO: 196677 - DNA, 11 bp, Unknown
  misc_feature (1)..( 11): Result.006 file - promoters50/5663347
aagaagactat

SEQ ID NO: 196678 - DNA, 11 bp, Unknown
  misc_feature (1)..( 11): Result.006 file - promoters50/5663347
acgaagactat

SEQ ID NO: 196679 - DNA, 11 bp, Unknown
  misc_feature (1)..( 11): Result.006 file - promoters50/5663358
acgaagatcct

SEQ ID NO: 196680 - DNA, 11 bp, Unknown
  misc_feature (1)..( 11): Result.006 file - promoters50/5663358
cactaaaaact

SEQ ID NO: 196681 - DNA, 11 bp, Unknown
  misc_feature (1)..( 11): Result.006 file - promoters50/5663358
ggaaaaaaact

SEQ ID NO: 196682 - DNA, 11 bp, Unknown
  misc_feature (1)..( 11): Result.006 file - promoters50/5663358
gaaaaaaaaca

SEQ ID NO: 196683 - DNA, 11 bp, Unknown
  misc_feature (1)..( 11): Result.006 file - promoters50/5663358
gaagaaaaaaa

SEQ ID NO: 196684 - DNA, 12 bp, Unknown
  misc_feature (1)..( 12): Result.006 file - promoters50/5663358
ttctaaaataat

SEQ ID NO: 196685 - DNA, 12 bp, Unknown
  misc_feature (1)..( 12): Result.006 file - promoters50/5663358
atttataatata

SEQ ID NO: 196686 - DNA, 12 bp, Unknown
  misc_feature (1)..( 12): Result.006 file - promoters50/5663358
atttatgttgtt

SEQ ID NO: 196687 - DNA, 9 bp, Unknown
  misc_feature (1)..( 9): Result.006 file - promoters50/5663358
aaaaaattc

SEQ ID NO: 196688 - DNA, 9 bp, Unknown
  misc_feature (1)..( 9): Result.006 file - promoters50/5663358
gaaaatttc

SEQ ID NO: 196689 - DNA, 9 bp, Unknown
  misc_feature (1)..( 9): Result.006 file - promoters50/5663358
gaaaaaaac

SEQ ID NO: 196690 - DNA, 9 bp, Unknown
  misc_feature (1)..( 9): Result.006 file - promoters50/5663358
taaaataat

SEQ ID NO: 196691 - DNA, 9 bp, Unknown
  misc_feature (1)..( 9): Result.006 file - promoters50/5663358
gaaaaaaaa

SEQ ID NO: 196692 - DNA, 9 bp, Unknown
  misc_feature (1)..( 9): Result.006 file - promoters50/5663370
taagatagc

SEQ ID NO: 196693 - DNA, 10 bp, Unknown
  misc_feature (1)..( 10): Result.006 file - promoters50/5663370
tggttattca

SEQ ID NO: 196694 - DNA, 10 bp, Unknown
  misc_feature (1)..( 10): Result.006 file - promoters50/5663370
tggtcattat

SEQ ID NO: 196695 - DNA, 10 bp, Unknown
  misc_feature (1)..( 10): Result.006 file - promoters50/5663370
atgttattca

SEQ ID NO: 196696 - DNA, 9 bp, Unknown
  misc_feature (1)..( 9): Result.006 file - promoters50/5663370
ttcaacatc

SEQ ID NO: 196697 - DNA, 9 bp, Unknown
  misc_feature (1)..( 9): Result.006 file - promoters50/5663370
ttctacatg

SEQ ID NO: 196698 - DNA, 9 bp, Unknown
  misc_feature (1)..( 9): Result.006 file - promoters50/5663374
gttaacatc

SEQ ID NO: 196699 - DNA, 16 bp, Unknown
  misc_feature (1)..( 16): Result.006 file - promoters50/5663374
aataaattaaatttct

SEQ ID NO: 196700 - DNA, 16 bp, Unknown
  misc_feature (1)..( 16): Result.006 file - promoters50/5663374
gggaaatgaaatatct

SEQ ID NO: 196701 - DNA, 16 bp, Unknown
  misc_feature (1)..( 16): Result.006 file - promoters50/5663374
aataaaataaatgaag

SEQ ID NO: 196702 - DNA, 9 bp, Unknown
  misc_feature (1)..( 9): Result.006 file - promoters50/5663374
agagatttg

SEQ ID NO: 196703 - DNA, 9 bp, Unknown
  misc_feature (1)..( 9): Result.006 file - promoters50/5663374
agacatttt

SEQ ID NO: 196704 - DNA, 10 bp, Unknown
  misc_feature (1)..( 10): Result.006 file - promoters50/5663374
catcatgttc

SEQ ID NO: 196705 - DNA, 9 bp, Unknown
  misc_feature (1)..( 9): Result.006 file - promoters50/5663374
ttctcacat

SEQ ID NO: 196706 - DNA, 9 bp, Unknown
  misc_feature (1)..( 9): Result.006 file - promoters50/5663374
ttcccacta

SEQ ID NO: 196707 - DNA, 9 bp, Unknown
  misc_feature (1)..( 9): Result.006 file - promoters50/5663374
aacccacta

SEQ ID NO: 196708 - DNA, 7 bp, Unknown
  misc_feature (1)..( 7): Result.006 file - promoters50/5663374
atttccc

SEQ ID NO: 196709 - DNA, 7 bp, Unknown
  misc_feature (1)..( 7): Result.006 file - promoters50/5663374
atttcca

SEQ ID NO: 196710 - DNA, 7 bp, Unknown
  misc_feature (1)..( 7): Result.006 file - promoters50/5663374
attacca

SEQ ID NO: 196711 - DNA, 10 bp, Unknown
  misc_feature (1)..( 10): Result.006 file - promoters50/5663374
catcacgtta

SEQ ID NO: 196712 - DNA, 10 bp, Unknown
  misc_feature (1)..( 10): Result.006 file - promoters50/5663374
catcatgttc

SEQ ID NO: 196713 - DNA, 10 bp, Unknown
  misc_feature (1)..( 10): Result.006 file - promoters50/5663374
agacattttc

SEQ ID NO: 196714 - DNA, 12 bp, Unknown
  misc_feature (1)..( 12): Result.006 file - promoters50/5663374
ctaattcgaaac

SEQ ID NO: 196715 - DNA, 12 bp, Unknown
  misc_feature (1)..( 12): Result.006 file - promoters50/5663374
ttaattcaaaaa

SEQ ID NO: 196716 - DNA, 12 bp, Unknown
  misc_feature (1)..( 12): Result.006 file - promoters50/5663374
ttaattaatggg

SEQ ID NO: 196717 - DNA, 12 bp, Unknown
  misc_feature (1)..( 12): Result.006 file - promoters50/5663406
taacgtcaaaaa

SEQ ID NO: 196718 - DNA, 7 bp, Unknown
  misc_feature (1)..( 7): Result.006 file - promoters50/5663406
attatga

SEQ ID NO: 196719 - DNA, 7 bp, Unknown
  misc_feature (1)..( 7): Result.006 file - promoters50/5663406
attgtga

SEQ ID NO: 196720 - DNA, 7 bp, Unknown
  misc_feature (1)..( 7): Result.006 file - promoters50/5663406
tttgtga

SEQ ID NO: 196721 - DNA, 11 bp, Unknown
  misc_feature (1)..( 11): Result.006 file - promoters50/5663406
tgtacataaat

SEQ ID NO: 196722 - DNA, 11 bp, Unknown
  misc_feature (1)..( 11): Result.006 file - promoters50/5663406
cttacctaaat

SEQ ID NO: 196723 - DNA, 11 bp, Unknown
  misc_feature (1)..( 11): Result.006 file - promoters50/5663406
cttaactattt

SEQ ID NO: 196724 - DNA, 12 bp, Unknown
  misc_feature (1)..( 12): Result.006 file - promoters50/5663406
tctttatccttt

SEQ ID NO: 196725 - DNA, 12 bp, Unknown
  misc_feature (1)..( 12): Result.006 file - promoters50/5663406
tgtcaatcattt

SEQ ID NO: 196726 - DNA, 12 bp, Unknown
  misc_feature (1)..( 12): Result.006 file - promoters50/5663418
tgtgaatcatat

SEQ ID NO: 196727 - DNA, 14 bp, Unknown
  misc_feature (1)..( 14): Result.006 file - promoters50/5663418
ggtttatttttaat

SEQ ID NO: 196728 - DNA, 14 bp, Unknown
  misc_feature (1)..( 14): Result.006 file - promoters50/5663418
ggtctattctaaat

SEQ ID NO: 196729 - DNA, 14 bp, Unknown
  misc_feature (1)..( 14): Result.006 file - promoters50/5663418
catctattctcaat

SEQ ID NO: 196730 - DNA, 14 bp, Unknown
  misc_feature (1)..( 14): Result.006 file - promoters50/5663418
tatcttttcaaatt

SEQ ID NO: 196731 - DNA, 15 bp, Unknown
  misc_feature (1)..( 15): Result.006 file - promoters50/5663418
aaaatatgatttgat

SEQ ID NO: 196732 - DNA, 15 bp, Unknown
  misc_feature (1)..( 15): Result.006 file - promoters50/5663418
cttttttgagttgat

SEQ ID NO: 196733 - DNA, 15 bp, Unknown
  misc_feature (1)..( 15): Result.006 file - promoters50/5663418
aaattattatttcca

SEQ ID NO: 196734 - DNA, 15 bp, Unknown
  misc_feature (1)..( 15): Result.006 file - promoters50/5663433
aagaagattgttgat

SEQ ID NO: 196735 - DNA, 10 bp, Unknown
  misc_feature (1)..( 10): Result.006 file - promoters50/5663433
ggcttagatt

SEQ ID NO: 196736 - DNA, 10 bp, Unknown
  misc_feature (1)..( 10): Result.006 file - promoters50/5663433
ggctttgatg

SEQ ID NO: 196737 - DNA, 10 bp, Unknown
  misc_feature (1)..( 10): Result.006 file - promoters50/5663433
tttttagatt

SEQ ID NO: 196738 - DNA, 8 bp, Unknown
  misc_feature (1)..( 8): Result.006 file - promoters50/5663433
tttttaga

SEQ ID NO: 196739 - DNA, 8 bp, Unknown
  misc_feature (1)..( 8): Result.006 file - promoters50/5663433
gtttgaga

SEQ ID NO: 196740 - DNA, 8 bp, Unknown
  misc_feature (1)..( 8): Result.006 file - promoters50/5663440
tttttatt

SEQ ID NO: 196741 - DNA, 11 bp, Unknown
  misc_feature (1)..( 11): Result.006 file - promoters50/5663440
aaaaagaaaaa

SEQ ID NO: 196742 - DNA, 11 bp, Unknown
  misc_feature (1)..( 11): Result.006 file - promoters50/5663440
taagagagaaa

SEQ ID NO: 196743 - DNA, 11 bp, Unknown
  misc_feature (1)..( 11): Result.006 file - promoters50/5663440
ctacaaataaa

SEQ ID NO: 196744 - DNA, 11 bp, Unknown
  misc_feature (1)..( 11): Result.006 file - promoters50/5663440
aagcagagaaa

SEQ ID NO: 196745 - DNA, 11 bp, Unknown
  misc_feature (1)..( 11): Result.006 file - promoters50/5663440
aaacacataat

SEQ ID NO: 196746 - DNA, 11 bp, Unknown
  misc_feature (1)..( 11): Result.006 file - promoters50/5663448
ctaaaaataat

SEQ ID NO: 196747 - DNA, 15 bp, Unknown
  misc_feature (1)..( 15): Result.006 file - promoters50/5663448
tcttgttatgatttg

SEQ ID NO: 196748 - DNA, 15 bp, Unknown
  misc_feature (1)..( 15): Result.006 file - promoters50/5663448
gaccattaggatttt

SEQ ID NO: 196749 - DNA, 15 bp, Unknown
  misc_feature (1)..( 15): Result.006 file - promoters50/5663448
tctttttataattta

SEQ ID NO: 196750 - DNA, 15 bp, Unknown
  misc_feature (1)..( 15): Result.006 file - promoters50/5663448
aaatcgaatgttttg

SEQ ID NO: 196751 - DNA, 13 bp, Unknown
  misc_feature (1)..( 13): Result.006 file - promoters50/5663448
gactcatataaca

SEQ ID NO: 196752 - DNA, 13 bp, Unknown
  misc_feature (1)..( 13): Result.006 file - promoters50/5663448
aactcaaataaca

SEQ ID NO: 196753 - DNA, 13 bp, Unknown
  misc_feature (1)..( 13): Result.006 file - promoters50/5663448
tactcatttatca

SEQ ID NO: 196754 - DNA, 13 bp, Unknown
  misc_feature (1)..( 13): Result.006 file - promoters50/5663448
aacacaaattaac

SEQ ID NO: 196755 - DNA, 13 bp, Unknown
  misc_feature (1)..( 13): Result.006 file - promoters50/5663448
aacaaaaatgata

SEQ ID NO: 196756 - DNA, 9 bp, Unknown
  misc_feature (1)..( 9): Result.006 file - promoters50/5663448
tgttttgaa

SEQ ID NO: 196757 - DNA, 9 bp, Unknown
  misc_feature (1)..( 9): Result.006 file - promoters50/5663448
tgttttttt

SEQ ID NO: 196758 - DNA, 9 bp, Unknown
  misc_feature (1)..( 9): Result.006 file - promoters50/5663448
tgtattgat

SEQ ID NO: 196759 - DNA, 9 bp, Unknown
  misc_feature (1)..( 9): Result.006 file - promoters50/5663448
aatattgat

SEQ ID NO: 196760 - DNA, 15 bp, Unknown
  misc_feature (1)..( 15): Result.006 file - promoters50/5663448
cgttaaaatagtgat

SEQ ID NO: 196761 - DNA, 15 bp, Unknown
  misc_feature (1)..( 15): Result.006 file - promoters50/5663448
tgttataattttttt

SEQ ID NO: 196762 - DNA, 15 bp, Unknown
  misc_feature (1)..( 15): Result.006 file - promoters50/5663448
tattattattttcta

SEQ ID NO: 196763 - DNA, 15 bp, Unknown
  misc_feature (1)..( 15): Result.006 file - promoters50/5663464
acttattttcaatgt

SEQ ID NO: 196764 - DNA, 11 bp, Unknown
  misc_feature (1)..( 11): Result.006 file - promoters50/5663464
tttaaataagc

SEQ ID NO: 196765 - DNA, 11 bp, Unknown
  misc_feature (1)..( 11): Result.006 file - promoters50/5663464
tttgaataatg

SEQ ID NO: 196766 - DNA, 11 bp, Unknown
  misc_feature (1)..( 11): Result.006 file - promoters50/5663464
ttcaaatcatg

SEQ ID NO: 196767 - DNA, 9 bp, Unknown
  misc_feature (1)..( 9): Result.006 file - promoters50/5663464
tttttcaag

SEQ ID NO: 196768 - DNA, 9 bp, Unknown
  misc_feature (1)..( 9): Result.006 file - promoters50/5663464
tttttcttg

SEQ ID NO: 196769 - DNA, 9 bp, Unknown
  misc_feature (1)..( 9): Result.006 file - promoters50/5663464
attttcctt

SEQ ID NO: 196770 - DNA, 8 bp, Unknown
  misc_feature (1)..( 8): Result.006 file - promoters50/5663464
cttggaaa

SEQ ID NO: 196771 - DNA, 8 bp, Unknown
  misc_feature (1)..( 8): Result.006 file - promoters50/5663464
aatggaaa

SEQ ID NO: 196772 - DNA, 8 bp, Unknown
  misc_feature (1)..( 8): Result.006 file - promoters50/5663474
aattgaat

SEQ ID NO: 196773 - DNA, 9 bp, Unknown
  misc_feature (1)..( 9): Result.006 file - promoters50/5663474
tcaaaaaga

SEQ ID NO: 196774 - DNA, 9 bp, Unknown
  misc_feature (1)..( 9): Result.006 file - promoters50/5663474
tcacaaaga

SEQ ID NO: 196775 - DNA, 9 bp, Unknown
  misc_feature (1)..( 9): Result.006 file - promoters50/5663474
acacaaatt

SEQ ID NO: 196776 - DNA, 7 bp, Unknown
  misc_feature (1)..( 7): Result.006 file - promoters50/5663474
gtttgat

SEQ ID NO: 196777 - DNA, 7 bp, Unknown
  misc_feature (1)..( 7): Result.006 file - promoters50/5663474
gttggat

SEQ ID NO: 196778 - DNA, 7 bp, Unknown
  misc_feature (1)..( 7): Result.006 file - promoters50/5663474
ttttgat

SEQ ID NO: 196779 - DNA, 7 bp, Unknown
  misc_feature (1)..( 7): Result.006 file - promoters50/5663474
catataa

SEQ ID NO: 196780 - DNA, 7 bp, Unknown
  misc_feature (1)..( 7): Result.006 file - promoters50/5663474
catgtaa

SEQ ID NO: 196781 - DNA, 7 bp, Unknown
  misc_feature (1)..( 7): Result.006 file - promoters50/5663474
aatataa

SEQ ID NO: 196782 - DNA, 9 bp, Unknown
  misc_feature (1)..( 9): Result.006 file - promoters50/5663474
tgtataatt

SEQ ID NO: 196783 - DNA, 9 bp, Unknown
  misc_feature (1)..( 9): Result.006 file - promoters50/5663474
tcaataatt

SEQ ID NO: 196784 - DNA, 9 bp, Unknown
  misc_feature (1)..( 9): Result.006 file - promoters50/5663474
tcactaata

SEQ ID NO: 196785 - DNA, 8 bp, Unknown
  misc_feature (1)..( 8): Result.006 file - promoters50/5663474
aaagtaaa

SEQ ID NO: 196786 - DNA, 8 bp, Unknown
  misc_feature (1)..( 8): Result.006 file - promoters50/5663474
aaagaaaa

SEQ ID NO: 196787 - DNA, 8 bp, Unknown
  misc_feature (1)..( 8): Result.006 file - promoters50/5663474
aaacaaag

SEQ ID NO: 196788 - DNA, 7 bp, Unknown
  misc_feature (1)..( 7): Result.006 file - promoters50/5663474
atatatg

SEQ ID NO: 196789 - DNA, 7 bp, Unknown
  misc_feature (1)..( 7): Result.006 file - promoters50/5663474
ataaatg

SEQ ID NO: 196790 - DNA, 7 bp, Unknown
  misc_feature (1)..( 7): Result.006 file - promoters50/5663478
ataaata

SEQ ID NO: 196791 - DNA, 14 bp, Unknown
  misc_feature (1)..( 14): Result.006 file - promoters50/5663478
ctcaaacttgtttc

SEQ ID NO: 196792 - DNA, 14 bp, Unknown
  misc_feature (1)..( 14): Result.006 file - promoters50/5663478
tgcaatctttaatc

SEQ ID NO: 196793 - DNA, 14 bp, Unknown
  misc_feature (1)..( 14): Result.006 file - promoters50/5663478
ctcaaaattgatta

SEQ ID NO: 196794 - DNA, 14 bp, Unknown
  misc_feature (1)..( 14): Result.006 file - promoters50/5663478
cataaaatcataat

SEQ ID NO: 196795 - DNA, 8 bp, Unknown
  misc_feature (1)..( 8): Result.006 file - promoters50/5663478
tttcttaa

SEQ ID NO: 196796 - DNA, 8 bp, Unknown
  misc_feature (1)..( 8): Result.006 file - promoters50/5663478
tttattaa

SEQ ID NO: 196797 - DNA, 8 bp, Unknown
  misc_feature (1)..( 8): Result.006 file - promoters50/5663478
tttcataa

SEQ ID NO: 196798 - DNA, 8 bp, Unknown
  misc_feature (1)..( 8): Result.006 file - promoters50/5663478
agtattaa

SEQ ID NO: 196799 - DNA, 10 bp, Unknown
  misc_feature (1)..( 10): Result.006 file - promoters50/5663478
tcattagtta

SEQ ID NO: 196800 - DNA, 10 bp, Unknown
  misc_feature (1)..( 10): Result.006 file - promoters50/5663478
tgattagtta

SEQ ID NO: 196801 - DNA, 10 bp, Unknown
  misc_feature (1)..( 10): Result.006 file - promoters50/5663478
cgatgagtac

SEQ ID NO: 196802 - DNA, 10 bp, Unknown
  misc_feature (1)..( 10): Result.006 file - promoters50/5663482
tgattagcaa

SEQ ID NO: 196803 - DNA, 9 bp, Unknown
  misc_feature (1)..( 9): Result.006 file - promoters50/5663482
ttgatagac

SEQ ID NO: 196804 - DNA, 9 bp, Unknown
  misc_feature (1)..( 9): Result.006 file - promoters50/5663482
ttggtagcc

SEQ ID NO: 196805 - DNA, 9 bp, Unknown
  misc_feature (1)..( 9): Result.006 file - promoters50/5663482
gggatagac

SEQ ID NO: 196806 - DNA, 7 bp, Unknown
  misc_feature (1)..( 7): Result.006 file - promoters50/5663482
gatagac

SEQ ID NO: 196807 - DNA, 7 bp, Unknown
  misc_feature (1)..( 7): Result.006 file - promoters50/5663482
aatagac

SEQ ID NO: 196808 - DNA, 7 bp, Unknown
  misc_feature (1)..( 7): Result.006 file - promoters50/5663482
gatagac

SEQ ID NO: 196809 - DNA, 11 bp, Unknown
  misc_feature (1)..( 11): Result.006 file - promoters50/5663482
gaacacactta

SEQ ID NO: 196810 - DNA, 11 bp, Unknown
  misc_feature (1)..( 11): Result.006 file - promoters50/5663482
gaacacttaag

SEQ ID NO: 196811 - DNA, 11 bp, Unknown
  misc_feature (1)..( 11): Result.006 file - promoters50/5663482
aaacactaaag

SEQ ID NO: 196812 - DNA, 10 bp, Unknown
  misc_feature (1)..( 10): Result.006 file - promoters50/5663482
cacacttaac

SEQ ID NO: 196813 - DNA, 10 bp, Unknown
  misc_feature (1)..( 10): Result.006 file - promoters50/5663482
aacacttaag

SEQ ID NO: 196814 - DNA, 10 bp, Unknown
  misc_feature (1)..( 10): Result.006 file - promoters50/5663490
aacactaaag

SEQ ID NO: 196815 - DNA, 11 bp, Unknown
  misc_feature (1)..( 11): Result.006 file - promoters50/5663490
ttttgaagttt

SEQ ID NO: 196816 - DNA, 11 bp, Unknown
  misc_feature (1)..( 11): Result.006 file - promoters50/5663490
agttggagttt

SEQ ID NO: 196817 - DNA, 11 bp, Unknown
  misc_feature (1)..( 11): Result.006 file - promoters50/5663490
agtcggagtaa

SEQ ID NO: 196818 - DNA, 7 bp, Unknown
  misc_feature (1)..( 7): Result.006 file - promoters50/5663490
taacgat

SEQ ID NO: 196819 - DNA, 7 bp, Unknown
  misc_feature (1)..( 7): Result.006 file - promoters50/5663490
aaacgat

SEQ ID NO: 196820 - DNA, 8 bp, Unknown
  misc_feature (1)..( 8): Result.006 file - promoters50/5663502
aaagcgaa

SEQ ID NO: 196821 - DNA, 9 bp, Unknown
  misc_feature (1)..( 9): Result.006 file - promoters50/5663502
catttcttt

SEQ ID NO: 196822 - DNA, 9 bp, Unknown
  misc_feature (1)..( 9): Result.006 file - promoters50/5663502
catttgttt

SEQ ID NO: 196823 - DNA, 9 bp, Unknown
  misc_feature (1)..( 9): Result.006 file - promoters50/5663502
tattacttt

SEQ ID NO: 196824 - DNA, 11 bp, Unknown
  misc_feature (1)..( 11): Result.006 file - promoters50/5663502
ctttttcgaat

SEQ ID NO: 196825 - DNA, 11 bp, Unknown
  misc_feature (1)..( 11): Result.006 file - promoters50/5663502
atttatcgaat

SEQ ID NO: 196826 - DNA, 11 bp, Unknown
  misc_feature (1)..( 11): Result.006 file - promoters50/5663502
attgatcaaaa

SEQ ID NO: 196827 - DNA, 11 bp, Unknown
  misc_feature (1)..( 11): Result.006 file - promoters50/5663502
atttattagag

SEQ ID NO: 196828 - DNA, 7 bp, Unknown
  misc_feature (1)..( 7): Result.006 file - promoters50/5663502
ttaaatt

SEQ ID NO: 196829 - DNA, 7 bp, Unknown
  misc_feature (1)..( 7): Result.006 file - promoters50/5663502
ttagatt

SEQ ID NO: 196830 - DNA, 7 bp, Unknown
  misc_feature (1)..( 7): Result.006 file - promoters50/5663502
gtaaatt

SEQ ID NO: 196831 - DNA, 8 bp, Unknown
  misc_feature (1)..( 8): Result.006 file - promoters50/5663502
aattctta

SEQ ID NO: 196832 - DNA, 8 bp, Unknown
  misc_feature (1)..( 8): Result.006 file - promoters50/5663502
tattcttt

SEQ ID NO: 196833 - DNA, 8 bp, Unknown
  misc_feature (1)..( 8): Result.006 file - promoters50/5663502
aattatta

SEQ ID NO: 196834 - DNA, 8 bp, Unknown
  misc_feature (1)..( 8): Result.006 file - promoters50/5663502
tttcaaac

SEQ ID NO: 196835 - DNA, 8 bp, Unknown
  misc_feature (1)..( 8): Result.006 file - promoters50/5663502
attcaaag

SEQ ID NO: 196836 - DNA, 8 bp, Unknown
  misc_feature (1)..( 8): Result.006 file - promoters50/5663502
ttttaaac

SEQ ID NO: 196837 - DNA, 14 bp, Unknown
  misc_feature (1)..( 14): Result.006 file - promoters50/5663502
tcatatttttttca

SEQ ID NO: 196838 - DNA, 14 bp, Unknown
  misc_feature (1)..( 14): Result.006 file - promoters50/5663502
tcatttttttttgt

SEQ ID NO: 196839 - DNA, 14 bp, Unknown
  misc_feature (1)..( 14): Result.006 file - promoters50/5663502
actagtttttgtgt

SEQ ID NO: 196840 - DNA, 10 bp, Unknown
  misc_feature (1)..( 10): Result.006 file - promoters50/5663502
tcacacgtct

SEQ ID NO: 196841 - DNA, 10 bp, Unknown
  misc_feature (1)..( 10): Result.006 file - promoters50/5663502
aaacacatct

SEQ ID NO: 196842 - DNA, 10 bp, Unknown
  misc_feature (1)..( 10): Result.006 file - promoters50/5663502
aaatacattt

SEQ ID NO: 196843 - DNA, 7 bp, Unknown
  misc_feature (1)..( 7): Result.006 file - promoters50/5663502
aaaaaat

SEQ ID NO: 196844 - DNA, 7 bp, Unknown
  misc_feature (1)..( 7): Result.006 file - promoters50/5663502
aaaaaaa

SEQ ID NO: 196845 - DNA, 7 bp, Unknown
  misc_feature (1)..( 7): Result.006 file - promoters50/5663502
aaaaaat

SEQ ID NO: 196846 - DNA, 7 bp, Unknown
  misc_feature (1)..( 7): Result.006 file - promoters50/5663502
acttttt

SEQ ID NO: 196847 - DNA, 7 bp, Unknown
  misc_feature (1)..( 7): Result.006 file - promoters50/5663502
actttta

SEQ ID NO: 196848 - DNA, 7 bp, Unknown
  misc_feature (1)..( 7): Result.006 file - promoters50/5663502
tctttta

SEQ ID NO: 196849 - DNA, 7 bp, Unknown
  misc_feature (1)..( 7): Result.006 file - promoters50/5663502
tttttac

SEQ ID NO: 196850 - DNA, 7 bp, Unknown
  misc_feature (1)..( 7): Result.006 file - promoters50/5663502
cttttac

SEQ ID NO: 196851 - DNA, 7 bp, Unknown
  misc_feature (1)..( 7): Result.006 file - promoters50/5663535
cttttaa

SEQ ID NO: 196852 - DNA, 6 bp, Unknown
  misc_feature (1)..( 6): Result.006 file - promoters50/5663535
ttacat

SEQ ID NO: 196853 - DNA, 6 bp, Unknown
  misc_feature (1)..( 6): Result.006 file - promoters50/5663535
ttacat

SEQ ID NO: 196854 - DNA, 6 bp, Unknown
  misc_feature (1)..( 6): Result.006 file - promoters50/5663535
ttacat

SEQ ID NO: 196855 - DNA, 8 bp, Unknown
  misc_feature (1)..( 8): Result.006 file - promoters50/5663535
ccactttc

SEQ ID NO: 196856 - DNA, 8 bp, Unknown
  misc_feature (1)..( 8): Result.006 file - promoters50/5663535
ccaatttt

SEQ ID NO: 196857 - DNA, 8 bp, Unknown
  misc_feature (1)..( 8): Result.006 file - promoters50/5663539
cgactaat

SEQ ID NO: 196858 - DNA, 10 bp, Unknown
  misc_feature (1)..( 10): Result.006 file - promoters50/5663539
ttaataccat

SEQ ID NO: 196859 - DNA, 10 bp, Unknown
  misc_feature (1)..( 10): Result.006 file - promoters50/5663539
ttaatagcat

SEQ ID NO: 196860 - DNA, 10 bp, Unknown
  misc_feature (1)..( 10): Result.006 file - promoters50/5663539
ttaataccat

SEQ ID NO: 196861 - DNA, 7 bp, Unknown
  misc_feature (1)..( 7): Result.006 file - promoters50/5663539
tattttt

SEQ ID NO: 196862 - DNA, 7 bp, Unknown
  misc_feature (1)..( 7): Result.006 file - promoters50/5663539
tattttt

SEQ ID NO: 196863 - DNA, 7 bp, Unknown
  misc_feature (1)..( 7): Result.006 file - promoters50/5663539
tattttc

SEQ ID NO: 196864 - DNA, 7 bp, Unknown
  misc_feature (1)..( 7): Result.006 file - promoters50/5663539
tattttt

SEQ ID NO: 196865 - DNA, 8 bp, Unknown
  misc_feature (1)..( 8): Result.006 file - promoters50/5663539
gaatttta

SEQ ID NO: 196866 - DNA, 8 bp, Unknown
  misc_feature (1)..( 8): Result.006 file - promoters50/5663539
taatttta

SEQ ID NO: 196867 - DNA, 8 bp, Unknown
  misc_feature (1)..( 8): Result.006 file - promoters50/5663539
atattttt

SEQ ID NO: 196868 - DNA, 7 bp, Unknown
  misc_feature (1)..( 7): Result.006 file - promoters50/5663539
tttgagt

SEQ ID NO: 196869 - DNA, 7 bp, Unknown
  misc_feature (1)..( 7): Result.006 file - promoters50/5663539
tttaagt

SEQ ID NO: 196870 - DNA, 7 bp, Unknown
  misc_feature (1)..( 7): Result.006 file - promoters50/5663539
tttgagt

SEQ ID NO: 196871 - DNA, 7 bp, Unknown
  misc_feature (1)..( 7): Result.006 file - promoters50/5663539
tgtgttg

SEQ ID NO: 196872 - DNA, 7 bp, Unknown
  misc_feature (1)..( 7): Result.006 file - promoters50/5663539
tgttttg

SEQ ID NO: 196873 - DNA, 7 bp, Unknown
  misc_feature (1)..( 7): Result.006 file - promoters50/5663539
tgtgttg

SEQ ID NO: 196874 - DNA, 8 bp, Unknown
  misc_feature (1)..( 8): Result.006 file - promoters50/5663539
tctttttt

SEQ ID NO: 196875 - DNA, 8 bp, Unknown
  misc_feature (1)..( 8): Result.006 file - promoters50/5663539
tatttttt

SEQ ID NO: 196876 - DNA, 8 bp, Unknown
  misc_feature (1)..( 8): Result.006 file - promoters50/5663539
tattttta

SEQ ID NO: 196877 - DNA, 8 bp, Unknown
  misc_feature (1)..( 8): Result.006 file - promoters50/5663539
taatttgg

SEQ ID NO: 196878 - DNA, 8 bp, Unknown
  misc_feature (1)..( 8): Result.006 file - promoters50/5663539
taatttaa

SEQ ID NO: 196879 - DNA, 8 bp, Unknown
  misc_feature (1)..( 8): Result.006 file - promoters50/5663539
aaatttaa

SEQ ID NO: 196880 - DNA, 7 bp, Unknown
  misc_feature (1)..( 7): Result.006 file - promoters50/5663539
aaataat

SEQ ID NO: 196881 - DNA, 7 bp, Unknown
  misc_feature (1)..( 7): Result.006 file - promoters50/5663539
aaaaaat

SEQ ID NO: 196882 - DNA, 7 bp, Unknown
  misc_feature (1)..( 7): Result.006 file - promoters50/5663539
aaataat

SEQ ID NO: 196883 - DNA, 6 bp, Unknown
  misc_feature (1)..( 6): Result.006 file - promoters50/5663539
tattgt

SEQ ID NO: 196884 - DNA, 6 bp, Unknown
  misc_feature (1)..( 6): Result.006 file - promoters50/5663539
tattgt

SEQ ID NO: 196885 - DNA, 6 bp, Unknown
  misc_feature (1)..( 6): Result.006 file - promoters50/5663539
tattgt

SEQ ID NO: 196886 - DNA, 9 bp, Unknown
  misc_feature (1)..( 9): Result.006 file - promoters50/5663539
tccatccat

SEQ ID NO: 196887 - DNA, 9 bp, Unknown
  misc_feature (1)..( 9): Result.006 file - promoters50/5663539
tccattcat

SEQ ID NO: 196888 - DNA, 9 bp, Unknown
  misc_feature (1)..( 9): Result.006 file - promoters50/5663589
tccatccat

SEQ ID NO: 196889 - DNA, 9 bp, Unknown
  misc_feature (1)..( 9): Result.006 file - promoters50/5663589
taggttacc

SEQ ID NO: 196890 - DNA, 9 bp, Unknown
  misc_feature (1)..( 9): Result.006 file - promoters50/5663589
taggttaag

SEQ ID NO: 196891 - DNA, 9 bp, Unknown
  misc_feature (1)..( 9): Result.006 file - promoters50/5663589
ttggtcaag

SEQ ID NO: 196892 - DNA, 8 bp, Unknown
  misc_feature (1)..( 8): Result.006 file - promoters50/5663589
ggatttat

SEQ ID NO: 196893 - DNA, 8 bp, Unknown
  misc_feature (1)..( 8): Result.006 file - promoters50/5663589
ggattttt

SEQ ID NO: 196894 - DNA, 8 bp, Unknown
  misc_feature (1)..( 8): Result.006 file - promoters50/5663595
tgatttat

SEQ ID NO: 196895 - DNA, 8 bp, Unknown
  misc_feature (1)..( 8): Result.006 file - promoters50/5663595
gtttattt

SEQ ID NO: 196896 - DNA, 8 bp, Unknown
  misc_feature (1)..( 8): Result.006 file - promoters50/5663595
ttttgttt

SEQ ID NO: 196897 - DNA, 8 bp, Unknown
  misc_feature (1)..( 8): Result.006 file - promoters50/5663607
ttttattt

SEQ ID NO: 196898 - DNA, 8 bp, Unknown
  misc_feature (1)..( 8): Result.006 file - promoters50/5663607
gatagata

SEQ ID NO: 196899 - DNA, 8 bp, Unknown
  misc_feature (1)..( 8): Result.006 file - promoters50/5663607
aataaata

SEQ ID NO: 196900 - DNA, 8 bp, Unknown
  misc_feature (1)..( 8): Result.006 file - promoters50/5663614
aataaaat

SEQ ID NO: 196901 - DNA, 8 bp, Unknown
  misc_feature (1)..( 8): Result.006 file - promoters50/5663614
aaacttta

SEQ ID NO: 196902 - DNA, 8 bp, Unknown
  misc_feature (1)..( 8): Result.006 file - promoters50/5663614
caacatta

SEQ ID NO: 196903 - DNA, 8 bp, Unknown
  misc_feature (1)..( 8): Result.006 file - promoters50/5663614
caactttt

SEQ ID NO: 196904 - DNA, 8 bp, Unknown
  misc_feature (1)..( 8): Result.006 file - promoters50/5663614
aaaattta

SEQ ID NO: 196905 - DNA, 8 bp, Unknown
  misc_feature (1)..( 8): Result.006 file - promoters50/5663614
taacatta

SEQ ID NO: 196906 - DNA, 8 bp, Unknown
  misc_feature (1)..( 8): Result.006 file - promoters50/5663614
aaaaataa

SEQ ID NO: 196907 - DNA, 10 bp, Unknown
  misc_feature (1)..( 10): Result.006 file - promoters50/5663614
aaatatatca

SEQ ID NO: 196908 - DNA, 10 bp, Unknown
  misc_feature (1)..( 10): Result.006 file - promoters50/5663614
atatatattc

SEQ ID NO: 196909 - DNA, 10 bp, Unknown
  misc_feature (1)..( 10): Result.006 file - promoters50/5663614
tgctatatca

SEQ ID NO: 196910 - DNA, 10 bp, Unknown
  misc_feature (1)..( 10): Result.006 file - promoters50/5663614
ggataaatta

SEQ ID NO: 196911 - DNA, 10 bp, Unknown
  misc_feature (1)..( 10): Result.006 file - promoters50/5663614
ggaaaaaaaa

SEQ ID NO: 196912 - DNA, 10 bp, Unknown
  misc_feature (1)..( 10): Result.006 file - promoters50/5663614
aacaaaatta

SEQ ID NO: 196913 - DNA, 14 bp, Unknown
  misc_feature (1)..( 14): Result.006 file - promoters50/5663614
gaaaaacctttttt

SEQ ID NO: 196914 - DNA, 14 bp, Unknown
  misc_feature (1)..( 14): Result.006 file - promoters50/5663614
taaacaccatttta

SEQ ID NO: 196915 - DNA, 15 bp, Unknown
  misc_feature (1)..( 15): Result.006 file - promoters50/5663614
tttctctatttgttt

SEQ ID NO: 196916 - DNA, 15 bp, Unknown
  misc_feature (1)..( 15): Result.006 file - promoters50/5663614
taaaaacaatttaaa

SEQ ID NO: 196917 - DNA, 15 bp, Unknown
  misc_feature (1)..( 15): Result.006 file - promoters50/5663614
aactcaccattgatt

SEQ ID NO: 196918 - DNA, 15 bp, Unknown
  misc_feature (1)..( 15): Result.006 file - promoters50/5663614
taagaactcatttga

SEQ ID NO: 196919 - DNA, 15 bp, Unknown
  misc_feature (1)..( 15): Result.006 file - promoters50/5663614
atatcaccacttggt

SEQ ID NO: 196920 - DNA, 11 bp, Unknown
  misc_feature (1)..( 11): Result.006 file - promoters50/5663614
gaaaaatatat

SEQ ID NO: 196921 - DNA, 11 bp, Unknown
  misc_feature (1)..( 11): Result.006 file - promoters50/5663614
ctaaaataact

SEQ ID NO: 196922 - DNA, 11 bp, Unknown
  misc_feature (1)..( 11): Result.006 file - promoters50/5663614
aaaaaattgag

SEQ ID NO: 196923 - DNA, 11 bp, Unknown
  misc_feature (1)..( 11): Result.006 file - promoters50/5663614
aaaaaatctgt

SEQ ID NO: 196924 - DNA, 11 bp, Unknown
  misc_feature (1)..( 11): Result.006 file - promoters50/5663614
acaaaattaac

SEQ ID NO: 196925 - DNA, 11 bp, Unknown
  misc_feature (1)..( 11): Result.006 file - promoters50/5663614
gataaattaca

SEQ ID NO: 196926 - DNA, 8 bp, Unknown
  misc_feature (1)..( 8): Result.006 file - promoters50/5663614
attttaaa

SEQ ID NO: 196927 - DNA, 8 bp, Unknown
  misc_feature (1)..( 8): Result.006 file - promoters50/5663614
gtttgaaa

SEQ ID NO: 196928 - DNA, 8 bp, Unknown
  misc_feature (1)..( 8): Result.006 file - promoters50/5663614
aatttaaa

SEQ ID NO: 196929 - DNA, 8 bp, Unknown
  misc_feature (1)..( 8): Result.006 file - promoters50/5663614
atttgaag

SEQ ID NO: 196930 - DNA, 8 bp, Unknown
  misc_feature (1)..( 8): Result.006 file - promoters50/5663614
attcgaat

SEQ ID NO: 196931 - DNA, 8 bp, Unknown
  misc_feature (1)..( 8): Result.006 file - promoters50/5663625
attcaaaa

SEQ ID NO: 196932 - DNA, 8 bp, Unknown
  misc_feature (1)..( 8): Result.006 file - promoters50/5663625
atatgatt

SEQ ID NO: 196933 - DNA, 8 bp, Unknown
  misc_feature (1)..( 8): Result.006 file - promoters50/5663625
atatgagt

SEQ ID NO: 196934 - DNA, 8 bp, Unknown
  misc_feature (1)..( 8): Result.006 file - promoters50/5663625
gtatgatg

SEQ ID NO: 196935 - DNA, 8 bp, Unknown
  misc_feature (1)..( 8): Result.006 file - promoters50/5663625
atattagt

SEQ ID NO: 196936 - DNA, 8 bp, Unknown
  misc_feature (1)..( 8): Result.006 file - promoters50/5663625
atattagt

SEQ ID NO: 196937 - DNA, 8 bp, Unknown
  misc_feature (1)..( 8): Result.006 file - promoters50/5663625
atattagt

SEQ ID NO: 196938 - DNA, 12 bp, Unknown
  misc_feature (1)..( 12): Result.006 file - promoters50/5663625
ataaaaacacaa

SEQ ID NO: 196939 - DNA, 12 bp, Unknown
  misc_feature (1)..( 12): Result.006 file - promoters50/5663625
atacaaacttta

SEQ ID NO: 196940 - DNA, 12 bp, Unknown
  misc_feature (1)..( 12): Result.006 file - promoters50/5663625
ataataactctt

SEQ ID NO: 196941 - DNA, 12 bp, Unknown
  misc_feature (1)..( 12): Result.006 file - promoters50/5663625
aaaataactgtg

SEQ ID NO: 196942 - DNA, 12 bp, Unknown
  misc_feature (1)..( 12): Result.006 file - promoters50/5663625
ttcataacttta

SEQ ID NO: 196943 - DNA, 12 bp, Unknown
  misc_feature (1)..( 12): Result.006 file - promoters50/5663625
taattaagttta

SEQ ID NO: 196944 - DNA, 12 bp, Unknown
  misc_feature (1)..( 12): Result.006 file - promoters50/5663625
ttgtcatagtta

SEQ ID NO: 196945 - DNA, 12 bp, Unknown
  misc_feature (1)..( 12): Result.006 file - promoters50/5663625
ttgtaataatta

SEQ ID NO: 196946 - DNA, 12 bp, Unknown
  misc_feature (1)..( 12): Result.006 file - promoters50/5663625
ttaaaataattc

SEQ ID NO: 196947 - DNA, 12 bp, Unknown
  misc_feature (1)..( 12): Result.006 file - promoters50/5663625
aacaaaaaatta

SEQ ID NO: 196948 - DNA, 12 bp, Unknown
  misc_feature (1)..( 12): Result.006 file - promoters50/5663625
aaccaataatgg

SEQ ID NO: 196949 - DNA, 12 bp, Unknown
  misc_feature (1)..( 12): Result.006 file - promoters50/5663625
agtggatattgg

SEQ ID NO: 196950 - DNA, 18 bp, Unknown
  misc_feature (1)..( 18): Result.006 file - promoters50/5663625
gagttcataatctcgtac

SEQ ID NO: 196951 - DNA, 18 bp, Unknown
  misc_feature (1)..( 18): Result.006 file - promoters50/5663625
ttgtttatataaaatata

SEQ ID NO: 196952 - DNA, 18 bp, Unknown
  misc_feature (1)..( 18): Result.006 file - promoters50/5663625
atgtttaatctgagtata

SEQ ID NO: 196953 - DNA, 18 bp, Unknown
  misc_feature (1)..( 18): Result.006 file - promoters50/5663625
ttgcttacaatttcactc

SEQ ID NO: 196954 - DNA, 18 bp, Unknown
  misc_feature (1)..( 18): Result.006 file - promoters50/5663625
agttttactttttttttt

SEQ ID NO: 196955 - DNA, 18 bp, Unknown
  misc_feature (1)..( 18): Result.006 file - promoters50/5663625
ttatttaacttttttttt

SEQ ID NO: 196956 - DNA, 12 bp, Unknown
  misc_feature (1)..( 12): Result.006 file - promoters50/5663625
aatatacttttt

SEQ ID NO: 196957 - DNA, 12 bp, Unknown
  misc_feature (1)..( 12): Result.006 file - promoters50/5663625
gttttacttttt

SEQ ID NO: 196958 - DNA, 12 bp, Unknown
  misc_feature (1)..( 12): Result.006 file - promoters50/5663625
atttaacttttt

SEQ ID NO: 196959 - DNA, 12 bp, Unknown
  misc_feature (1)..( 12): Result.006 file - promoters50/5663625
gtttttcttttc

SEQ ID NO: 196960 - DNA, 12 bp, Unknown
  misc_feature (1)..( 12): Result.006 file - promoters50/5663625
tctttgcttaca

SEQ ID NO: 196961 - DNA, 12 bp, Unknown
  misc_feature (1)..( 12): Result.006 file - promoters50/5663644
aaagttgtttat

SEQ ID NO: 196962 - DNA, 9 bp, Unknown
  misc_feature (1)..( 9): Result.006 file - promoters50/5663644
aaactaaaa

SEQ ID NO: 196963 - DNA, 9 bp, Unknown
  misc_feature (1)..( 9): Result.006 file - promoters50/5663644
aaattaaaa

SEQ ID NO: 196964 - DNA, 9 bp, Unknown
  misc_feature (1)..( 9): Result.006 file - promoters50/5663644
caactaaaa

SEQ ID NO: 196965 - DNA, 7 bp, Unknown
  misc_feature (1)..( 7): Result.006 file - promoters50/5663644
aaatttt

SEQ ID NO: 196966 - DNA, 7 bp, Unknown
  misc_feature (1)..( 7): Result.006 file - promoters50/5663644
aaattta

SEQ ID NO: 196967 - DNA, 8 bp, Unknown
  misc_feature (1)..( 8): Result.006 file - promoters50/5663644
aaatattt

SEQ ID NO: 196968 - DNA, 8 bp, Unknown
  misc_feature (1)..( 8): Result.006 file - promoters50/5663644
attgtttt

SEQ ID NO: 196969 - DNA, 8 bp, Unknown
  misc_feature (1)..( 8): Result.006 file - promoters50/5663644
attttttt

SEQ ID NO: 196970 - DNA, 8 bp, Unknown
  misc_feature (1)..( 8): Result.006 file - promoters50/5663644
ctttatta

SEQ ID NO: 196971 - DNA, 12 bp, Unknown
  misc_feature (1)..( 12): Result.006 file - promoters50/5663644
tacaaaacattt

SEQ ID NO: 196972 - DNA, 12 bp, Unknown
  misc_feature (1)..( 12): Result.006 file - promoters50/5663644
gaaaaaatattt

SEQ ID NO: 196973 - DNA, 12 bp, Unknown
  misc_feature (1)..( 12): Result.006 file - promoters50/5663644
gaaaaaataaat

SEQ ID NO: 196974 - DNA, 7 bp, Unknown
  misc_feature (1)..( 7): Result.006 file - promoters50/5663644
aattttt

SEQ ID NO: 196975 - DNA, 7 bp, Unknown
  misc_feature (1)..( 7): Result.006 file - promoters50/5663644
tattttt

SEQ ID NO: 196976 - DNA, 7 bp, Unknown
  misc_feature (1)..( 7): Result.006 file - promoters50/5663688
tatttta

SEQ ID NO: 196977 - DNA, 9 bp, Unknown
  misc_feature (1)..( 9): Result.006 file - promoters50/5663688
cgtgtgtct

SEQ ID NO: 196978 - DNA, 9 bp, Unknown
  misc_feature (1)..( 9): Result.006 file - promoters50/5663688
attgtttct

SEQ ID NO: 196979 - DNA, 9 bp, Unknown
  misc_feature (1)..( 9): Result.006 file - promoters50/5663688
attatttgg

SEQ ID NO: 196980 - DNA, 9 bp, Unknown
  misc_feature (1)..( 9): Result.006 file - promoters50/5663688
aatatttgt

SEQ ID NO: 196981 - DNA, 9 bp, Unknown
  misc_feature (1)..( 9): Result.006 file - promoters50/5663688
gttgcattt

SEQ ID NO: 196982 - DNA, 9 bp, Unknown
  misc_feature (1)..( 9): Result.006 file - promoters50/5663688
tttggattt

SEQ ID NO: 196983 - DNA, 9 bp, Unknown
  misc_feature (1)..( 9): Result.006 file - promoters50/5663688
tgtggattc

SEQ ID NO: 196984 - DNA, 9 bp, Unknown
  misc_feature (1)..( 9): Result.006 file - promoters50/5663688
tttgttgat

SEQ ID NO: 196985 - DNA, 9 bp, Unknown
  misc_feature (1)..( 9): Result.006 file - promoters50/5663688
tattacttg

SEQ ID NO: 196986 - DNA, 9 bp, Unknown
  misc_feature (1)..( 9): Result.006 file - promoters50/5663688
tattatttg

SEQ ID NO: 196987 - DNA, 9 bp, Unknown
  misc_feature (1)..( 9): Result.006 file - promoters50/5663688
cattactta

SEQ ID NO: 196988 - DNA, 9 bp, Unknown
  misc_feature (1)..( 9): Result.006 file - promoters50/5663688
gattgtttc

SEQ ID NO: 196989 - DNA, 9 bp, Unknown
  misc_feature (1)..( 9): Result.006 file - promoters50/5663688
ttaggaaac

SEQ ID NO: 196990 - DNA, 9 bp, Unknown
  misc_feature (1)..( 9): Result.006 file - promoters50/5663688
ttaagaact

SEQ ID NO: 196991 - DNA, 9 bp, Unknown
  misc_feature (1)..( 9): Result.006 file - promoters50/5663688
cgaggaaac

SEQ ID NO: 196992 - DNA, 9 bp, Unknown
  misc_feature (1)..( 9): Result.006 file - promoters50/5663688
ataaaaaca

SEQ ID NO: 196993 - DNA, 11 bp, Unknown
  misc_feature (1)..( 11): Result.006 file - promoters50/5663688
tatgtgtgttg

SEQ ID NO: 196994 - DNA, 11 bp, Unknown
  misc_feature (1)..( 11): Result.006 file - promoters50/5663688
tatttgttgat

SEQ ID NO: 196995 - DNA, 11 bp, Unknown
  misc_feature (1)..( 11): Result.006 file - promoters50/5663688
tatttggattt

SEQ ID NO: 196996 - DNA, 11 bp, Unknown
  misc_feature (1)..( 11): Result.006 file - promoters50/5663700
gttttgtggat

SEQ ID NO: 196997 - DNA, 8 bp, Unknown
  misc_feature (1)..( 8): Result.006 file - promoters50/5663700
taaaatat

SEQ ID NO: 196998 - DNA, 8 bp, Unknown
  misc_feature (1)..( 8): Result.006 file - promoters50/5663700
taaaattt

SEQ ID NO: 196999 - DNA, 8 bp, Unknown
  misc_feature (1)..( 8): Result.006 file - promoters50/5663700
taaaatat

SEQ ID NO: 197000 - DNA, 7 bp, Unknown
  misc_feature (1)..( 7): Result.006 file - promoters50/5663700
tttatgt

SEQ ID NO: 197001 - DNA, 7 bp, Unknown
  misc_feature (1)..( 7): Result.006 file - promoters50/5663700
tttgtgt

SEQ ID NO: 197002 - DNA, 7 bp, Unknown
  misc_feature (1)..( 7): Result.006 file - promoters50/5663706
tgtatta

SEQ ID NO: 197003 - DNA, 15 bp, Unknown
  misc_feature (1)..( 15): Result.006 file - promoters50/5663706
tgagattctatagta

SEQ ID NO: 197004 - DNA, 15 bp, Unknown
  misc_feature (1)..( 15): Result.006 file - promoters50/5663706
ataaattgtatagtt

SEQ ID NO: 197005 - DNA, 15 bp, Unknown
  misc_feature (1)..( 15): Result.006 file - promoters50/5663706
tgacattctatcttt

SEQ ID NO: 197006 - DNA, 15 bp, Unknown
  misc_feature (1)..( 15): Result.006 file - promoters50/5663706
gtagattcaatcttt

SEQ ID NO: 197007 - DNA, 10 bp, Unknown
  misc_feature (1)..( 10): Result.006 file - promoters50/5663706
taattaattt

SEQ ID NO: 197008 - DNA, 10 bp, Unknown
  misc_feature (1)..( 10): Result.006 file - promoters50/5663706
ttatttattc

SEQ ID NO: 197009 - DNA, 10 bp, Unknown
  misc_feature (1)..( 10): Result.006 file - promoters50/5663706
taattagttt

SEQ ID NO: 197010 - DNA, 10 bp, Unknown
  misc_feature (1)..( 10): Result.006 file - promoters50/5663706
taattaacaa

SEQ ID NO: 197011 - DNA, 7 bp, Unknown
  misc_feature (1)..( 7): Result.006 file - promoters50/5663706
gtagaaa

SEQ ID NO: 197012 - DNA, 7 bp, Unknown
  misc_feature (1)..( 7): Result.006 file - promoters50/5663706
gtataaa

SEQ ID NO: 197013 - DNA, 7 bp, Unknown
  misc_feature (1)..( 7): Result.006 file - promoters50/5663706
gtaaaaa

SEQ ID NO: 197014 - DNA, 7 bp, Unknown
  misc_feature (1)..( 7): Result.006 file - promoters50/5663706
ctaaaaa

SEQ ID NO: 197015 - DNA, 8 bp, Unknown
  misc_feature (1)..( 8): Result.006 file - promoters50/5663706
aaatattc

SEQ ID NO: 197016 - DNA, 8 bp, Unknown
  misc_feature (1)..( 8): Result.006 file - promoters50/5663706
aaatatcc

SEQ ID NO: 197017 - DNA, 8 bp, Unknown
  misc_feature (1)..( 8): Result.006 file - promoters50/5663706
gaatattt

SEQ ID NO: 197018 - DNA, 9 bp, Unknown
  misc_feature (1)..( 9): Result.006 file - promoters50/5663706
caataattc

SEQ ID NO: 197019 - DNA, 10 bp, Unknown
  misc_feature (1)..( 10): Result.006 file - promoters50/5663706
aaaattttaa

SEQ ID NO: 197020 - DNA, 10 bp, Unknown
  misc_feature (1)..( 10): Result.006 file - promoters50/5663706
aaaattctaa

SEQ ID NO: 197021 - DNA, 10 bp, Unknown
  misc_feature (1)..( 10): Result.006 file - promoters50/5663706
aaaatgttat

SEQ ID NO: 197022 - DNA, 11 bp, Unknown
  misc_feature (1)..( 11): Result.006 file - promoters50/5663706
aaacattgtat

SEQ ID NO: 197023 - DNA, 10 bp, Unknown
  misc_feature (1)..( 10): Result.006 file - promoters50/5663706
tctttatcct

SEQ ID NO: 197024 - DNA, 10 bp, Unknown
  misc_feature (1)..( 10): Result.006 file - promoters50/5663706
tctatataaa

SEQ ID NO: 197025 - DNA, 10 bp, Unknown
  misc_feature (1)..( 10): Result.006 file - promoters50/5663706
cctatatata

SEQ ID NO: 197026 - DNA, 10 bp, Unknown
  misc_feature (1)..( 10): Result.006 file - promoters50/5663710
cctatataaa

SEQ ID NO: 197027 - DNA, 8 bp, Unknown
  misc_feature (1)..( 8): Result.006 file - promoters50/5663710
tatgaatc

SEQ ID NO: 197028 - DNA, 8 bp, Unknown
  misc_feature (1)..( 8): Result.006 file - promoters50/5663710
catgaata

SEQ ID NO: 197029 - DNA, 8 bp, Unknown
  misc_feature (1)..( 8): Result.006 file - promoters50/5663710
catggata

SEQ ID NO: 197030 - DNA, 11 bp, Unknown
  misc_feature (1)..( 11): Result.006 file - promoters50/5663710
tctataaaaag

SEQ ID NO: 197031 - DNA, 11 bp, Unknown
  misc_feature (1)..( 11): Result.006 file - promoters50/5663710
tctatcaaagt

SEQ ID NO: 197032 - DNA, 11 bp, Unknown
  misc_feature (1)..( 11): Result.006 file - promoters50/5663710
gacatcacagt

SEQ ID NO: 197033 - DNA, 7 bp, Unknown
  misc_feature (1)..( 7): Result.006 file - promoters50/5663710
catatat

SEQ ID NO: 197034 - DNA, 7 bp, Unknown
  misc_feature (1)..( 7): Result.006 file - promoters50/5663710
tatatat

SEQ ID NO: 197035 - DNA, 7 bp, Unknown
  misc_feature (1)..( 7): Result.006 file - promoters50/5663728
tatataa

SEQ ID NO: 197036 - DNA, 7 bp, Unknown
  misc_feature (1)..( 7): Result.006 file - promoters50/5663728
ccatata

SEQ ID NO: 197037 - DNA, 7 bp, Unknown
  misc_feature (1)..( 7): Result.006 file - promoters50/5663728
gcatata

SEQ ID NO: 197038 - DNA, 7 bp, Unknown
  misc_feature (1)..( 7): Result.006 file - promoters50/5663728
gcatata

SEQ ID NO: 197039 - DNA, 9 bp, Unknown
  misc_feature (1)..( 9): Result.006 file - promoters50/5663728
tactaaaaa

SEQ ID NO: 197040 - DNA, 9 bp, Unknown
  misc_feature (1)..( 9): Result.006 file - promoters50/5663728
ttttaaaaa

SEQ ID NO: 197041 - DNA, 9 bp, Unknown
  misc_feature (1)..( 9): Result.006 file - promoters50/5663732
ttttaaatg

SEQ ID NO: 197042 - DNA, 10 bp, Unknown
  misc_feature (1)..( 10): Result.006 file - promoters50/5663732
ctaatattgg

SEQ ID NO: 197043 - DNA, 10 bp, Unknown
  misc_feature (1)..( 10): Result.006 file - promoters50/5663732
ctaagattca

SEQ ID NO: 197044 - DNA, 10 bp, Unknown
  misc_feature (1)..( 10): Result.006 file - promoters50/5663732
acaaaataat

SEQ ID NO: 197045 - DNA, 12 bp, Unknown
  misc_feature (1)..( 12): Result.006 file - promoters50/5663732
atgtgtataaaa

SEQ ID NO: 197046 - DNA, 12 bp, Unknown
  misc_feature (1)..( 12): Result.006 file - promoters50/5663732
ttttgtctaaaa

SEQ ID NO: 197047 - DNA, 12 bp, Unknown
  misc_feature (1)..( 12): Result.006 file - promoters50/5663740
ttttttcttttt

SEQ ID NO: 197048 - DNA, 7 bp, Unknown
  misc_feature (1)..( 7): Result.006 file - promoters50/5663740
catactt

SEQ ID NO: 197049 - DNA, 7 bp, Unknown
  misc_feature (1)..( 7): Result.006 file - promoters50/5663740
tatactt

SEQ ID NO: 197050 - DNA, 7 bp, Unknown
  misc_feature (1)..( 7): Result.006 file - promoters50/5663740
tatgctt

SEQ ID NO: 197051 - DNA, 9 bp, Unknown
  misc_feature (1)..( 9): Result.006 file - promoters50/5663740
gtaatatct

SEQ ID NO: 197052 - DNA, 9 bp, Unknown
  misc_feature (1)..( 9): Result.006 file - promoters50/5663740
gtattatct

SEQ ID NO: 197053 - DNA, 9 bp, Unknown
  misc_feature (1)..( 9): Result.006 file - promoters50/5663740
aaattttct

SEQ ID NO: 197054 - DNA, 10 bp, Unknown
  misc_feature (1)..( 10): Result.006 file - promoters50/5663740
ccattttgca

SEQ ID NO: 197055 - DNA, 10 bp, Unknown
  misc_feature (1)..( 10): Result.006 file - promoters50/5663740
taattttgca

SEQ ID NO: 197056 - DNA, 10 bp, Unknown
  misc_feature (1)..( 10): Result.006 file - promoters50/5663740
ccattttttc

SEQ ID NO: 197057 - DNA, 8 bp, Unknown
  misc_feature (1)..( 8): Result.006 file - promoters50/5663740
aagatact

SEQ ID NO: 197058 - DNA, 8 bp, Unknown
  misc_feature (1)..( 8): Result.006 file - promoters50/5663740
tagatact

SEQ ID NO: 197059 - DNA, 8 bp, Unknown
  misc_feature (1)..( 8): Result.006 file - promoters50/5663740
tagatatt

SEQ ID NO: 197060 - DNA, 13 bp, Unknown
  misc_feature (1)..( 13): Result.006 file - promoters50/5663740
ttaaacttcgaat

SEQ ID NO: 197061 - DNA, 13 bp, Unknown
  misc_feature (1)..( 13): Result.006 file - promoters50/5663740
ttaaatttctaat

SEQ ID NO: 197062 - DNA, 13 bp, Unknown
  misc_feature (1)..( 13): Result.006 file - promoters50/5663746
cttttttttgaat

SEQ ID NO: 197063 - DNA, 8 bp, Unknown
  misc_feature (1)..( 8): Result.006 file - promoters50/5663746
tatctatt

SEQ ID NO: 197064 - DNA, 8 bp, Unknown
  misc_feature (1)..( 8): Result.006 file - promoters50/5663746
tatttatc

SEQ ID NO: 197065 - DNA, 8 bp, Unknown
  misc_feature (1)..( 8): Result.006 file - promoters50/5663748
tttctatt

SEQ ID NO: 197066 - DNA, 11 bp, Unknown
  misc_feature (1)..( 11): Result.006 file - promoters50/5663748
aagaaaattaa

SEQ ID NO: 197067 - DNA, 11 bp, Unknown
  misc_feature (1)..( 11): Result.006 file - promoters50/5663748
aaaaaaattca

SEQ ID NO: 197068 - DNA, 11 bp, Unknown
  misc_feature (1)..( 11): Result.006 file - promoters50/5663748
tcaaaaataaa

SEQ ID NO: 197069 - DNA, 11 bp, Unknown
  misc_feature (1)..( 11): Result.006 file - promoters50/5663748
taaaaaacaaa

SEQ ID NO: 197070 - DNA, 11 bp, Unknown
  misc_feature (1)..( 11): Result.006 file - promoters50/5663748
acaaaagaata

SEQ ID NO: 197071 - DNA, 11 bp, Unknown
  misc_feature (1)..( 11): Result.006 file - promoters50/5663748
aaaaaaaaaaa

SEQ ID NO: 197072 - DNA, 15 bp, Unknown
  misc_feature (1)..( 15): Result.006 file - promoters50/5663748
aaaaaaatcaagaaa

SEQ ID NO: 197073 - DNA, 15 bp, Unknown
  misc_feature (1)..( 15): Result.006 file - promoters50/5663748
ataaatatcctcact

SEQ ID NO: 197074 - DNA, 15 bp, Unknown
  misc_feature (1)..( 15): Result.006 file - promoters50/5663748
ccaaaaaaaaaaaaa

SEQ ID NO: 197075 - DNA, 15 bp, Unknown
  misc_feature (1)..( 15): Result.006 file - promoters50/5663748
agaaacatcattcat

SEQ ID NO: 197076 - DNA, 15 bp, Unknown
  misc_feature (1)..( 15): Result.006 file - promoters50/5663748
aaaaaaataaaaaaa

SEQ ID NO: 197077 - DNA, 15 bp, Unknown
  misc_feature (1)..( 15): Result.006 file - promoters50/5663748
tcaaaaataaatcga

SEQ ID NO: 197078 - DNA, 15 bp, Unknown
  misc_feature (1)..( 15): Result.006 file - promoters50/5663748
ctaaaaaacaaaagt

SEQ ID NO: 197079 - DNA, 15 bp, Unknown
  misc_feature (1)..( 15): Result.006 file - promoters50/5663752
acaaaagaataaata

SEQ ID NO: 197080 - DNA, 8 bp, Unknown
  misc_feature (1)..( 8): Result.006 file - promoters50/5663752
aaataaac

SEQ ID NO: 197081 - DNA, 8 bp, Unknown
  misc_feature (1)..( 8): Result.006 file - promoters50/5663752
gaattaac

SEQ ID NO: 197082 - DNA, 8 bp, Unknown
  misc_feature (1)..( 8): Result.006 file - promoters50/5663752
aaactaag

SEQ ID NO: 197083 - DNA, 9 bp, Unknown
  misc_feature (1)..( 9): Result.006 file - promoters50/5663752
taatttaaa

SEQ ID NO: 197084 - DNA, 9 bp, Unknown
  misc_feature (1)..( 9): Result.006 file - promoters50/5663752
taattaaaa

SEQ ID NO: 197085 - DNA, 9 bp, Unknown
  misc_feature (1)..( 9): Result.006 file - promoters50/5663752
ttatataag

SEQ ID NO: 197086 - DNA, 11 bp, Unknown
  misc_feature (1)..( 11): Result.006 file - promoters50/5663752
agaaaaaaaaa

SEQ ID NO: 197087 - DNA, 11 bp, Unknown
  misc_feature (1)..( 11): Result.006 file - promoters50/5663752
tataaagaaaa

SEQ ID NO: 197088 - DNA, 11 bp, Unknown
  misc_feature (1)..( 11): Result.006 file - promoters50/5663752
aagaaagaaag

SEQ ID NO: 197089 - DNA, 11 bp, Unknown
  misc_feature (1)..( 11): Result.006 file - promoters50/5663752
aaatcaagaag

SEQ ID NO: 197090 - DNA, 11 bp, Unknown
  misc_feature (1)..( 11): Result.006 file - promoters50/5663752
aaaacaaaaca

SEQ ID NO: 197091 - DNA, 11 bp, Unknown
  misc_feature (1)..( 11): Result.006 file - promoters50/5663752
aaatcaaattg

SEQ ID NO: 197092 - DNA, 12 bp, Unknown
  misc_feature (1)..( 12): Result.006 file - promoters50/5663752
aaacacaataca

SEQ ID NO: 197093 - DNA, 7 bp, Unknown
  misc_feature (1)..( 7): Result.006 file - promoters50/5663752
caaaaaa

SEQ ID NO: 197094 - DNA, 7 bp, Unknown
  misc_feature (1)..( 7): Result.006 file - promoters50/5663752
caaaaaa

SEQ ID NO: 197095 - DNA, 7 bp, Unknown
  misc_feature (1)..( 7): Result.006 file - promoters50/5663752
taaaaat

SEQ ID NO: 197096 - DNA, 7 bp, Unknown
  misc_feature (1)..( 7): Result.006 file - promoters50/5663752
tctttta

SEQ ID NO: 197097 - DNA, 7 bp, Unknown
  misc_feature (1)..( 7): Result.006 file - promoters50/5663752
tcttttc

SEQ ID NO: 197098 - DNA, 7 bp, Unknown
  misc_feature (1)..( 7): Result.006 file - promoters50/5663752
tctgtta

SEQ ID NO: 197099 - DNA, 11 bp, Unknown
  misc_feature (1)..( 11): Result.006 file - promoters50/5663752
ataataaaaga

SEQ ID NO: 197100 - DNA, 11 bp, Unknown
  misc_feature (1)..( 11): Result.006 file - promoters50/5663752
ttaataacagt

SEQ ID NO: 197101 - DNA, 11 bp, Unknown
  misc_feature (1)..( 11): Result.006 file - promoters50/5663752
ttaattactaa

SEQ ID NO: 197102 - DNA, 12 bp, Unknown
  misc_feature (1)..( 12): Result.006 file - promoters50/5663752
aaaaacaatgag

SEQ ID NO: 197103 - DNA, 12 bp, Unknown
  misc_feature (1)..( 12): Result.006 file - promoters50/5663752
aaaatcaatgca

SEQ ID NO: 197104 - DNA, 12 bp, Unknown
  misc_feature (1)..( 12): Result.006 file - promoters50/5663752
tatctcagtgca

SEQ ID NO: 197105 - DNA, 8 bp, Unknown
  misc_feature (1)..( 8): Result.006 file - promoters50/5663752
aaaattat

SEQ ID NO: 197106 - DNA, 8 bp, Unknown
  misc_feature (1)..( 8): Result.006 file - promoters50/5663752
aaatttat

SEQ ID NO: 197107 - DNA, 8 bp, Unknown
  misc_feature (1)..( 8): Result.006 file - promoters50/5663752
atatttat

SEQ ID NO: 197108 - DNA, 8 bp, Unknown
  misc_feature (1)..( 8): Result.006 file - promoters50/5663752
ttgaatgc

SEQ ID NO: 197109 - DNA, 8 bp, Unknown
  misc_feature (1)..( 8): Result.006 file - promoters50/5663752
tagaatgc

SEQ ID NO: 197110 - DNA, 8 bp, Unknown
  misc_feature (1)..( 8): Result.006 file - promoters50/5663752
taggatgc

SEQ ID NO: 197111 - DNA, 12 bp, Unknown
  misc_feature (1)..( 12): Result.006 file - promoters50/5663752
aaagacaaatca

SEQ ID NO: 197112 - DNA, 12 bp, Unknown
  misc_feature (1)..( 12): Result.006 file - promoters50/5663752
aaacacaataca

SEQ ID NO: 197113 - DNA, 12 bp, Unknown
  misc_feature (1)..( 12): Result.006 file - promoters50/5663752
aaaaacaaaaca

SEQ ID NO: 197114 - DNA, 9 bp, Unknown
  misc_feature (1)..( 9): Result.006 file - promoters50/5663752
gaatcttta

SEQ ID NO: 197115 - DNA, 9 bp, Unknown
  misc_feature (1)..( 9): Result.006 file - promoters50/5663752
gaatcttca

SEQ ID NO: 197116 - DNA, 9 bp, Unknown
  misc_feature (1)..( 9): Result.006 file - promoters50/5663758
agatcttca

SEQ ID NO: 197117 - DNA, 8 bp, Unknown
  misc_feature (1)..( 8): Result.006 file - promoters50/5663758
gtaaaatt

SEQ ID NO: 197118 - DNA, 8 bp, Unknown
  misc_feature (1)..( 8): Result.006 file - promoters50/5663758
ctaaaatc

SEQ ID NO: 197119 - DNA, 8 bp, Unknown
  misc_feature (1)..( 8): Result.006 file - promoters50/5663758
ctaaaata

SEQ ID NO: 197120 - DNA, 8 bp, Unknown
  misc_feature (1)..( 8): Result.006 file - promoters50/5663758
aaaaaatt

SEQ ID NO: 197121 - DNA, 8 bp, Unknown
  misc_feature (1)..( 8): Result.006 file - promoters50/5663758
gtaaaaga

SEQ ID NO: 197122 - DNA, 8 bp, Unknown
  misc_feature (1)..( 8): Result.006 file - promoters50/5663772
ctacaatt

SEQ ID NO: 197123 - DNA, 7 bp, Unknown
  misc_feature (1)..( 7): Result.006 file - promoters50/5663772
attgaat

SEQ ID NO: 197124 - DNA, 7 bp, Unknown
  misc_feature (1)..( 7): Result.006 file - promoters50/5663772
cttgaat

SEQ ID NO: 197125 - DNA, 7 bp, Unknown
  misc_feature (1)..( 7): Result.006 file - promoters50/5663772
attcaat

SEQ ID NO: 197126 - DNA, 10 bp, Unknown
  misc_feature (1)..( 10): Result.006 file - promoters50/5663772
aggctctaag

SEQ ID NO: 197127 - DNA, 10 bp, Unknown
  misc_feature (1)..( 10): Result.006 file - promoters50/5663772
tggctttaag

SEQ ID NO: 197128 - DNA, 10 bp, Unknown
  misc_feature (1)..( 10): Result.006 file - promoters50/5663772
tggttttcta

SEQ ID NO: 197129 - DNA, 7 bp, Unknown
  misc_feature (1)..( 7): Result.006 file - promoters50/5663772
aaatcaa

SEQ ID NO: 197130 - DNA, 7 bp, Unknown
  misc_feature (1)..( 7): Result.006 file - promoters50/5663772
aaatcac

SEQ ID NO: 197131 - DNA, 7 bp, Unknown
  misc_feature (1)..( 7): Result.006 file - promoters50/5663774
gaatcac

SEQ ID NO: 197132 - DNA, 6 bp, Unknown
  misc_feature (1)..( 6): Result.006 file - promoters50/5663774
ttttct

SEQ ID NO: 197133 - DNA, 6 bp, Unknown
  misc_feature (1)..( 6): Result.006 file - promoters50/5663774
ttttct

SEQ ID NO: 197134 - DNA, 6 bp, Unknown
  misc_feature (1)..( 6): Result.006 file - promoters50/5663774
ttttct

SEQ ID NO: 197135 - DNA, 8 bp, Unknown
  misc_feature (1)..( 8): Result.006 file - promoters50/5663774
aatattta

SEQ ID NO: 197136 - DNA, 8 bp, Unknown
  misc_feature (1)..( 8): Result.006 file - promoters50/5663774
aattttta

SEQ ID NO: 197137 - DNA, 8 bp, Unknown
  misc_feature (1)..( 8): Result.006 file - promoters50/5663774
tatttttt

SEQ ID NO: 197138 - DNA, 11 bp, Unknown
  misc_feature (1)..( 11): Result.006 file - promoters50/5663774
aacataaataa

SEQ ID NO: 197139 - DNA, 11 bp, Unknown
  misc_feature (1)..( 11): Result.006 file - promoters50/5663774
acaatatataa

SEQ ID NO: 197140 - DNA, 11 bp, Unknown
  misc_feature (1)..( 11): Result.006 file - promoters50/5663774
aacaaaaatca

SEQ ID NO: 197141 - DNA, 14 bp, Unknown
  misc_feature (1)..( 14): Result.006 file - promoters50/5663774
cgaatcaaacgaaa

SEQ ID NO: 197142 - DNA, 14 bp, Unknown
  misc_feature (1)..( 14): Result.006 file - promoters50/5663774
gaaataaaaccaaa

SEQ ID NO: 197143 - DNA, 15 bp, Unknown
  misc_feature (1)..( 15): Result.006 file - promoters50/5663778
agaagtaaaggggcg

SEQ ID NO: 197144 - DNA, 12 bp, Unknown
  misc_feature (1)..( 12): Result.006 file - promoters50/5663778
gaaaagtatggg

SEQ ID NO: 197145 - DNA, 12 bp, Unknown
  misc_feature (1)..( 12): Result.006 file - promoters50/5663778
gaaatgtatcga

SEQ ID NO: 197146 - DNA, 12 bp, Unknown
  misc_feature (1)..( 12): Result.006 file - promoters50/5663778
ataatttattta

SEQ ID NO: 197147 - DNA, 12 bp, Unknown
  misc_feature (1)..( 12): Result.006 file - promoters50/5663778
tttatgaatctg

SEQ ID NO: 197148 - DNA, 12 bp, Unknown
  misc_feature (1)..( 12): Result.006 file - promoters50/5663778
ctattgaacctg

SEQ ID NO: 197149 - DNA, 11 bp, Unknown
  misc_feature (1)..( 11): Result.006 file - promoters50/5663778
tactaatgttt

SEQ ID NO: 197150 - DNA, 11 bp, Unknown
  misc_feature (1)..( 11): Result.006 file - promoters50/5663778
tacaaatgttt

SEQ ID NO: 197151 - DNA, 11 bp, Unknown
  misc_feature (1)..( 11): Result.006 file - promoters50/5663778
tactaacactt

SEQ ID NO: 197152 - DNA, 11 bp, Unknown
  misc_feature (1)..( 11): Result.006 file - promoters50/5663778
atttaatattt

SEQ ID NO: 197153 - DNA, 11 bp, Unknown
  misc_feature (1)..( 11): Result.006 file - promoters50/5663778
tgctaatgtga

SEQ ID NO: 197154 - DNA, 11 bp, Unknown
  misc_feature (1)..( 11): Result.006 file - promoters50/5663778
ctctattctta

SEQ ID NO: 197155 - DNA, 10 bp, Unknown
  misc_feature (1)..( 10): Result.006 file - promoters50/5663778
cttttgatta

SEQ ID NO: 197156 - DNA, 10 bp, Unknown
  misc_feature (1)..( 10): Result.006 file - promoters50/5663778
tgtttgatta

SEQ ID NO: 197157 - DNA, 10 bp, Unknown
  misc_feature (1)..( 10): Result.006 file - promoters50/5663778
aagttggtta

SEQ ID NO: 197158 - DNA, 10 bp, Unknown
  misc_feature (1)..( 10): Result.006 file - promoters50/5663778
tgtgtgatcg

SEQ ID NO: 197159 - DNA, 10 bp, Unknown
  misc_feature (1)..( 10): Result.006 file - promoters50/5663778
gtcttggttg

SEQ ID NO: 197160 - DNA, 10 bp, Unknown
  misc_feature (1)..( 10): Result.006 file - promoters50/5663778
atttaacccg

SEQ ID NO: 197161 - DNA, 10 bp, Unknown
  misc_feature (1)..( 10): Result.006 file - promoters50/5663778
gtttaacaga

SEQ ID NO: 197162 - DNA, 10 bp, Unknown
  misc_feature (1)..( 10): Result.006 file - promoters50/5663778
atttaatatt

SEQ ID NO: 197163 - DNA, 10 bp, Unknown
  misc_feature (1)..( 10): Result.006 file - promoters50/5663778
attgaacctg

SEQ ID NO: 197164 - DNA, 10 bp, Unknown
  misc_feature (1)..( 10): Result.006 file - promoters50/5663785
tatgaatctg

SEQ ID NO: 197165 - DNA, 10 bp, Unknown
  misc_feature (1)..( 10): Result.006 file - promoters50/5663785
aaaaagaaaa

SEQ ID NO: 197166 - DNA, 10 bp, Unknown
  misc_feature (1)..( 10): Result.006 file - promoters50/5663785
caaaataaaa

SEQ ID NO: 197167 - DNA, 10 bp, Unknown
  misc_feature (1)..( 10): Result.006 file - promoters50/5663785
aaaaataaac

SEQ ID NO: 197168 - DNA, 10 bp, Unknown
  misc_feature (1)..( 10): Result.006 file - promoters50/5663785
caaaagacaa

SEQ ID NO: 197169 - DNA, 10 bp, Unknown
  misc_feature (1)..( 10): Result.006 file - promoters50/5663785
taaaataaat

SEQ ID NO: 197170 - DNA, 10 bp, Unknown
  misc_feature (1)..( 10): Result.006 file - promoters50/5663785
aaaaataata

SEQ ID NO: 197171 - DNA, 10 bp, Unknown
  misc_feature (1)..( 10): Result.006 file - promoters50/5663785
taaagtaatt

SEQ ID NO: 197172 - DNA, 12 bp, Unknown
  misc_feature (1)..( 12): Result.006 file - promoters50/5663785
cattaaaaaaaa

SEQ ID NO: 197173 - DNA, 12 bp, Unknown
  misc_feature (1)..( 12): Result.006 file - promoters50/5663785
atgaaaaataaa

SEQ ID NO: 197174 - DNA, 12 bp, Unknown
  misc_feature (1)..( 12): Result.006 file - promoters50/5663785
aagacaaataaa

SEQ ID NO: 197175 - DNA, 12 bp, Unknown
  misc_feature (1)..( 12): Result.006 file - promoters50/5663785
atttaaaataaa

SEQ ID NO: 197176 - DNA, 12 bp, Unknown
  misc_feature (1)..( 12): Result.006 file - promoters50/5663785
aaccaaaataaa

SEQ ID NO: 197177 - DNA, 12 bp, Unknown
  misc_feature (1)..( 12): Result.006 file - promoters50/5663785
ttataaagtaat

SEQ ID NO: 197178 - DNA, 13 bp, Unknown
  misc_feature (1)..( 13): Result.006 file - promoters50/5663785
aaacagaaatcgc

SEQ ID NO: 197179 - DNA, 13 bp, Unknown
  misc_feature (1)..( 13): Result.006 file - promoters50/5663785
aaacaaaaatgac

SEQ ID NO: 197180 - DNA, 13 bp, Unknown
  misc_feature (1)..( 13): Result.006 file - promoters50/5663785
tccaagaaatggt

SEQ ID NO: 197181 - DNA, 13 bp, Unknown
  misc_feature (1)..( 13): Result.006 file - promoters50/5663785
aatttgaattggt

SEQ ID NO: 197182 - DNA, 13 bp, Unknown
  misc_feature (1)..( 13): Result.006 file - promoters50/5663785
aaaaaaaaaaaat

SEQ ID NO: 197183 - DNA, 13 bp, Unknown
  misc_feature (1)..( 13): Result.006 file - promoters50/5663785
aaaccaaaacgac

SEQ ID NO: 197184 - DNA, 13 bp, Unknown
  misc_feature (1)..( 13): Result.006 file - promoters50/5663785
atttaaccaaaat

SEQ ID NO: 197185 - DNA, 13 bp, Unknown
  misc_feature (1)..( 13): Result.006 file - promoters50/5663785
aataaactaaaca

SEQ ID NO: 197186 - DNA, 13 bp, Unknown
  misc_feature (1)..( 13): Result.006 file - promoters50/5663785
ttataaccaaaaa

SEQ ID NO: 197187 - DNA, 13 bp, Unknown
  misc_feature (1)..( 13): Result.006 file - promoters50/5663785
gtttcaccaaggt

SEQ ID NO: 197188 - DNA, 13 bp, Unknown
  misc_feature (1)..( 13): Result.006 file - promoters50/5663785
tttaaaataaatc

SEQ ID NO: 197189 - DNA, 13 bp, Unknown
  misc_feature (1)..( 13): Result.006 file - promoters50/5663785
agacaaataaatc

SEQ ID NO: 197190 - DNA, 13 bp, Unknown
  misc_feature (1)..( 13): Result.006 file - promoters50/5663805
tttaaaatatgca

SEQ ID NO: 197191 - DNA, 14 bp, Unknown
  misc_feature (1)..( 14): Result.006 file - promoters50/5663805
acttataatgaatt

SEQ ID NO: 197192 - DNA, 14 bp, Unknown
  misc_feature (1)..( 14): Result.006 file - promoters50/5663805
actcataataaata

SEQ ID NO: 197193 - DNA, 14 bp, Unknown
  misc_feature (1)..( 14): Result.006 file - promoters50/5663805
atttataatataat

SEQ ID NO: 197194 - DNA, 14 bp, Unknown
  misc_feature (1)..( 14): Result.006 file - promoters50/5663805
tcatataatagtaa

SEQ ID NO: 197195 - DNA, 14 bp, Unknown
  misc_feature (1)..( 14): Result.006 file - promoters50/5663805
taaaataaggaatt

SEQ ID NO: 197196 - DNA, 14 bp, Unknown
  misc_feature (1)..( 14): Result.006 file - promoters50/5663805
tcttttaattttct

SEQ ID NO: 197197 - DNA, 14 bp, Unknown
  misc_feature (1)..( 14): Result.006 file - promoters50/5663805
tctcataagtttga

SEQ ID NO: 197198 - DNA, 10 bp, Unknown
  misc_feature (1)..( 10): Result.006 file - promoters50/5663805
ttaataacaa

SEQ ID NO: 197199 - DNA, 10 bp, Unknown
  misc_feature (1)..( 10): Result.006 file - promoters50/5663805
ataataaata

SEQ ID NO: 197200 - DNA, 10 bp, Unknown
  misc_feature (1)..( 10): Result.006 file - promoters50/5663805
ttattatact

SEQ ID NO: 197201 - DNA, 10 bp, Unknown
  misc_feature (1)..( 10): Result.006 file - promoters50/5663805
ataaaaaata

SEQ ID NO: 197202 - DNA, 10 bp, Unknown
  misc_feature (1)..( 10): Result.006 file - promoters50/5663805
caaataacca

SEQ ID NO: 197203 - DNA, 10 bp, Unknown
  misc_feature (1)..( 10): Result.006 file - promoters50/5663805
aaaagaaaaa

SEQ ID NO: 197204 - DNA, 10 bp, Unknown
  misc_feature (1)..( 10): Result.006 file - promoters50/5663805
ggaaaaaatg

SEQ ID NO: 197205 - DNA, 9 bp, Unknown
  misc_feature (1)..( 9): Result.006 file - promoters50/5663805
ctttttatc

SEQ ID NO: 197206 - DNA, 9 bp, Unknown
  misc_feature (1)..( 9): Result.006 file - promoters50/5663805
ttttttaat

SEQ ID NO: 197207 - DNA, 9 bp, Unknown
  misc_feature (1)..( 9): Result.006 file - promoters50/5663805
atttgtata

SEQ ID NO: 197208 - DNA, 9 bp, Unknown
  misc_feature (1)..( 9): Result.006 file - promoters50/5663805
atttttaag

SEQ ID NO: 197209 - DNA, 9 bp, Unknown
  misc_feature (1)..( 9): Result.006 file - promoters50/5663805
tggtgtata

SEQ ID NO: 197210 - DNA, 10 bp, Unknown
  misc_feature (1)..( 10): Result.006 file - promoters50/5663805
ttttttcatt

SEQ ID NO: 197211 - DNA, 10 bp, Unknown
  misc_feature (1)..( 10): Result.006 file - promoters50/5663805
taaattcatt

SEQ ID NO: 197212 - DNA, 9 bp, Unknown
  misc_feature (1)..( 9): Result.006 file - promoters50/5663805
cttaatgac

SEQ ID NO: 197213 - DNA, 9 bp, Unknown
  misc_feature (1)..( 9): Result.006 file - promoters50/5663805
tttattgat

SEQ ID NO: 197214 - DNA, 10 bp, Unknown
  misc_feature (1)..( 10): Result.006 file - promoters50/5663805
aaataatgaa

SEQ ID NO: 197215 - DNA, 9 bp, Unknown
  misc_feature (1)..( 9): Result.006 file - promoters50/5663805
tttgttggt

SEQ ID NO: 197216 - DNA, 9 bp, Unknown
  misc_feature (1)..( 9): Result.006 file - promoters50/5663805
gttactgat

SEQ ID NO: 197217 - DNA, 10 bp, Unknown
  misc_feature (1)..( 10): Result.006 file - promoters50/5663805
tttcattatc

SEQ ID NO: 197218 - DNA, 10 bp, Unknown
  misc_feature (1)..( 10): Result.006 file - promoters50/5663805
attcatttct

SEQ ID NO: 197219 - DNA, 10 bp, Unknown
  misc_feature (1)..( 10): Result.006 file - promoters50/5663805
ataaaaattg

SEQ ID NO: 197220 - DNA, 10 bp, Unknown
  misc_feature (1)..( 10): Result.006 file - promoters50/5663805
atataaaatc

SEQ ID NO: 197221 - DNA, 10 bp, Unknown
  misc_feature (1)..( 10): Result.006 file - promoters50/5663805
agaaaaaaaa

SEQ ID NO: 197222 - DNA, 10 bp, Unknown
  misc_feature (1)..( 10): Result.006 file - promoters50/5663805
ataaaaaata

SEQ ID NO: 197223 - DNA, 10 bp, Unknown
  misc_feature (1)..( 10): Result.006 file - promoters50/5663805
gaaaaaatgc

SEQ ID NO: 197224 - DNA, 11 bp, Unknown
  misc_feature (1)..( 11): Result.006 file - promoters50/5663805
ataataaatag

SEQ ID NO: 197225 - DNA, 10 bp, Unknown
  misc_feature (1)..( 10): Result.006 file - promoters50/5663805
ataacaaatc

SEQ ID NO: 197226 - DNA, 10 bp, Unknown
  misc_feature (1)..( 10): Result.006 file - promoters50/5663805
ataaaaaata

SEQ ID NO: 197227 - DNA, 10 bp, Unknown
  misc_feature (1)..( 10): Result.006 file - promoters50/5663805
ataacaattt

SEQ ID NO: 197228 - DNA, 10 bp, Unknown
  misc_feature (1)..( 10): Result.006 file - promoters50/5663805
ataataaata

SEQ ID NO: 197229 - DNA, 10 bp, Unknown
  misc_feature (1)..( 10): Result.006 file - promoters50/5663805
aaccaaaata

SEQ ID NO: 197230 - DNA, 10 bp, Unknown
  misc_feature (1)..( 10): Result.006 file - promoters50/5663805
aaaagaaaaa

SEQ ID NO: 197231 - DNA, 12 bp, Unknown
  misc_feature (1)..( 12): Result.006 file - promoters50/5663805
tcaatcaaaaga

SEQ ID NO: 197232 - DNA, 12 bp, Unknown
  misc_feature (1)..( 12): Result.006 file - promoters50/5663805
ttgatccaaaca

SEQ ID NO: 197233 - DNA, 12 bp, Unknown
  misc_feature (1)..( 12): Result.006 file - promoters50/5663805
tcaattaaaagg

SEQ ID NO: 197234 - DNA, 12 bp, Unknown
  misc_feature (1)..( 12): Result.006 file - promoters50/5663805
attatcctaact

SEQ ID NO: 197235 - DNA, 12 bp, Unknown
  misc_feature (1)..( 12): Result.006 file - promoters50/5663805
ccagaccataca

SEQ ID NO: 197236 - DNA, 12 bp, Unknown
  misc_feature (1)..( 12): Result.006 file - promoters50/5663805
ggaataaaaagt

SEQ ID NO: 197237 - DNA, 11 bp, Unknown
  misc_feature (1)..( 11): Result.006 file - promoters50/5663805
tgaatattaga

SEQ ID NO: 197238 - DNA, 11 bp, Unknown
  misc_feature (1)..( 11): Result.006 file - promoters50/5663805
tgaatattaga

SEQ ID NO: 197239 - DNA, 11 bp, Unknown
  misc_feature (1)..( 11): Result.006 file - promoters50/5663805
caaattttatt

SEQ ID NO: 197240 - DNA, 11 bp, Unknown
  misc_feature (1)..( 11): Result.006 file - promoters50/5663805
aaaattaatga

SEQ ID NO: 197241 - DNA, 11 bp, Unknown
  misc_feature (1)..( 11): Result.006 file - promoters50/5663805
gggtttttata

SEQ ID NO: 197242 - DNA, 11 bp, Unknown
  misc_feature (1)..( 11): Result.006 file - promoters50/5663805
caaaaaataaa

SEQ ID NO: 197243 - DNA, 11 bp, Unknown
  misc_feature (1)..( 11): Result.006 file - promoters50/5663805
ataatgaaaac

SEQ ID NO: 197244 - DNA, 11 bp, Unknown
  misc_feature (1)..( 11): Result.006 file - promoters50/5663805
aaatatatatc

SEQ ID NO: 197245 - DNA, 11 bp, Unknown
  misc_feature (1)..( 11): Result.006 file - promoters50/5663805
caatttattta

SEQ ID NO: 197246 - DNA, 11 bp, Unknown
  misc_feature (1)..( 11): Result.006 file - promoters50/5663805
caataaatatg

SEQ ID NO: 197247 - DNA, 11 bp, Unknown
  misc_feature (1)..( 11): Result.006 file - promoters50/5663805
cgctttgtttc

SEQ ID NO: 197248 - DNA, 11 bp, Unknown
  misc_feature (1)..( 11): Result.006 file - promoters50/5663805
aattttctttc

SEQ ID NO: 197249 - DNA, 11 bp, Unknown
  misc_feature (1)..( 11): Result.006 file - promoters50/5663841
aaataaggaat

SEQ ID NO: 197250 - DNA, 7 bp, Unknown
  misc_feature (1)..( 7): Result.006 file - promoters50/5663841
taaaacg

SEQ ID NO: 197251 - DNA, 7 bp, Unknown
  misc_feature (1)..( 7): Result.006 file - promoters50/5663841
caaaacg

SEQ ID NO: 197252 - DNA, 7 bp, Unknown
  misc_feature (1)..( 7): Result.006 file - promoters50/5663841
taaaaca

SEQ ID NO: 197253 - DNA, 10 bp, Unknown
  misc_feature (1)..( 10): Result.006 file - promoters50/5663841
ttgttttctt

SEQ ID NO: 197254 - DNA, 10 bp, Unknown
  misc_feature (1)..( 10): Result.006 file - promoters50/5663841
ttatttactt

SEQ ID NO: 197255 - DNA, 10 bp, Unknown
  misc_feature (1)..( 10): Result.006 file - promoters50/5663847
ttaattacta

SEQ ID NO: 197256 - DNA, 9 bp, Unknown
  misc_feature (1)..( 9): Result.006 file - promoters50/5663847
aaatctaat

SEQ ID NO: 197257 - DNA, 9 bp, Unknown
  misc_feature (1)..( 9): Result.006 file - promoters50/5663847
aaatctttt

SEQ ID NO: 197258 - DNA, 9 bp, Unknown
  misc_feature (1)..( 9): Result.006 file - promoters50/5663847
aaatatttt

SEQ ID NO: 197259 - DNA, 9 bp, Unknown
  misc_feature (1)..( 9): Result.006 file - promoters50/5663847
ttttaaata

SEQ ID NO: 197260 - DNA, 9 bp, Unknown
  misc_feature (1)..( 9): Result.006 file - promoters50/5663847
ttttaaaga

SEQ ID NO: 197261 - DNA, 9 bp, Unknown
  misc_feature (1)..( 9): Result.006 file - promoters50/5663847
tgttaaata

SEQ ID NO: 197262 - DNA, 9 bp, Unknown
  misc_feature (1)..( 9): Result.006 file - promoters50/5663847
acattaaca

SEQ ID NO: 197263 - DNA, 9 bp, Unknown
  misc_feature (1)..( 9): Result.006 file - promoters50/5663847
ttgttaaca

SEQ ID NO: 197264 - DNA, 9 bp, Unknown
  misc_feature (1)..( 9): Result.006 file - promoters50/5663847
acatcaaca

SEQ ID NO: 197265 - DNA, 6 bp, Unknown
  misc_feature (1)..( 6): Result.006 file - promoters50/5663847
atataa

SEQ ID NO: 197266 - DNA, 6 bp, Unknown
  misc_feature (1)..( 6): Result.006 file - promoters50/5663847
atataa

SEQ ID NO: 197267 - DNA, 6 bp, Unknown
  misc_feature (1)..( 6): Result.006 file - promoters50/5663847
atataa

SEQ ID NO: 197268 - DNA, 12 bp, Unknown
  misc_feature (1)..( 12): Result.006 file - promoters50/5663847
aaagattttttt

SEQ ID NO: 197269 - DNA, 12 bp, Unknown
  misc_feature (1)..( 12): Result.006 file - promoters50/5663847
aaagattctaac

SEQ ID NO: 197270 - DNA, 12 bp, Unknown
  misc_feature (1)..( 12): Result.006 file - promoters50/5663847
tcagattgtttt

SEQ ID NO: 197271 - DNA, 9 bp, Unknown
  misc_feature (1)..( 9): Result.006 file - promoters50/5663847
ttttataaa

SEQ ID NO: 197272 - DNA, 9 bp, Unknown
  misc_feature (1)..( 9): Result.006 file - promoters50/5663847
ctttctaat

SEQ ID NO: 197273 - DNA, 10 bp, Unknown
  misc_feature (1)..( 10): Result.006 file - promoters50/5663847
ttttaataaa

SEQ ID NO: 197274 - DNA, 10 bp, Unknown
  misc_feature (1)..( 10): Result.006 file - promoters50/5663847
caaatataaa

SEQ ID NO: 197275 - DNA, 8 bp, Unknown
  misc_feature (1)..( 8): Result.006 file - promoters50/5663847
aaagaaaa

SEQ ID NO: 197276 - DNA, 8 bp, Unknown
  misc_feature (1)..( 8): Result.006 file - promoters50/5663847
aaataaaa

SEQ ID NO: 197277 - DNA, 8 bp, Unknown
  misc_feature (1)..( 8): Result.006 file - promoters50/5663847
atataaaa

SEQ ID NO: 197278 - DNA, 8 bp, Unknown
  misc_feature (1)..( 8): Result.006 file - promoters50/5663847
atcctgta

SEQ ID NO: 197279 - DNA, 8 bp, Unknown
  misc_feature (1)..( 8): Result.006 file - promoters50/5663847
gtccagta

SEQ ID NO: 197280 - DNA, 8 bp, Unknown
  misc_feature (1)..( 8): Result.006 file - promoters50/5663847
atcgtgtc

SEQ ID NO: 197281 - DNA, 9 bp, Unknown
  misc_feature (1)..( 9): Result.006 file - promoters50/5663847
tttgtaaaa

SEQ ID NO: 197282 - DNA, 9 bp, Unknown
  misc_feature (1)..( 9): Result.006 file - promoters50/5663847
cttgtgaaa

SEQ ID NO: 197283 - DNA, 9 bp, Unknown
  misc_feature (1)..( 9): Result.006 file - promoters50/5663847
tttttaaaa

SEQ ID NO: 197284 - DNA, 9 bp, Unknown
  misc_feature (1)..( 9): Result.006 file - promoters50/5663847
tagtatttt

SEQ ID NO: 197285 - DNA, 9 bp, Unknown
  misc_feature (1)..( 9): Result.006 file - promoters50/5663847
aaatatttt

SEQ ID NO: 197286 - DNA, 9 bp, Unknown
  misc_feature (1)..( 9): Result.006 file - promoters50/5663851
aaatctttt

SEQ ID NO: 197287 - DNA, 9 bp, Unknown
  misc_feature (1)..( 9): Result.006 file - promoters50/5663851
aaaatgact

SEQ ID NO: 197288 - DNA, 9 bp, Unknown
  misc_feature (1)..( 9): Result.006 file - promoters50/5663851
aaaatgtga

SEQ ID NO: 197289 - DNA, 9 bp, Unknown
  misc_feature (1)..( 9): Result.006 file - promoters50/5663862
aaaaaggtg

SEQ ID NO: 197290 - DNA, 12 bp, Unknown
  misc_feature (1)..( 12): Result.006 file - promoters50/5663862
gggatttgattg

SEQ ID NO: 197291 - DNA, 12 bp, Unknown
  misc_feature (1)..( 12): Result.006 file - promoters50/5663862
acgatttaattc

SEQ ID NO: 197292 - DNA, 12 bp, Unknown
  misc_feature (1)..( 12): Result.006 file - promoters50/5663862
aagatttgaaag

SEQ ID NO: 197293 - DNA, 12 bp, Unknown
  misc_feature (1)..( 12): Result.006 file - promoters50/5663862
tttttttaattg

SEQ ID NO: 197294 - DNA, 12 bp, Unknown
  misc_feature (1)..( 12): Result.006 file - promoters50/5663862
tcaaattgattt

SEQ ID NO: 197295 - DNA, 12 bp, Unknown
  misc_feature (1)..( 12): Result.006 file - promoters50/5663862
aaggtttcattc

SEQ ID NO: 197296 - DNA, 10 bp, Unknown
  misc_feature (1)..( 10): Result.006 file - promoters50/5663862
aattttaaat

SEQ ID NO: 197297 - DNA, 10 bp, Unknown
  misc_feature (1)..( 10): Result.006 file - promoters50/5663862
aatttttgta

SEQ ID NO: 197298 - DNA, 10 bp, Unknown
  misc_feature (1)..( 10): Result.006 file - promoters50/5663862
tatttttaat

SEQ ID NO: 197299 - DNA, 10 bp, Unknown
  misc_feature (1)..( 10): Result.006 file - promoters50/5663862
aatctttcga

SEQ ID NO: 197300 - DNA, 10 bp, Unknown
  misc_feature (1)..( 10): Result.006 file - promoters50/5663862
aatgtttaca

SEQ ID NO: 197301 - DNA, 10 bp, Unknown
  misc_feature (1)..( 10): Result.006 file - promoters50/5663865
tattttttct

SEQ ID NO: 197302 - DNA, 10 bp, Unknown
  misc_feature (1)..( 10): Result.006 file - promoters50/5663865
aaccagacaa

SEQ ID NO: 197303 - DNA, 10 bp, Unknown
  misc_feature (1)..( 10): Result.006 file - promoters50/5663865
aaccatacag

SEQ ID NO: 197304 - DNA, 10 bp, Unknown
  misc_feature (1)..( 10): Result.006 file - promoters50/5663865
taccaaacaa

SEQ ID NO: 197305 - DNA, 9 bp, Unknown
  misc_feature (1)..( 9): Result.006 file - promoters50/5663865
aattaacaa

SEQ ID NO: 197306 - DNA, 9 bp, Unknown
  misc_feature (1)..( 9): Result.006 file - promoters50/5663865
ggttaacaa

SEQ ID NO: 197307 - DNA, 9 bp, Unknown
  misc_feature (1)..( 9): Result.006 file - promoters50/5663873
aatcaacaa

SEQ ID NO: 197308 - DNA, 8 bp, Unknown
  misc_feature (1)..( 8): Result.006 file - promoters50/5663873
cttgctta

SEQ ID NO: 197309 - DNA, 8 bp, Unknown
  misc_feature (1)..( 8): Result.006 file - promoters50/5663873
tttgttta

SEQ ID NO: 197310 - DNA, 8 bp, Unknown
  misc_feature (1)..( 8): Result.006 file - promoters50/5663873
tttgttct

SEQ ID NO: 197311 - DNA, 7 bp, Unknown
  misc_feature (1)..( 7): Result.006 file - promoters50/5663873
gttttgt

SEQ ID NO: 197312 - DNA, 7 bp, Unknown
  misc_feature (1)..( 7): Result.006 file - promoters50/5663873
tttttgt

SEQ ID NO: 197313 - DNA, 7 bp, Unknown
  misc_feature (1)..( 7): Result.006 file - promoters50/5663881
gttttgg

SEQ ID NO: 197314 - DNA, 10 bp, Unknown
  misc_feature (1)..( 10): Result.006 file - promoters50/5663881
atgatgatga

SEQ ID NO: 197315 - DNA, 10 bp, Unknown
  misc_feature (1)..( 10): Result.006 file - promoters50/5663881
atgatgaatt

SEQ ID NO: 197316 - DNA, 10 bp, Unknown
  misc_feature (1)..( 10): Result.006 file - promoters50/5663884
ttgattaatt

SEQ ID NO: 197317 - DNA, 10 bp, Unknown
  misc_feature (1)..( 10): Result.006 file - promoters50/5663884
gtaacatatt

SEQ ID NO: 197318 - DNA, 10 bp, Unknown
  misc_feature (1)..( 10): Result.006 file - promoters50/5663884
gtatcataat

SEQ ID NO: 197319 - DNA, 10 bp, Unknown
  misc_feature (1)..( 10): Result.006 file - promoters50/5663895
gggtcataat

SEQ ID NO: 197320 - DNA, 7 bp, Unknown
  misc_feature (1)..( 7): Result.006 file - promoters50/5663895
taagtat

SEQ ID NO: 197321 - DNA, 7 bp, Unknown
  misc_feature (1)..( 7): Result.006 file - promoters50/5663895
taaatat

SEQ ID NO: 197322 - DNA, 7 bp, Unknown
  misc_feature (1)..( 7): Result.006 file - promoters50/5663895
aaaatat

SEQ ID NO: 197323 - DNA, 7 bp, Unknown
  misc_feature (1)..( 7): Result.006 file - promoters50/5663895
attgttc

SEQ ID NO: 197324 - DNA, 7 bp, Unknown
  misc_feature (1)..( 7): Result.006 file - promoters50/5663895
attattc

SEQ ID NO: 197325 - DNA, 7 bp, Unknown
  misc_feature (1)..( 7): Result.006 file - promoters50/5663895
tttgttc

SEQ ID NO: 197326 - DNA, 9 bp, Unknown
  misc_feature (1)..( 9): Result.006 file - promoters50/5663895
tataattca

SEQ ID NO: 197327 - DNA, 9 bp, Unknown
  misc_feature (1)..( 9): Result.006 file - promoters50/5663895
tatcattcg

SEQ ID NO: 197328 - DNA, 9 bp, Unknown
  misc_feature (1)..( 9): Result.006 file - promoters50/5663895
gataagtca

SEQ ID NO: 197329 - DNA, 16 bp, Unknown
  misc_feature (1)..( 16): Result.006 file - promoters50/5663895
aatatttatgtttgct

SEQ ID NO: 197330 - DNA, 16 bp, Unknown
  misc_feature (1)..( 16): Result.006 file - promoters50/5663895
accttttatttttaac

SEQ ID NO: 197331 - DNA, 16 bp, Unknown
  misc_feature (1)..( 16): Result.006 file - promoters50/5663895
gatttttttttttttt

SEQ ID NO: 197332 - DNA, 16 bp, Unknown
  misc_feature (1)..( 16): Result.006 file - promoters50/5663895
agagtttttgtttttt

SEQ ID NO: 197333 - DNA, 10 bp, Unknown
  misc_feature (1)..( 10): Result.006 file - promoters50/5663895
acagcaaacc

SEQ ID NO: 197334 - DNA, 10 bp, Unknown
  misc_feature (1)..( 10): Result.006 file - promoters50/5663895
acaacaaaaa

SEQ ID NO: 197335 - DNA, 10 bp, Unknown
  misc_feature (1)..( 10): Result.006 file - promoters50/5663916
taaacaaaaa

SEQ ID NO: 197336 - DNA, 9 bp, Unknown
  misc_feature (1)..( 9): Result.006 file - promoters50/5663916
ctggtatat

SEQ ID NO: 197337 - DNA, 9 bp, Unknown
  misc_feature (1)..( 9): Result.006 file - promoters50/5663916
ctgatataa

SEQ ID NO: 197338 - DNA, 9 bp, Unknown
  misc_feature (1)..( 9): Result.006 file - promoters50/5663916
tttatataa

SEQ ID NO: 197339 - DNA, 8 bp, Unknown
  misc_feature (1)..( 8): Result.006 file - promoters50/5663916
ttttacaa

SEQ ID NO: 197340 - DNA, 8 bp, Unknown
  misc_feature (1)..( 8): Result.006 file - promoters50/5663916
tttgacat

SEQ ID NO: 197341 - DNA, 8 bp, Unknown
  misc_feature (1)..( 8): Result.006 file - promoters50/5663928
gttgtcat

SEQ ID NO: 197342 - DNA, 12 bp, Unknown
  misc_feature (1)..( 12): Result.006 file - promoters50/5663928
aaacattatcgt

SEQ ID NO: 197343 - DNA, 12 bp, Unknown
  misc_feature (1)..( 12): Result.006 file - promoters50/5663928
acccatcatcgt

SEQ ID NO: 197344 - DNA, 12 bp, Unknown
  misc_feature (1)..( 12): Result.006 file - promoters50/5663928
aaacataatctt

SEQ ID NO: 197345 - DNA, 7 bp, Unknown
  misc_feature (1)..( 7): Result.006 file - promoters50/5663928
aatgatt

SEQ ID NO: 197346 - DNA, 7 bp, Unknown
  misc_feature (1)..( 7): Result.006 file - promoters50/5663928
gatgatt

SEQ ID NO: 197347 - DNA, 7 bp, Unknown
  misc_feature (1)..( 7): Result.006 file - promoters50/5663934
gatgatg

SEQ ID NO: 197348 - DNA, 9 bp, Unknown
  misc_feature (1)..( 9): Result.006 file - promoters50/5663934
ttaaataaa

SEQ ID NO: 197349 - DNA, 9 bp, Unknown
  misc_feature (1)..( 9): Result.006 file - promoters50/5663934
agaaaaaaa

SEQ ID NO: 197350 - DNA, 9 bp, Unknown
  misc_feature (1)..( 9): Result.006 file - promoters50/5663934
gtaactaaa

SEQ ID NO: 197351 - DNA, 9 bp, Unknown
  misc_feature (1)..( 9): Result.006 file - promoters50/5663934
ataattaat

SEQ ID NO: 197352 - DNA, 9 bp, Unknown
  misc_feature (1)..( 9): Result.006 file - promoters50/5663934
ctaaagaaa

SEQ ID NO: 197353 - DNA, 9 bp, Unknown
  misc_feature (1)..( 9): Result.006 file - promoters50/5663934
ataatttac

SEQ ID NO: 197354 - DNA, 14 bp, Unknown
  misc_feature (1)..( 14): Result.006 file - promoters50/5663934
ttaaaaagtaattc

SEQ ID NO: 197355 - DNA, 14 bp, Unknown
  misc_feature (1)..( 14): Result.006 file - promoters50/5663934
ttacaaatctatcc

SEQ ID NO: 197356 - DNA, 14 bp, Unknown
  misc_feature (1)..( 14): Result.006 file - promoters50/5663934
aaaaaaagtttttg

SEQ ID NO: 197357 - DNA, 14 bp, Unknown
  misc_feature (1)..( 14): Result.006 file - promoters50/5663934
acacaaatttttac

SEQ ID NO: 197358 - DNA, 14 bp, Unknown
  misc_feature (1)..( 14): Result.006 file - promoters50/5663934
cctcaaacttttat

SEQ ID NO: 197359 - DNA, 14 bp, Unknown
  misc_feature (1)..( 14): Result.006 file - promoters50/5663934
aaacaaacaaaaaa

SEQ ID NO: 197360 - DNA, 13 bp, Unknown
  misc_feature (1)..( 13): Result.006 file - promoters50/5663934
ttaaactttgtct

SEQ ID NO: 197361 - DNA, 13 bp, Unknown
  misc_feature (1)..( 13): Result.006 file - promoters50/5663934
atttactttggaa

SEQ ID NO: 197362 - DNA, 13 bp, Unknown
  misc_feature (1)..( 13): Result.006 file - promoters50/5663934
ttaaattttggta

SEQ ID NO: 197363 - DNA, 13 bp, Unknown
  misc_feature (1)..( 13): Result.006 file - promoters50/5663934
attaatttcttct

SEQ ID NO: 197364 - DNA, 13 bp, Unknown
  misc_feature (1)..( 13): Result.006 file - promoters50/5663934
tgcttctttggat

SEQ ID NO: 197365 - DNA, 13 bp, Unknown
  misc_feature (1)..( 13): Result.006 file - promoters50/5663934
tatagagttggat

SEQ ID NO: 197366 - DNA, 10 bp, Unknown
  misc_feature (1)..( 10): Result.006 file - promoters50/5663934
acaaacaaaa

SEQ ID NO: 197367 - DNA, 10 bp, Unknown
  misc_feature (1)..( 10): Result.006 file - promoters50/5663934
aaaaataaac

SEQ ID NO: 197368 - DNA, 10 bp, Unknown
  misc_feature (1)..( 10): Result.006 file - promoters50/5663934
agtaacaaaa

SEQ ID NO: 197369 - DNA, 10 bp, Unknown
  misc_feature (1)..( 10): Result.006 file - promoters50/5663934
ggacataacc

SEQ ID NO: 197370 - DNA, 10 bp, Unknown
  misc_feature (1)..( 10): Result.006 file - promoters50/5663934
aaaaatactt

SEQ ID NO: 197371 - DNA, 10 bp, Unknown
  misc_feature (1)..( 10): Result.006 file - promoters50/5663934
agaaaaaaat

SEQ ID NO: 197372 - DNA, 10 bp, Unknown
  misc_feature (1)..( 10): Result.006 file - promoters50/5663934
cttaattaaa

SEQ ID NO: 197373 - DNA, 9 bp, Unknown
  misc_feature (1)..( 9): Result.006 file - promoters50/5663934
ttaatttcc

SEQ ID NO: 197374 - DNA, 10 bp, Unknown
  misc_feature (1)..( 10): Result.006 file - promoters50/5663934
agtaactaaa

SEQ ID NO: 197375 - DNA, 10 bp, Unknown
  misc_feature (1)..( 10): Result.006 file - promoters50/5663934
tataattaat

SEQ ID NO: 197376 - DNA, 10 bp, Unknown
  misc_feature (1)..( 10): Result.006 file - promoters50/5663934
cttaatgttt

SEQ ID NO: 197377 - DNA, 10 bp, Unknown
  misc_feature (1)..( 10): Result.006 file - promoters50/5663934
aataatttac

SEQ ID NO: 197378 - DNA, 10 bp, Unknown
  misc_feature (1)..( 10): Result.006 file - promoters50/5663934
gttgactaaa

SEQ ID NO: 197379 - DNA, 11 bp, Unknown
  misc_feature (1)..( 11): Result.006 file - promoters50/5663934
gataaatattc

SEQ ID NO: 197380 - DNA, 11 bp, Unknown
  misc_feature (1)..( 11): Result.006 file - promoters50/5663934
ataaaaaattt

SEQ ID NO: 197381 - DNA, 11 bp, Unknown
  misc_feature (1)..( 11): Result.006 file - promoters50/5663934
atgaaattttt

SEQ ID NO: 197382 - DNA, 11 bp, Unknown
  misc_feature (1)..( 11): Result.006 file - promoters50/5663934
ctatcattttt

SEQ ID NO: 197383 - DNA, 11 bp, Unknown
  misc_feature (1)..( 11): Result.006 file - promoters50/5663934
aagaaaaaaaa

SEQ ID NO: 197384 - DNA, 11 bp, Unknown
  misc_feature (1)..( 11): Result.006 file - promoters50/5663934
aagaaacaaag

SEQ ID NO: 197385 - DNA, 11 bp, Unknown
  misc_feature (1)..( 11): Result.006 file - promoters50/5663934
tcgaaccaatc

SEQ ID NO: 197386 - DNA, 13 bp, Unknown
  misc_feature (1)..( 13): Result.006 file - promoters50/5663934
agacctaagttta

SEQ ID NO: 197387 - DNA, 13 bp, Unknown
  misc_feature (1)..( 13): Result.006 file - promoters50/5663934
ttgtataatttta

SEQ ID NO: 197388 - DNA, 13 bp, Unknown
  misc_feature (1)..( 13): Result.006 file - promoters50/5663934
tgacataaatttt

SEQ ID NO: 197389 - DNA, 13 bp, Unknown
  misc_feature (1)..( 13): Result.006 file - promoters50/5663934
acaaagaattttt

SEQ ID NO: 197390 - DNA, 13 bp, Unknown
  misc_feature (1)..( 13): Result.006 file - promoters50/5663934
caacaaaaacaag

SEQ ID NO: 197391 - DNA, 13 bp, Unknown
  misc_feature (1)..( 13): Result.006 file - promoters50/5663946
tgatatattgttc

SEQ ID NO: 197392 - DNA, 8 bp, Unknown
  misc_feature (1)..( 8): Result.006 file - promoters50/5663946
taaagaaa

SEQ ID NO: 197393 - DNA, 8 bp, Unknown
  misc_feature (1)..( 8): Result.006 file - promoters50/5663946
gaaataaa

SEQ ID NO: 197394 - DNA, 8 bp, Unknown
  misc_feature (1)..( 8): Result.006 file - promoters50/5663946
taaagagc

SEQ ID NO: 197395 - DNA, 8 bp, Unknown
  misc_feature (1)..( 8): Result.006 file - promoters50/5663946
aaaataac

SEQ ID NO: 197396 - DNA, 10 bp, Unknown
  misc_feature (1)..( 10): Result.006 file - promoters50/5663946
tcaatttttc

SEQ ID NO: 197397 - DNA, 10 bp, Unknown
  misc_feature (1)..( 10): Result.006 file - promoters50/5663946
atgattttta

SEQ ID NO: 197398 - DNA, 10 bp, Unknown
  misc_feature (1)..( 10): Result.006 file - promoters50/5663946
cttattcttc

SEQ ID NO: 197399 - DNA, 10 bp, Unknown
  misc_feature (1)..( 10): Result.006 file - promoters50/5663946
cttagtcttt

SEQ ID NO: 197400 - DNA, 7 bp, Unknown
  misc_feature (1)..( 7): Result.006 file - promoters50/5663946
tttcttc

SEQ ID NO: 197401 - DNA, 7 bp, Unknown
  misc_feature (1)..( 7): Result.006 file - promoters50/5663946
tttctta

SEQ ID NO: 197402 - DNA, 7 bp, Unknown
  misc_feature (1)..( 7): Result.006 file - promoters50/5663946
tttcttc

SEQ ID NO: 197403 - DNA, 8 bp, Unknown
  misc_feature (1)..( 8): Result.006 file - promoters50/5663946
tttccttt

SEQ ID NO: 197404 - DNA, 12 bp, Unknown
  misc_feature (1)..( 12): Result.006 file - promoters50/5663946
aatttggtctta

SEQ ID NO: 197405 - DNA, 12 bp, Unknown
  misc_feature (1)..( 12): Result.006 file - promoters50/5663946
cattttgtccga

SEQ ID NO: 197406 - DNA, 12 bp, Unknown
  misc_feature (1)..( 12): Result.006 file - promoters50/5663946
aatttggttttg

SEQ ID NO: 197407 - DNA, 12 bp, Unknown
  misc_feature (1)..( 12): Result.006 file - promoters50/5663950
gtacttgttttt

SEQ ID NO: 197408 - DNA, 12 bp, Unknown
  misc_feature (1)..( 12): Result.006 file - promoters50/5663950
taaaaatttact

SEQ ID NO: 197409 - DNA, 12 bp, Unknown
  misc_feature (1)..( 12): Result.006 file - promoters50/5663950
aaaagatttgat

SEQ ID NO: 197410 - DNA, 12 bp, Unknown
  misc_feature (1)..( 12): Result.006 file - promoters50/5663950
cataaatttttt

SEQ ID NO: 197411 - DNA, 12 bp, Unknown
  misc_feature (1)..( 12): Result.006 file - promoters50/5663950
taaaaattatac

SEQ ID NO: 197412 - DNA, 12 bp, Unknown
  misc_feature (1)..( 12): Result.006 file - promoters50/5663950
ataagattgccg

SEQ ID NO: 197413 - DNA, 12 bp, Unknown
  misc_feature (1)..( 12): Result.006 file - promoters50/5663950
tacagattggtt

SEQ ID NO: 197414 - DNA, 12 bp, Unknown
  misc_feature (1)..( 12): Result.006 file - promoters50/5663954
cttcgattgttt

SEQ ID NO: 197415 - DNA, 11 bp, Unknown
  misc_feature (1)..( 11): Result.006 file - promoters50/5663954
ttgtctgagaa

SEQ ID NO: 197416 - DNA, 11 bp, Unknown
  misc_feature (1)..( 11): Result.006 file - promoters50/5663954
gaaattgagaa

SEQ ID NO: 197417 - DNA, 11 bp, Unknown
  misc_feature (1)..( 11): Result.006 file - promoters50/5663954
aattcttagaa

SEQ ID NO: 197418 - DNA, 11 bp, Unknown
  misc_feature (1)..( 11): Result.006 file - promoters50/5663954
aatacttacaa

SEQ ID NO: 197419 - DNA, 11 bp, Unknown
  misc_feature (1)..( 11): Result.006 file - promoters50/5663954
gtttcctagct

SEQ ID NO: 197420 - DNA, 11 bp, Unknown
  misc_feature (1)..( 11): Result.006 file - promoters50/5663954
aatactcgaag

SEQ ID NO: 197421 - DNA, 11 bp, Unknown
  misc_feature (1)..( 11): Result.006 file - promoters50/5663954
gaacatttttt

SEQ ID NO: 197422 - DNA, 11 bp, Unknown
  misc_feature (1)..( 11): Result.006 file - promoters50/5663954
gattgtttttt

SEQ ID NO: 197423 - DNA, 11 bp, Unknown
  misc_feature (1)..( 11): Result.006 file - promoters50/5663954
ttttgtttttg

SEQ ID NO: 197424 - DNA, 11 bp, Unknown
  misc_feature (1)..( 11): Result.006 file - promoters50/5663954
tttagttttaa

SEQ ID NO: 197425 - DNA, 11 bp, Unknown
  misc_feature (1)..( 11): Result.006 file - promoters50/5663954
cagagttttaa

SEQ ID NO: 197426 - DNA, 11 bp, Unknown
  misc_feature (1)..( 11): Result.006 file - promoters50/5663978
aaaagtttttg

SEQ ID NO: 197427 - DNA, 10 bp, Unknown
  misc_feature (1)..( 10): Result.006 file - promoters50/5663978
aggtaagatt

SEQ ID NO: 197428 - DNA, 10 bp, Unknown
  misc_feature (1)..( 10): Result.006 file - promoters50/5663978
tggtaacatt

SEQ ID NO: 197429 - DNA, 10 bp, Unknown
  misc_feature (1)..( 10): Result.006 file - promoters50/5663982
tggtaaagac

SEQ ID NO: 197430 - DNA, 8 bp, Unknown
  misc_feature (1)..( 8): Result.006 file - promoters50/5663982
agaaaatg

SEQ ID NO: 197431 - DNA, 8 bp, Unknown
  misc_feature (1)..( 8): Result.006 file - promoters50/5663982
agaaaaga

SEQ ID NO: 197432 - DNA, 8 bp, Unknown
  misc_feature (1)..( 8): Result.006 file - promoters50/5663982
agaaaaga

SEQ ID NO: 197433 - DNA, 9 bp, Unknown
  misc_feature (1)..( 9): Result.006 file - promoters50/5663982
gaaaatgat

SEQ ID NO: 197434 - DNA, 9 bp, Unknown
  misc_feature (1)..( 9): Result.006 file - promoters50/5663982
agaaaagat

SEQ ID NO: 197435 - DNA, 9 bp, Unknown
  misc_feature (1)..( 9): Result.006 file - promoters50/5663982
agaaaagaa

SEQ ID NO: 197436 - DNA, 9 bp, Unknown
  misc_feature (1)..( 9): Result.006 file - promoters50/5663982
agtggggtt

SEQ ID NO: 197437 - DNA, 9 bp, Unknown
  misc_feature (1)..( 9): Result.006 file - promoters50/5663982
tatggtgtt

SEQ ID NO: 197438 - DNA, 9 bp, Unknown
  misc_feature (1)..( 9): Result.006 file - promoters50/5663982
tatcgtgca

SEQ ID NO: 197439 - DNA, 7 bp, Unknown
  misc_feature (1)..( 7): Result.006 file - promoters50/5663982
aaacatt

SEQ ID NO: 197440 - DNA, 7 bp, Unknown
  misc_feature (1)..( 7): Result.006 file - promoters50/5663982
aaacata

SEQ ID NO: 197441 - DNA, 7 bp, Unknown
  misc_feature (1)..( 7): Result.006 file - promoters50/5663985
aaagata

SEQ ID NO: 197442 - DNA, 11 bp, Unknown
  misc_feature (1)..( 11): Result.006 file - promoters50/5663985
cgttttggtta

SEQ ID NO: 197443 - DNA, 11 bp, Unknown
  misc_feature (1)..( 11): Result.006 file - promoters50/5663985
catttttgtta

SEQ ID NO: 197444 - DNA, 11 bp, Unknown
  misc_feature (1)..( 11): Result.006 file - promoters50/5663985
cgtttcggtca

SEQ ID NO: 197445 - DNA, 11 bp, Unknown
  misc_feature (1)..( 11): Result.006 file - promoters50/5663985
aatttttagaa

SEQ ID NO: 197446 - DNA, 11 bp, Unknown
  misc_feature (1)..( 11): Result.006 file - promoters50/5663985
tctttttggtt

SEQ ID NO: 197447 - DNA, 11 bp, Unknown
  misc_feature (1)..( 11): Result.006 file - promoters50/5663985
ttttttggttt

SEQ ID NO: 197448 - DNA, 15 bp, Unknown
  misc_feature (1)..( 15): Result.006 file - promoters50/5663985
tttgttatcttgcaa

SEQ ID NO: 197449 - DNA, 15 bp, Unknown
  misc_feature (1)..( 15): Result.006 file - promoters50/5663985
tttattattttgaag

SEQ ID NO: 197450 - DNA, 15 bp, Unknown
  misc_feature (1)..( 15): Result.006 file - promoters50/5663985
aaatgtattttgatt

SEQ ID NO: 197451 - DNA, 15 bp, Unknown
  misc_feature (1)..( 15): Result.006 file - promoters50/5663985
tttttttttttggtt

SEQ ID NO: 197452 - DNA, 15 bp, Unknown
  misc_feature (1)..( 15): Result.006 file - promoters50/5663985
aaccaaattttaaag

SEQ ID NO: 197453 - DNA, 15 bp, Unknown
  misc_feature (1)..( 15): Result.006 file - promoters50/5663985
caatcaatttttttt

SEQ ID NO: 197454 - DNA, 15 bp, Unknown
  misc_feature (1)..( 15): Result.006 file - promoters50/5663985
cagagtgtatttgac

SEQ ID NO: 197455 - DNA, 15 bp, Unknown
  misc_feature (1)..( 15): Result.006 file - promoters50/5663985
aataggattgtaaca

SEQ ID NO: 197456 - DNA, 9 bp, Unknown
  misc_feature (1)..( 9): Result.006 file - promoters50/5663985
gatttatta

SEQ ID NO: 197457 - DNA, 9 bp, Unknown
  misc_feature (1)..( 9): Result.006 file - promoters50/5663985
tattcattt

SEQ ID NO: 197458 - DNA, 9 bp, Unknown
  misc_feature (1)..( 9): Result.006 file - promoters50/5663985
tttttttta

SEQ ID NO: 197459 - DNA, 9 bp, Unknown
  misc_feature (1)..( 9): Result.006 file - promoters50/5663985
gatttatta

SEQ ID NO: 197460 - DNA, 9 bp, Unknown
  misc_feature (1)..( 9): Result.006 file - promoters50/5663985
ttttgatta

SEQ ID NO: 197461 - DNA, 9 bp, Unknown
  misc_feature (1)..( 9): Result.006 file - promoters50/5663996
attttaaag

SEQ ID NO: 197462 - DNA, 15 bp, Unknown
  misc_feature (1)..( 15): Result.006 file - promoters50/5663996
aatctggaatcaaca

SEQ ID NO: 197463 - DNA, 15 bp, Unknown
  misc_feature (1)..( 15): Result.006 file - promoters50/5663996
ctctatgaatcatgt

SEQ ID NO: 197464 - DNA, 15 bp, Unknown
  misc_feature (1)..( 15): Result.006 file - promoters50/5663996
tcaaacaaatcaaat

SEQ ID NO: 197465 - DNA, 15 bp, Unknown
  misc_feature (1)..( 15): Result.006 file - promoters50/5663996
gtttatgaatctgct

SEQ ID NO: 197466 - DNA, 15 bp, Unknown
  misc_feature (1)..( 15): Result.006 file - promoters50/5663996
gtttatgaaggggtt

SEQ ID NO: 197467 - DNA, 15 bp, Unknown
  misc_feature (1)..( 15): Result.006 file - promoters50/5663996
acttggtaataatgt

SEQ ID NO: 197468 - DNA, 9 bp, Unknown
  misc_feature (1)..( 9): Result.006 file - promoters50/5663996
caacaatta

SEQ ID NO: 197469 - DNA, 9 bp, Unknown
  misc_feature (1)..( 9): Result.006 file - promoters50/5663996
taacaattt

SEQ ID NO: 197470 - DNA, 9 bp, Unknown
  misc_feature (1)..( 9): Result.006 file - promoters50/5663996
taacgattc

SEQ ID NO: 197471 - DNA, 10 bp, Unknown
  misc_feature (1)..( 10): Result.006 file - promoters50/5663996
caataagtta

SEQ ID NO: 197472 - DNA, 10 bp, Unknown
  misc_feature (1)..( 10): Result.006 file - promoters50/5663996
tgtcaaattt

SEQ ID NO: 197473 - DNA, 10 bp, Unknown
  misc_feature (1)..( 10): Result.006 file - promoters50/5663996
aatcaaatcg

SEQ ID NO: 197474 - DNA, 10 bp, Unknown
  misc_feature (1)..( 10): Result.006 file - promoters50/5663996
agataagttc

SEQ ID NO: 197475 - DNA, 14 bp, Unknown
  misc_feature (1)..( 14): Result.006 file - promoters50/5663996
ctgaatcgagaata

SEQ ID NO: 197476 - DNA, 14 bp, Unknown
  misc_feature (1)..( 14): Result.006 file - promoters50/5663996
ttgaatcaatattt

SEQ ID NO: 197477 - DNA, 14 bp, Unknown
  misc_feature (1)..( 14): Result.006 file - promoters50/5663996
ttgattcaaaattc

SEQ ID NO: 197478 - DNA, 14 bp, Unknown
  misc_feature (1)..( 14): Result.006 file - promoters50/5663996
tatcccaaaaatta

SEQ ID NO: 197479 - DNA, 14 bp, Unknown
  misc_feature (1)..( 14): Result.006 file - promoters50/5663996
cagacttaaaatct

SEQ ID NO: 197480 - DNA, 14 bp, Unknown
  misc_feature (1)..( 14): Result.006 file - promoters50/5664022
agaggtgaaactta

SEQ ID NO: 197481 - DNA, 8 bp, Unknown
  misc_feature (1)..( 8): Result.006 file - promoters50/5664022
acccaaat

SEQ ID NO: 197482 - DNA, 8 bp, Unknown
  misc_feature (1)..( 8): Result.006 file - promoters50/5664022
acccaaaa

SEQ ID NO: 197483 - DNA, 8 bp, Unknown
  misc_feature (1)..( 8): Result.006 file - promoters50/5664022
accaaaaa

SEQ ID NO: 197484 - DNA, 8 bp, Unknown
  misc_feature (1)..( 8): Result.006 file - promoters50/5664049
gccaaaaa

SEQ ID NO: 197485 - DNA, 8 bp, Unknown
  misc_feature (1)..( 8): Result.006 file - promoters50/5664049
acttattc

SEQ ID NO: 197486 - DNA, 8 bp, Unknown
  misc_feature (1)..( 8): Result.006 file - promoters50/5664049
tcttcttc

SEQ ID NO: 197487 - DNA, 8 bp, Unknown
  misc_feature (1)..( 8): Result.006 file - promoters50/5664060
tcttcttc

SEQ ID NO: 197488 - DNA, 11 bp, Unknown
  misc_feature (1)..( 11): Result.006 file - promoters50/5664060
aaacaattttc

SEQ ID NO: 197489 - DNA, 11 bp, Unknown
  misc_feature (1)..( 11): Result.006 file - promoters50/5664060
ttacaaattta

SEQ ID NO: 197490 - DNA, 11 bp, Unknown
  misc_feature (1)..( 11): Result.006 file - promoters50/5664060
gttcaaataat

SEQ ID NO: 197491 - DNA, 11 bp, Unknown
  misc_feature (1)..( 11): Result.006 file - promoters50/5664060
taacaattgaa

SEQ ID NO: 197492 - DNA, 11 bp, Unknown
  misc_feature (1)..( 11): Result.006 file - promoters50/5664060
aaaaaaatcta

SEQ ID NO: 197493 - DNA, 11 bp, Unknown
  misc_feature (1)..( 11): Result.006 file - promoters50/5664060
aaaaagttata

SEQ ID NO: 197494 - DNA, 11 bp, Unknown
  misc_feature (1)..( 11): Result.006 file - promoters50/5664072
acacagtgata

SEQ ID NO: 197495 - DNA, 8 bp, Unknown
  misc_feature (1)..( 8): Result.006 file - promoters50/5664072
atcttttt

SEQ ID NO: 197496 - DNA, 8 bp, Unknown
  misc_feature (1)..( 8): Result.006 file - promoters50/5664072
ctctattt

SEQ ID NO: 197497 - DNA, 8 bp, Unknown
  misc_feature (1)..( 8): Result.006 file - promoters50/5664080
ctccattg

SEQ ID NO: 197498 - DNA, 8 bp, Unknown
  misc_feature (1)..( 8): Result.006 file - promoters50/5664080
tgaagaaa

SEQ ID NO: 197499 - DNA, 8 bp, Unknown
  misc_feature (1)..( 8): Result.006 file - promoters50/5664080
tgatgaac

SEQ ID NO: 197500 - DNA, 8 bp, Unknown
  misc_feature (1)..( 8): Result.006 file - promoters50/5664080
agaaaaaa

SEQ ID NO: 197501 - DNA, 13 bp, Unknown
  misc_feature (1)..( 13): Result.006 file - promoters50/5664080
gaaactttgtgat

SEQ ID NO: 197502 - DNA, 13 bp, Unknown
  misc_feature (1)..( 13): Result.006 file - promoters50/5664080
gaatctttaagcc

SEQ ID NO: 197503 - DNA, 13 bp, Unknown
  misc_feature (1)..( 13): Result.006 file - promoters50/5664080
gaaacaaagaaac

SEQ ID NO: 197504 - DNA, 13 bp, Unknown
  misc_feature (1)..( 13): Result.006 file - promoters50/5664080
ctatctttaccat

SEQ ID NO: 197505 - DNA, 9 bp, Unknown
  misc_feature (1)..( 9): Result.006 file - promoters50/5664080
gcatcaagc

SEQ ID NO: 197506 - DNA, 9 bp, Unknown
  misc_feature (1)..( 9): Result.006 file - promoters50/5664080
acatcaatt

SEQ ID NO: 197507 - DNA, 9 bp, Unknown
  misc_feature (1)..( 9): Result.006 file - promoters50/5664080
acatctatt

SEQ ID NO: 197508 - DNA, 11 bp, Unknown
  misc_feature (1)..( 11): Result.006 file - promoters50/5664080
agatatcttgt

SEQ ID NO: 197509 - DNA, 11 bp, Unknown
  misc_feature (1)..( 11): Result.006 file - promoters50/5664080
agacatcaatt

SEQ ID NO: 197510 - DNA, 11 bp, Unknown
  misc_feature (1)..( 11): Result.006 file - promoters50/5664080
ccacatctatt

SEQ ID NO: 197511 - DNA, 10 bp, Unknown
  misc_feature (1)..( 10): Result.006 file - promoters50/5664080
ctttaaagat

SEQ ID NO: 197512 - DNA, 10 bp, Unknown
  misc_feature (1)..( 10): Result.006 file - promoters50/5664080
cttcaaaatt

SEQ ID NO: 197513 - DNA, 10 bp, Unknown
  misc_feature (1)..( 10): Result.006 file - promoters50/5664084
aatcaaaatt

SEQ ID NO: 197514 - DNA, 8 bp, Unknown
  misc_feature (1)..( 8): Result.006 file - promoters50/5664084
aaaattaa

SEQ ID NO: 197515 - DNA, 8 bp, Unknown
  misc_feature (1)..( 8): Result.006 file - promoters50/5664084
aaagttaa

SEQ ID NO: 197516 - DNA, 8 bp, Unknown
  misc_feature (1)..( 8): Result.006 file - promoters50/5664084
taagttaa

SEQ ID NO: 197517 - DNA, 11 bp, Unknown
  misc_feature (1)..( 11): Result.006 file - promoters50/5664084
ttttaattttt

SEQ ID NO: 197518 - DNA, 11 bp, Unknown
  misc_feature (1)..( 11): Result.006 file - promoters50/5664084
agttaaatttt

SEQ ID NO: 197519 - DNA, 11 bp, Unknown
  misc_feature (1)..( 11): Result.006 file - promoters50/5664084
ttttcattggc

SEQ ID NO: 197520 - DNA, 9 bp, Unknown
  misc_feature (1)..( 9): Result.006 file - promoters50/5664084
gccagaaaa

SEQ ID NO: 197521 - DNA, 9 bp, Unknown
  misc_feature (1)..( 9): Result.006 file - promoters50/5664084
tccataaac

SEQ ID NO: 197522 - DNA, 9 bp, Unknown
  misc_feature (1)..( 9): Result.006 file - promoters50/5664084
aaaagaaaa

SEQ ID NO: 197523 - DNA, 9 bp, Unknown
  misc_feature (1)..( 9): Result.006 file - promoters50/5664084
tccaaaaat

SEQ ID NO: 197524 - DNA, 10 bp, Unknown
  misc_feature (1)..( 10): Result.006 file - promoters50/5664084
tccaaaggat

SEQ ID NO: 197525 - DNA, 10 bp, Unknown
  misc_feature (1)..( 10): Result.006 file - promoters50/5664084
atcaaatgat

SEQ ID NO: 197526 - DNA, 10 bp, Unknown
  misc_feature (1)..( 10): Result.006 file - promoters50/5664084
atctaattga

SEQ ID NO: 197527 - DNA, 6 bp, Unknown
  misc_feature (1)..( 6): Result.006 file - promoters50/5664084
atataa

SEQ ID NO: 197528 - DNA, 6 bp, Unknown
  misc_feature (1)..( 6): Result.006 file - promoters50/5664084
atataa

SEQ ID NO: 197529 - DNA, 6 bp, Unknown
  misc_feature (1)..( 6): Result.006 file - promoters50/5664084
atataa

SEQ ID NO: 197530 - DNA, 8 bp, Unknown
  misc_feature (1)..( 8): Result.006 file - promoters50/5664084
tgtctctc

SEQ ID NO: 197531 - DNA, 8 bp, Unknown
  misc_feature (1)..( 8): Result.006 file - promoters50/5664084
tgtttctt

SEQ ID NO: 197532 - DNA, 8 bp, Unknown
  misc_feature (1)..( 8): Result.006 file - promoters50/5664088
tgtatctt

SEQ ID NO: 197533 - DNA, 9 bp, Unknown
  misc_feature (1)..( 9): Result.006 file - promoters50/5664088
gtagaaaaa

SEQ ID NO: 197534 - DNA, 9 bp, Unknown
  misc_feature (1)..( 9): Result.006 file - promoters50/5664088
agagaaaaa

SEQ ID NO: 197535 - DNA, 9 bp, Unknown
  misc_feature (1)..( 9): Result.006 file - promoters50/5664088
gtagcaaat

SEQ ID NO: 197536 - DNA, 11 bp, Unknown
  misc_feature (1)..( 11): Result.006 file - promoters50/5664088
gcatcaattaa

SEQ ID NO: 197537 - DNA, 11 bp, Unknown
  misc_feature (1)..( 11): Result.006 file - promoters50/5664088
gcatccattag

SEQ ID NO: 197538 - DNA, 11 bp, Unknown
  misc_feature (1)..( 11): Result.006 file - promoters50/5664088
gtaacaactaa

SEQ ID NO: 197539 - DNA, 11 bp, Unknown
  misc_feature (1)..( 11): Result.006 file - promoters50/5664088
gataaataata

SEQ ID NO: 197540 - DNA, 11 bp, Unknown
  misc_feature (1)..( 11): Result.006 file - promoters50/5664088
gcacaataatt

SEQ ID NO: 197541 - DNA, 11 bp, Unknown
  misc_feature (1)..( 11): Result.006 file - promoters50/5664088
aaaaaataaaa

SEQ ID NO: 197542 - DNA, 7 bp, Unknown
  misc_feature (1)..( 7): Result.006 file - promoters50/5664088
aaaatat

SEQ ID NO: 197543 - DNA, 7 bp, Unknown
  misc_feature (1)..( 7): Result.006 file - promoters50/5664088
gaaatat

SEQ ID NO: 197544 - DNA, 7 bp, Unknown
  misc_feature (1)..( 7): Result.006 file - promoters50/5664092
gaaataa

SEQ ID NO: 197545 - DNA, 9 bp, Unknown
  misc_feature (1)..( 9): Result.006 file - promoters50/5664092
tgatttgtt

SEQ ID NO: 197546 - DNA, 9 bp, Unknown
  misc_feature (1)..( 9): Result.006 file - promoters50/5664092
tgatttgaa

SEQ ID NO: 197547 - DNA, 9 bp, Unknown
  misc_feature (1)..( 9): Result.006 file - promoters50/5664092
gaatttgaa

SEQ ID NO: 197548 - DNA, 9 bp, Unknown
  misc_feature (1)..( 9): Result.006 file - promoters50/5664092
cactttgaa

SEQ ID NO: 197549 - DNA, 8 bp, Unknown
  misc_feature (1)..( 8): Result.006 file - promoters50/5664092
gaaaaaat

SEQ ID NO: 197550 - DNA, 8 bp, Unknown
  misc_feature (1)..( 8): Result.006 file - promoters50/5664092
gaataaag

SEQ ID NO: 197551 - DNA, 8 bp, Unknown
  misc_feature (1)..( 8): Result.006 file - promoters50/5664095
taaagaat

SEQ ID NO: 197552 - DNA, 7 bp, Unknown
  misc_feature (1)..( 7): Result.006 file - promoters50/5664095
agttatt

SEQ ID NO: 197553 - DNA, 7 bp, Unknown
  misc_feature (1)..( 7): Result.006 file - promoters50/5664095
agtcatt

SEQ ID NO: 197554 - DNA, 7 bp, Unknown
  misc_feature (1)..( 7): Result.006 file - promoters50/5664115
agtaatt

SEQ ID NO: 197555 - DNA, 8 bp, Unknown
  misc_feature (1)..( 8): Result.006 file - promoters50/5664115
aaactaaa

SEQ ID NO: 197556 - DNA, 8 bp, Unknown
  misc_feature (1)..( 8): Result.006 file - promoters50/5664115
gaaccaaa

SEQ ID NO: 197557 - DNA, 8 bp, Unknown
  misc_feature (1)..( 8): Result.006 file - promoters50/5664115
aaaataat

SEQ ID NO: 197558 - DNA, 9 bp, Unknown
  misc_feature (1)..( 9): Result.006 file - promoters50/5664115
caaaagtta

SEQ ID NO: 197559 - DNA, 9 bp, Unknown
  misc_feature (1)..( 9): Result.006 file - promoters50/5664115
caaaaatta

SEQ ID NO: 197560 - DNA, 9 bp, Unknown
  misc_feature (1)..( 9): Result.006 file - promoters50/5664115
caaaaaaat

SEQ ID NO: 197561 - DNA, 9 bp, Unknown
  misc_feature (1)..( 9): Result.006 file - promoters50/5664115
gatcacatt

SEQ ID NO: 197562 - DNA, 9 bp, Unknown
  misc_feature (1)..( 9): Result.006 file - promoters50/5664115
tatctcatt

SEQ ID NO: 197563 - DNA, 9 bp, Unknown
  misc_feature (1)..( 9): Result.006 file - promoters50/5664115
tatttcaat

SEQ ID NO: 197564 - DNA, 13 bp, Unknown
  misc_feature (1)..( 13): Result.006 file - promoters50/5664115
gaaagaaagaaaa

SEQ ID NO: 197565 - DNA, 13 bp, Unknown
  misc_feature (1)..( 13): Result.006 file - promoters50/5664115
caaaaaaaaaaaa

SEQ ID NO: 197566 - DNA, 13 bp, Unknown
  misc_feature (1)..( 13): Result.006 file - promoters50/5664115
caataaagtagtt

SEQ ID NO: 197567 - DNA, 11 bp, Unknown
  misc_feature (1)..( 11): Result.006 file - promoters50/5664115
ttaataaaacg

SEQ ID NO: 197568 - DNA, 11 bp, Unknown
  misc_feature (1)..( 11): Result.006 file - promoters50/5664115
ttagtaaaacc

SEQ ID NO: 197569 - DNA, 11 bp, Unknown
  misc_feature (1)..( 11): Result.006 file - promoters50/5664115
tcaataaaata

SEQ ID NO: 197570 - DNA, 11 bp, Unknown
  misc_feature (1)..( 11): Result.006 file - promoters50/5664115
tgtgtagaacc

SEQ ID NO: 197571 - DNA, 7 bp, Unknown
  misc_feature (1)..( 7): Result.006 file - promoters50/5664115
atataaa

SEQ ID NO: 197572 - DNA, 7 bp, Unknown
  misc_feature (1)..( 7): Result.006 file - promoters50/5664115
atataaa

SEQ ID NO: 197573 - DNA, 7 bp, Unknown
  misc_feature (1)..( 7): Result.006 file - promoters50/5664126
atataat

SEQ ID NO: 197574 - DNA, 7 bp, Unknown
  misc_feature (1)..( 7): Result.006 file - promoters50/5664126
attctac

SEQ ID NO: 197575 - DNA, 7 bp, Unknown
  misc_feature (1)..( 7): Result.006 file - promoters50/5664126
attatac

SEQ ID NO: 197576 - DNA, 7 bp, Unknown
  misc_feature (1)..( 7): Result.006 file - promoters50/5664126
tttctac

SEQ ID NO: 197577 - DNA, 7 bp, Unknown
  misc_feature (1)..( 7): Result.006 file - promoters50/5664126
gaaaatc

SEQ ID NO: 197578 - DNA, 7 bp, Unknown
  misc_feature (1)..( 7): Result.006 file - promoters50/5664126
gaaaata

SEQ ID NO: 197579 - DNA, 7 bp, Unknown
  misc_feature (1)..( 7): Result.006 file - promoters50/5664126
aaaaatc

SEQ ID NO: 197580 - DNA, 14 bp, Unknown
  misc_feature (1)..( 14): Result.006 file - promoters50/5664126
taattcagaaaaat

SEQ ID NO: 197581 - DNA, 14 bp, Unknown
  misc_feature (1)..( 14): Result.006 file - promoters50/5664126
ggagtcagaaaaat

SEQ ID NO: 197582 - DNA, 14 bp, Unknown
  misc_feature (1)..( 14): Result.006 file - promoters50/5664126
taattgagaatccg

SEQ ID NO: 197583 - DNA, 14 bp, Unknown
  misc_feature (1)..( 14): Result.006 file - promoters50/5664126
tttttctgaaggaa

SEQ ID NO: 197584 - DNA, 8 bp, Unknown
  misc_feature (1)..( 8): Result.006 file - promoters50/5664126
aatatatg

SEQ ID NO: 197585 - DNA, 8 bp, Unknown
  misc_feature (1)..( 8): Result.006 file - promoters50/5664126
aatataaa

SEQ ID NO: 197586 - DNA, 8 bp, Unknown
  misc_feature (1)..( 8): Result.006 file - promoters50/5664126
aatgtaaa

SEQ ID NO: 197587 - DNA, 8 bp, Unknown
  misc_feature (1)..( 8): Result.006 file - promoters50/5664126
aaaattct

SEQ ID NO: 197588 - DNA, 8 bp, Unknown
  misc_feature (1)..( 8): Result.006 file - promoters50/5664126
aaaattgt

SEQ ID NO: 197589 - DNA, 8 bp, Unknown
  misc_feature (1)..( 8): Result.006 file - promoters50/5664126
taaatttc

SEQ ID NO: 197590 - DNA, 8 bp, Unknown
  misc_feature (1)..( 8): Result.006 file - promoters50/5664126
aacagaaa

SEQ ID NO: 197591 - DNA, 8 bp, Unknown
  misc_feature (1)..( 8): Result.006 file - promoters50/5664126
aactgaag

SEQ ID NO: 197592 - DNA, 8 bp, Unknown
  misc_feature (1)..( 8): Result.006 file - promoters50/5664126
aaccgaaa

SEQ ID NO: 197593 - DNA, 7 bp, Unknown
  misc_feature (1)..( 7): Result.006 file - promoters50/5664126
tttattt

SEQ ID NO: 197594 - DNA, 7 bp, Unknown
  misc_feature (1)..( 7): Result.006 file - promoters50/5664126
tttattt

SEQ ID NO: 197595 - DNA, 7 bp, Unknown
  misc_feature (1)..( 7): Result.006 file - promoters50/5664126
tttgttt

SEQ ID NO: 197596 - DNA, 8 bp, Unknown
  misc_feature (1)..( 8): Result.006 file - promoters50/5664126
taatttgt

SEQ ID NO: 197597 - DNA, 8 bp, Unknown
  misc_feature (1)..( 8): Result.006 file - promoters50/5664126
taatttgt

SEQ ID NO: 197598 - DNA, 8 bp, Unknown
  misc_feature (1)..( 8): Result.006 file - promoters50/5664126
agatttgt

SEQ ID NO: 197599 - DNA, 16 bp, Unknown
  misc_feature (1)..( 16): Result.006 file - promoters50/5664126
gttcggttcggtttaa

SEQ ID NO: 197600 - DNA, 16 bp, Unknown
  misc_feature (1)..( 16): Result.006 file - promoters50/5664126
gttcggttcggtttac

SEQ ID NO: 197601 - DNA, 16 bp, Unknown
  misc_feature (1)..( 16): Result.006 file - promoters50/5664126
tgaagagtaagtttac

SEQ ID NO: 197602 - DNA, 9 bp, Unknown
  misc_feature (1)..( 9): Result.006 file - promoters50/5664126
aaaatatat

SEQ ID NO: 197603 - DNA, 9 bp, Unknown
  misc_feature (1)..( 9): Result.006 file - promoters50/5664126
taaatatat

SEQ ID NO: 197604 - DNA, 9 bp, Unknown
  misc_feature (1)..( 9): Result.006 file - promoters50/5664133
aaaataacc

SEQ ID NO: 197605 - DNA, 10 bp, Unknown
  misc_feature (1)..( 10): Result.006 file - promoters50/5664133
gaacttaatt

SEQ ID NO: 197606 - DNA, 10 bp, Unknown
  misc_feature (1)..( 10): Result.006 file - promoters50/5664133
aaacataatt

SEQ ID NO: 197607 - DNA, 10 bp, Unknown
  misc_feature (1)..( 10): Result.006 file - promoters50/5664133
aaacatatcc

SEQ ID NO: 197608 - DNA, 9 bp, Unknown
  misc_feature (1)..( 9): Result.006 file - promoters50/5664133
gtaaacaca

SEQ ID NO: 197609 - DNA, 9 bp, Unknown
  misc_feature (1)..( 9): Result.006 file - promoters50/5664133
ataaacatg

SEQ ID NO: 197610 - DNA, 9 bp, Unknown
  misc_feature (1)..( 9): Result.006 file - promoters50/5664133
ataaaaatg

SEQ ID NO: 197611 - DNA, 8 bp, Unknown
  misc_feature (1)..( 8): Result.006 file - promoters50/5664133
caaacaaa

SEQ ID NO: 197612 - DNA, 8 bp, Unknown
  misc_feature (1)..( 8): Result.006 file - promoters50/5664133
gaaaaaaa

SEQ ID NO: 197613 - DNA, 8 bp, Unknown
  misc_feature (1)..( 8): Result.006 file - promoters50/5664133
caaacata

SEQ ID NO: 197614 - DNA, 8 bp, Unknown
  misc_feature (1)..( 8): Result.006 file - promoters50/5664133
aaaacata

SEQ ID NO: 197615 - DNA, 7 bp, Unknown
  misc_feature (1)..( 7): Result.006 file - promoters50/5664133
caaacaa

SEQ ID NO: 197616 - DNA, 7 bp, Unknown
  misc_feature (1)..( 7): Result.006 file - promoters50/5664133
caaacat

SEQ ID NO: 197617 - DNA, 7 bp, Unknown
  misc_feature (1)..( 7): Result.006 file - promoters50/5664133
caaccat

SEQ ID NO: 197618 - DNA, 7 bp, Unknown
  misc_feature (1)..( 7): Result.006 file - promoters50/5664133
tcacaaa

SEQ ID NO: 197619 - DNA, 7 bp, Unknown
  misc_feature (1)..( 7): Result.006 file - promoters50/5664133
tcacaag

SEQ ID NO: 197620 - DNA, 7 bp, Unknown
  misc_feature (1)..( 7): Result.006 file - promoters50/5664133
ccacaaa

SEQ ID NO: 197621 - DNA, 9 bp, Unknown
  misc_feature (1)..( 9): Result.006 file - promoters50/5664133
aattaagtt

SEQ ID NO: 197622 - DNA, 9 bp, Unknown
  misc_feature (1)..( 9): Result.006 file - promoters50/5664133
aattaaaaa

SEQ ID NO: 197623 - DNA, 9 bp, Unknown
  misc_feature (1)..( 9): Result.006 file - promoters50/5664133
cattaagtt

SEQ ID NO: 197624 - DNA, 8 bp, Unknown
  misc_feature (1)..( 8): Result.006 file - promoters50/5664133
cacaaaac

SEQ ID NO: 197625 - DNA, 8 bp, Unknown
  misc_feature (1)..( 8): Result.006 file - promoters50/5664133
aacaaaac

SEQ ID NO: 197626 - DNA, 8 bp, Unknown
  misc_feature (1)..( 8): Result.006 file - promoters50/5664141
cacaaaca

SEQ ID NO: 197627 - DNA, 11 bp, Unknown
  misc_feature (1)..( 11): Result.006 file - promoters50/5664141
ttattatttac

SEQ ID NO: 197628 - DNA, 11 bp, Unknown
  misc_feature (1)..( 11): Result.006 file - promoters50/5664141
tgatttttttt

SEQ ID NO: 197629 - DNA, 11 bp, Unknown
  misc_feature (1)..( 11): Result.006 file - promoters50/5664141
ctataatttga

SEQ ID NO: 197630 - DNA, 12 bp, Unknown
  misc_feature (1)..( 12): Result.006 file - promoters50/5664141
gtatttgttttc

SEQ ID NO: 197631 - DNA, 12 bp, Unknown
  misc_feature (1)..( 12): Result.006 file - promoters50/5664141
atttgagttttt

SEQ ID NO: 197632 - DNA, 12 bp, Unknown
  misc_feature (1)..( 12): Result.006 file - promoters50/5664141
tgatttgtttgc

SEQ ID NO: 197633 - DNA, 15 bp, Unknown
  misc_feature (1)..( 15): Result.006 file - promoters50/5664141
atcttttttactgta

SEQ ID NO: 197634 - DNA, 15 bp, Unknown
  misc_feature (1)..( 15): Result.006 file - promoters50/5664141
aaagctttaactacg

SEQ ID NO: 197635 - DNA, 15 bp, Unknown
  misc_feature (1)..( 15): Result.006 file - promoters50/5664141
aaagatttaagagac

SEQ ID NO: 197636 - DNA, 15 bp, Unknown
  misc_feature (1)..( 15): Result.006 file - promoters50/5664141
ttatatgaaaggatc

SEQ ID NO: 197637 - DNA, 15 bp, Unknown
  misc_feature (1)..( 15): Result.006 file - promoters50/5664141
ttggattctatgaaa

SEQ ID NO: 197638 - DNA, 15 bp, Unknown
  misc_feature (1)..( 15): Result.006 file - promoters50/5664141
tatcttgcaaggatg

SEQ ID NO: 197639 - DNA, 11 bp, Unknown
  misc_feature (1)..( 11): Result.006 file - promoters50/5664141
aattaaaaata

SEQ ID NO: 197640 - DNA, 11 bp, Unknown
  misc_feature (1)..( 11): Result.006 file - promoters50/5664141
gtataaaaaca

SEQ ID NO: 197641 - DNA, 11 bp, Unknown
  misc_feature (1)..( 11): Result.006 file - promoters50/5664141
atataaatata

SEQ ID NO: 197642 - DNA, 11 bp, Unknown
  misc_feature (1)..( 11): Result.006 file - promoters50/5664141
ttctaaaaaga

SEQ ID NO: 197643 - DNA, 11 bp, Unknown
  misc_feature (1)..( 11): Result.006 file - promoters50/5664141
tattaaacccc

SEQ ID NO: 197644 - DNA, 11 bp, Unknown
  misc_feature (1)..( 11): Result.006 file - promoters50/5664141
tcataaaccct

SEQ ID NO: 197645 - DNA, 10 bp, Unknown
  misc_feature (1)..( 10): Result.006 file - promoters50/5664141
gaataaaaac

SEQ ID NO: 197646 - DNA, 10 bp, Unknown
  misc_feature (1)..( 10): Result.006 file - promoters50/5664141
tgataaaaag

SEQ ID NO: 197647 - DNA, 10 bp, Unknown
  misc_feature (1)..( 10): Result.006 file - promoters50/5664141
caataaaagt

SEQ ID NO: 197648 - DNA, 10 bp, Unknown
  misc_feature (1)..( 10): Result.006 file - promoters50/5664141
tcttaaaaac

SEQ ID NO: 197649 - DNA, 10 bp, Unknown
  misc_feature (1)..( 10): Result.006 file - promoters50/5664141
gattaaatgt

SEQ ID NO: 197650 - DNA, 10 bp, Unknown
  misc_feature (1)..( 10): Result.006 file - promoters50/5664149
ctcgaaaaag

SEQ ID NO: 197651 - DNA, 8 bp, Unknown
  misc_feature (1)..( 8): Result.006 file - promoters50/5664149
ttatgtga

SEQ ID NO: 197652 - DNA, 8 bp, Unknown
  misc_feature (1)..( 8): Result.006 file - promoters50/5664149
ttatgtac

SEQ ID NO: 197653 - DNA, 8 bp, Unknown
  misc_feature (1)..( 8): Result.006 file - promoters50/5664149
atatatac

SEQ ID NO: 197654 - DNA, 7 bp, Unknown
  misc_feature (1)..( 7): Result.006 file - promoters50/5664149
ataatag

SEQ ID NO: 197655 - DNA, 7 bp, Unknown
  misc_feature (1)..( 7): Result.006 file - promoters50/5664149
ataatac

SEQ ID NO: 197656 - DNA, 7 bp, Unknown
  misc_feature (1)..( 7): Result.006 file - promoters50/5664149
ttaatac

SEQ ID NO: 197657 - DNA, 11 bp, Unknown
  misc_feature (1)..( 11): Result.006 file - promoters50/5664149
taaaacaatct

SEQ ID NO: 197658 - DNA, 11 bp, Unknown
  misc_feature (1)..( 11): Result.006 file - promoters50/5664149
taatacattct

SEQ ID NO: 197659 - DNA, 11 bp, Unknown
  misc_feature (1)..( 11): Result.006 file - promoters50/5664153
taataccaacc

SEQ ID NO: 197660 - DNA, 10 bp, Unknown
  misc_feature (1)..( 10): Result.006 file - promoters50/5664153
tagtttaaaa

SEQ ID NO: 197661 - DNA, 10 bp, Unknown
  misc_feature (1)..( 10): Result.006 file - promoters50/5664153
atttttcaaa

SEQ ID NO: 197662 - DNA, 10 bp, Unknown
  misc_feature (1)..( 10): Result.006 file - promoters50/5664153
aaatttgaaa

SEQ ID NO: 197663 - DNA, 10 bp, Unknown
  misc_feature (1)..( 10): Result.006 file - promoters50/5664153
gtgtttcaaa

SEQ ID NO: 197664 - DNA, 10 bp, Unknown
  misc_feature (1)..( 10): Result.006 file - promoters50/5664153
attcttcagt

SEQ ID NO: 197665 - DNA, 8 bp, Unknown
  misc_feature (1)..( 8): Result.006 file - promoters50/5664153
ataccaaa

SEQ ID NO: 197666 - DNA, 8 bp, Unknown
  misc_feature (1)..( 8): Result.006 file - promoters50/5664153
gtactaaa

SEQ ID NO: 197667 - DNA, 8 bp, Unknown
  misc_feature (1)..( 8): Result.006 file - promoters50/5664153
gtaataac

SEQ ID NO: 197668 - DNA, 8 bp, Unknown
  misc_feature (1)..( 8): Result.006 file - promoters50/5664174
ataaaaac

SEQ ID NO: 197669 - DNA, 10 bp, Unknown
  misc_feature (1)..( 10): Result.006 file - promoters50/5664174
atccaagatc

SEQ ID NO: 197670 - DNA, 10 bp, Unknown
  misc_feature (1)..( 10): Result.006 file - promoters50/5664174
atccaatgta

SEQ ID NO: 197671 - DNA, 10 bp, Unknown
  misc_feature (1)..( 10): Result.006 file - promoters50/5664174
atcaaatgta

SEQ ID NO: 197672 - DNA, 10 bp, Unknown
  misc_feature (1)..( 10): Result.006 file - promoters50/5664174
aatcaaagtc

SEQ ID NO: 197673 - DNA, 10 bp, Unknown
  misc_feature (1)..( 10): Result.006 file - promoters50/5664174
aattaaaaaa

SEQ ID NO: 197674 - DNA, 11 bp, Unknown
  misc_feature (1)..( 11): Result.006 file - promoters50/5664174
tattacaaaac

SEQ ID NO: 197675 - DNA, 12 bp, Unknown
  misc_feature (1)..( 12): Result.006 file - promoters50/5664174
tggtaatttaac

SEQ ID NO: 197676 - DNA, 12 bp, Unknown
  misc_feature (1)..( 12): Result.006 file - promoters50/5664174
atccaatgtaac

SEQ ID NO: 197677 - DNA, 12 bp, Unknown
  misc_feature (1)..( 12): Result.006 file - promoters50/5664174
atcaaatgtatt

SEQ ID NO: 197678 - DNA, 8 bp, Unknown
  misc_feature (1)..( 8): Result.006 file - promoters50/5664174
ttttgatt

SEQ ID NO: 197679 - DNA, 8 bp, Unknown
  misc_feature (1)..( 8): Result.006 file - promoters50/5664174
ttttgacg

SEQ ID NO: 197680 - DNA, 8 bp, Unknown
  misc_feature (1)..( 8): Result.006 file - promoters50/5664178
tttttatt

SEQ ID NO: 197681 - DNA, 9 bp, Unknown
  misc_feature (1)..( 9): Result.006 file - promoters50/5664178
tttatatat

SEQ ID NO: 197682 - DNA, 9 bp, Unknown
  misc_feature (1)..( 9): Result.006 file - promoters50/5664178
tttttataa

SEQ ID NO: 197683 - DNA, 9 bp, Unknown
  misc_feature (1)..( 9): Result.006 file - promoters50/5664178
tatatatat

SEQ ID NO: 197684 - DNA, 8 bp, Unknown
  misc_feature (1)..( 8): Result.006 file - promoters50/5664178
taaaagat

SEQ ID NO: 197685 - DNA, 8 bp, Unknown
  misc_feature (1)..( 8): Result.006 file - promoters50/5664178
taaaagaa

SEQ ID NO: 197686 - DNA, 8 bp, Unknown
  misc_feature (1)..( 8): Result.006 file - promoters50/5664178
tgaaagaa

SEQ ID NO: 197687 - DNA, 10 bp, Unknown
  misc_feature (1)..( 10): Result.006 file - promoters50/5664178
aaaaacaaaa

SEQ ID NO: 197688 - DNA, 10 bp, Unknown
  misc_feature (1)..( 10): Result.006 file - promoters50/5664178
aaacacaaac

SEQ ID NO: 197689 - DNA, 10 bp, Unknown
  misc_feature (1)..( 10): Result.006 file - promoters50/5664178
aagtacaaaa

SEQ ID NO: 197690 - DNA, 10 bp, Unknown
  misc_feature (1)..( 10): Result.006 file - promoters50/5664178
ttatttgttt

SEQ ID NO: 197691 - DNA, 10 bp, Unknown
  misc_feature (1)..( 10): Result.006 file - promoters50/5664178
ttatttatac

SEQ ID NO: 197692 - DNA, 10 bp, Unknown
  misc_feature (1)..( 10): Result.006 file - promoters50/5664178
tttttttata

SEQ ID NO: 197693 - DNA, 10 bp, Unknown
  misc_feature (1)..( 10): Result.006 file - promoters50/5664178
aagaggattg

SEQ ID NO: 197694 - DNA, 10 bp, Unknown
  misc_feature (1)..( 10): Result.006 file - promoters50/5664178
gagaggcttg

SEQ ID NO: 197695 - DNA, 10 bp, Unknown
  misc_feature (1)..( 10): Result.006 file - promoters50/5664178
aagatgatgt

SEQ ID NO: 197696 - DNA, 9 bp, Unknown
  misc_feature (1)..( 9): Result.006 file - promoters50/5664178
aaaaaggcc

SEQ ID NO: 197697 - DNA, 9 bp, Unknown
  misc_feature (1)..( 9): Result.006 file - promoters50/5664178
aaaaagagt

SEQ ID NO: 197698 - DNA, 9 bp, Unknown
  misc_feature (1)..( 9): Result.006 file - promoters50/5664186
ttaaaggag

SEQ ID NO: 197699 - DNA, 8 bp, Unknown
  misc_feature (1)..( 8): Result.006 file - promoters50/5664186
ttcttctc

SEQ ID NO: 197700 - DNA, 8 bp, Unknown
  misc_feature (1)..( 8): Result.006 file - promoters50/5664186
ttcttcgt

SEQ ID NO: 197701 - DNA, 8 bp, Unknown
  misc_feature (1)..( 8): Result.006 file - promoters50/5664186
ctcttcgt

SEQ ID NO: 197702 - DNA, 9 bp, Unknown
  misc_feature (1)..( 9): Result.006 file - promoters50/5664186
ctctccacc

SEQ ID NO: 197703 - DNA, 9 bp, Unknown
  misc_feature (1)..( 9): Result.006 file - promoters50/5664186
gtcttcacc

SEQ ID NO: 197704 - DNA, 9 bp, Unknown
  misc_feature (1)..( 9): Result.006 file - promoters50/5664186
ctcaccaag

SEQ ID NO: 197705 - DNA, 9 bp, Unknown
  misc_feature (1)..( 9): Result.006 file - promoters50/5664186
gttcttcgt

SEQ ID NO: 197706 - DNA, 9 bp, Unknown
  misc_feature (1)..( 9): Result.006 file - promoters50/5664186
actcttcgt

SEQ ID NO: 197707 - DNA, 9 bp, Unknown
  misc_feature (1)..( 9): Result.006 file - promoters50/5664186
actattctt

SEQ ID NO: 197708 - DNA, 8 bp, Unknown
  misc_feature (1)..( 8): Result.006 file - promoters50/5664186
taaacatt

SEQ ID NO: 197709 - DNA, 8 bp, Unknown
  misc_feature (1)..( 8): Result.006 file - promoters50/5664186
caaagatt

SEQ ID NO: 197710 - DNA, 8 bp, Unknown
  misc_feature (1)..( 8): Result.006 file - promoters50/5664209
taaacaaa

SEQ ID NO: 197711 - DNA, 7 bp, Unknown
  misc_feature (1)..( 7): Result.006 file - promoters50/5664209
aagaaaa

SEQ ID NO: 197712 - DNA, 7 bp, Unknown
  misc_feature (1)..( 7): Result.006 file - promoters50/5664209
aagtaaa

SEQ ID NO: 197713 - DNA, 7 bp, Unknown
  misc_feature (1)..( 7): Result.006 file - promoters50/5664209
gagtaaa

SEQ ID NO: 197714 - DNA, 10 bp, Unknown
  misc_feature (1)..( 10): Result.006 file - promoters50/5664209
tgatacaatt

SEQ ID NO: 197715 - DNA, 10 bp, Unknown
  misc_feature (1)..( 10): Result.006 file - promoters50/5664209
aaataaaata

SEQ ID NO: 197716 - DNA, 10 bp, Unknown
  misc_feature (1)..( 10): Result.006 file - promoters50/5664209
aaatgaaata

SEQ ID NO: 197717 - DNA, 11 bp, Unknown
  misc_feature (1)..( 11): Result.006 file - promoters50/5664209
agactaataag

SEQ ID NO: 197718 - DNA, 11 bp, Unknown
  misc_feature (1)..( 11): Result.006 file - promoters50/5664209
agagtaaaaag

SEQ ID NO: 197719 - DNA, 11 bp, Unknown
  misc_feature (1)..( 11): Result.006 file - promoters50/5664216
tagataataat

SEQ ID NO: 197720 - DNA, 10 bp, Unknown
  misc_feature (1)..( 10): Result.006 file - promoters50/5664216
acttgacaca

SEQ ID NO: 197721 - DNA, 10 bp, Unknown
  misc_feature (1)..( 10): Result.006 file - promoters50/5664216
atttgataca

SEQ ID NO: 197722 - DNA, 10 bp, Unknown
  misc_feature (1)..( 10): Result.006 file - promoters50/5664216
atttgatcgg

SEQ ID NO: 197723 - DNA, 10 bp, Unknown
  misc_feature (1)..( 10): Result.006 file - promoters50/5664216
atttaataaa

SEQ ID NO: 197724 - DNA, 10 bp, Unknown
  misc_feature (1)..( 10): Result.006 file - promoters50/5664216
tgttgctcgg

SEQ ID NO: 197725 - DNA, 10 bp, Unknown
  misc_feature (1)..( 10): Result.006 file - promoters50/5664216
gtttaatttg

SEQ ID NO: 197726 - DNA, 10 bp, Unknown
  misc_feature (1)..( 10): Result.006 file - promoters50/5664216
ttataaatac

SEQ ID NO: 197727 - DNA, 10 bp, Unknown
  misc_feature (1)..( 10): Result.006 file - promoters50/5664216
atataaatcc

SEQ ID NO: 197728 - DNA, 10 bp, Unknown
  misc_feature (1)..( 10): Result.006 file - promoters50/5664216
ttataaataa

SEQ ID NO: 197729 - DNA, 10 bp, Unknown
  misc_feature (1)..( 10): Result.006 file - promoters50/5664216
agttaaatag

SEQ ID NO: 197730 - DNA, 10 bp, Unknown
  misc_feature (1)..( 10): Result.006 file - promoters50/5664216
ccctaaatac

SEQ ID NO: 197731 - DNA, 10 bp, Unknown
  misc_feature (1)..( 10): Result.006 file - promoters50/5664216
ctatatataa

SEQ ID NO: 197732 - DNA, 11 bp, Unknown
  misc_feature (1)..( 11): Result.006 file - promoters50/5664216
tttttctttct

SEQ ID NO: 197733 - DNA, 11 bp, Unknown
  misc_feature (1)..( 11): Result.006 file - promoters50/5664216
tgtttcttctc

SEQ ID NO: 197734 - DNA, 11 bp, Unknown
  misc_feature (1)..( 11): Result.006 file - promoters50/5664216
gggttctttgc

SEQ ID NO: 197735 - DNA, 11 bp, Unknown
  misc_feature (1)..( 11): Result.006 file - promoters50/5664216
tcttttttttt

SEQ ID NO: 197736 - DNA, 11 bp, Unknown
  misc_feature (1)..( 11): Result.006 file - promoters50/5664216
cgcatcttttt

SEQ ID NO: 197737 - DNA, 11 bp, Unknown
  misc_feature (1)..( 11): Result.006 file - promoters50/5664222
tgtttctgttt

SEQ ID NO: 197738 - DNA, 12 bp, Unknown
  misc_feature (1)..( 12): Result.006 file - promoters50/5664222
tcaattcatttt

SEQ ID NO: 197739 - DNA, 12 bp, Unknown
  misc_feature (1)..( 12): Result.006 file - promoters50/5664222
tacattcacttt

SEQ ID NO: 197740 - DNA, 12 bp, Unknown
  misc_feature (1)..( 12): Result.006 file - promoters50/5664222
tcaattcatagt

SEQ ID NO: 197741 - DNA, 12 bp, Unknown
  misc_feature (1)..( 12): Result.006 file - promoters50/5664263
tggaggcatttt

SEQ ID NO: 197742 - DNA, 9 bp, Unknown
  misc_feature (1)..( 9): Result.006 file - promoters50/5664263
gctaaaatt

SEQ ID NO: 197743 - DNA, 9 bp, Unknown
  misc_feature (1)..( 9): Result.006 file - promoters50/5664263
gctaaattc

SEQ ID NO: 197744 - DNA, 10 bp, Unknown
  misc_feature (1)..( 10): Result.006 file - promoters50/5664263
actagaattt

SEQ ID NO: 197745 - DNA, 10 bp, Unknown
  misc_feature (1)..( 10): Result.006 file - promoters50/5664263
actagattct

SEQ ID NO: 197746 - DNA, 10 bp, Unknown
  misc_feature (1)..( 10): Result.006 file - promoters50/5664263
tctatattgc

SEQ ID NO: 197747 - DNA, 10 bp, Unknown
  misc_feature (1)..( 10): Result.006 file - promoters50/5664263
acttgattca

SEQ ID NO: 197748 - DNA, 10 bp, Unknown
  misc_feature (1)..( 10): Result.006 file - promoters50/5664263
catatattat

SEQ ID NO: 197749 - DNA, 10 bp, Unknown
  misc_feature (1)..( 10): Result.006 file - promoters50/5664263
gatagatttg

SEQ ID NO: 197750 - DNA, 10 bp, Unknown
  misc_feature (1)..( 10): Result.006 file - promoters50/5664263
actagattct

SEQ ID NO: 197751 - DNA, 10 bp, Unknown
  misc_feature (1)..( 10): Result.006 file - promoters50/5664263
catatattat

SEQ ID NO: 197752 - DNA, 10 bp, Unknown
  misc_feature (1)..( 10): Result.006 file - promoters50/5664263
gctaaattct

SEQ ID NO: 197753 - DNA, 10 bp, Unknown
  misc_feature (1)..( 10): Result.006 file - promoters50/5664263
tctatattgc

SEQ ID NO: 197754 - DNA, 10 bp, Unknown
  misc_feature (1)..( 10): Result.006 file - promoters50/5664263
acttgattca

SEQ ID NO: 197755 - DNA, 12 bp, Unknown
  misc_feature (1)..( 12): Result.006 file - promoters50/5664263
agggtttaagag

SEQ ID NO: 197756 - DNA, 12 bp, Unknown
  misc_feature (1)..( 12): Result.006 file - promoters50/5664263
catgtttaatct

SEQ ID NO: 197757 - DNA, 12 bp, Unknown
  misc_feature (1)..( 12): Result.006 file - promoters50/5664263
gatgttgaagtc

SEQ ID NO: 197758 - DNA, 12 bp, Unknown
  misc_feature (1)..( 12): Result.006 file - promoters50/5664263
tctcttttagat

SEQ ID NO: 197759 - DNA, 12 bp, Unknown
  misc_feature (1)..( 12): Result.006 file - promoters50/5664263
tgcttttaatct

SEQ ID NO: 197760 - DNA, 12 bp, Unknown
  misc_feature (1)..( 12): Result.006 file - promoters50/5664263
catatttagcag

SEQ ID NO: 197761 - DNA, 14 bp, Unknown
  misc_feature (1)..( 14): Result.006 file - promoters50/5664263
ccattgttgagaga

SEQ ID NO: 197762 - DNA, 14 bp, Unknown
  misc_feature (1)..( 14): Result.006 file - promoters50/5664263
taattgatgaaaga

SEQ ID NO: 197763 - DNA, 14 bp, Unknown
  misc_feature (1)..( 14): Result.006 file - promoters50/5664263
caattgattctaat

SEQ ID NO: 197764 - DNA, 14 bp, Unknown
  misc_feature (1)..( 14): Result.006 file - promoters50/5664263
aaattgagcaatgt

SEQ ID NO: 197765 - DNA, 14 bp, Unknown
  misc_feature (1)..( 14): Result.006 file - promoters50/5664263
gaatttattcgtat

SEQ ID NO: 197766 - DNA, 14 bp, Unknown
  misc_feature (1)..( 14): Result.006 file - promoters50/5664265
gaatttcataaagc

SEQ ID NO: 197767 - DNA, 11 bp, Unknown
  misc_feature (1)..( 11): Result.006 file - promoters50/5664265
tccctttaatt

SEQ ID NO: 197768 - DNA, 11 bp, Unknown
  misc_feature (1)..( 11): Result.006 file - promoters50/5664265
agattttaata

SEQ ID NO: 197769 - DNA, 12 bp, Unknown
  misc_feature (1)..( 12): Result.006 file - promoters50/5664265
atggtttgaata

SEQ ID NO: 197770 - DNA, 12 bp, Unknown
  misc_feature (1)..( 12): Result.006 file - promoters50/5664265
atggtgtgaatc

SEQ ID NO: 197771 - DNA, 10 bp, Unknown
  misc_feature (1)..( 10): Result.006 file - promoters50/5664265
aaagaaattg

SEQ ID NO: 197772 - DNA, 10 bp, Unknown
  misc_feature (1)..( 10): Result.006 file - promoters50/5664265
aaagtaataa

SEQ ID NO: 197773 - DNA, 10 bp, Unknown
  misc_feature (1)..( 10): Result.006 file - promoters50/5664265
cgtgaaattg

SEQ ID NO: 197774 - DNA, 7 bp, Unknown
  misc_feature (1)..( 7): Result.006 file - promoters50/5664265
aaacagt

SEQ ID NO: 197775 - DNA, 7 bp, Unknown
  misc_feature (1)..( 7): Result.006 file - promoters50/5664265
aaaaagt

SEQ ID NO: 197776 - DNA, 7 bp, Unknown
  misc_feature (1)..( 7): Result.006 file - promoters50/5664268
taaaagt

SEQ ID NO: 197777 - DNA, 12 bp, Unknown
  misc_feature (1)..( 12): Result.006 file - promoters50/5664268
gattttagtggt

SEQ ID NO: 197778 - DNA, 12 bp, Unknown
  misc_feature (1)..( 12): Result.006 file - promoters50/5664268
aattttaataac

SEQ ID NO: 197779 - DNA, 12 bp, Unknown
  misc_feature (1)..( 12): Result.006 file - promoters50/5664268
ttttttactaac

SEQ ID NO: 197780 - DNA, 12 bp, Unknown
  misc_feature (1)..( 12): Result.006 file - promoters50/5664272
aatattactgag

SEQ ID NO: 197781 - DNA, 9 bp, Unknown
  misc_feature (1)..( 9): Result.006 file - promoters50/5664272
gttctgtgg

SEQ ID NO: 197782 - DNA, 9 bp, Unknown
  misc_feature (1)..( 9): Result.006 file - promoters50/5664272
gttttgttc

SEQ ID NO: 197783 - DNA, 9 bp, Unknown
  misc_feature (1)..( 9): Result.006 file - promoters50/5664272
ctttagttc

SEQ ID NO: 197784 - DNA, 9 bp, Unknown
  misc_feature (1)..( 9): Result.006 file - promoters50/5664272
tttgattta

SEQ ID NO: 197785 - DNA, 9 bp, Unknown
  misc_feature (1)..( 9): Result.006 file - promoters50/5664272
gatgtagct

SEQ ID NO: 197786 - DNA, 9 bp, Unknown
  misc_feature (1)..( 9): Result.006 file - promoters50/5664274
tttgattaa

SEQ ID NO: 197787 - DNA, 9 bp, Unknown
  misc_feature (1)..( 9): Result.006 file - promoters50/5664274
ttttagcaa

SEQ ID NO: 197788 - DNA, 9 bp, Unknown
  misc_feature (1)..( 9): Result.006 file - promoters50/5664274
tttgagctt

SEQ ID NO: 197789 - DNA, 9 bp, Unknown
  misc_feature (1)..( 9): Result.006 file - promoters50/5664274
aatgatctt

SEQ ID NO: 197790 - DNA, 8 bp, Unknown
  misc_feature (1)..( 8): Result.006 file - promoters50/5664274
tgttcctt

SEQ ID NO: 197791 - DNA, 8 bp, Unknown
  misc_feature (1)..( 8): Result.006 file - promoters50/5664274
agtttctt

SEQ ID NO: 197792 - DNA, 8 bp, Unknown
  misc_feature (1)..( 8): Result.006 file - promoters50/5664274
agtatctt

SEQ ID NO: 197793 - DNA, 8 bp, Unknown
  misc_feature (1)..( 8): Result.006 file - promoters50/5664274
aaacaaat

SEQ ID NO: 197794 - DNA, 8 bp, Unknown
  misc_feature (1)..( 8): Result.006 file - promoters50/5664274
aaagaaag

SEQ ID NO: 197795 - DNA, 8 bp, Unknown
  misc_feature (1)..( 8): Result.006 file - promoters50/5664294
aaaaaaat

SEQ ID NO: 197796 - DNA, 8 bp, Unknown
  misc_feature (1)..( 8): Result.006 file - promoters50/5664294
caaaccga

SEQ ID NO: 197797 - DNA, 8 bp, Unknown
  misc_feature (1)..( 8): Result.006 file - promoters50/5664294
aaaatcga

SEQ ID NO: 197798 - DNA, 8 bp, Unknown
  misc_feature (1)..( 8): Result.006 file - promoters50/5664294
aaaatctg

SEQ ID NO: 197799 - DNA, 8 bp, Unknown
  misc_feature (1)..( 8): Result.006 file - promoters50/5664294
gataaaaa

SEQ ID NO: 197800 - DNA, 8 bp, Unknown
  misc_feature (1)..( 8): Result.006 file - promoters50/5664294
tatataaa

SEQ ID NO: 197801 - DNA, 8 bp, Unknown
  misc_feature (1)..( 8): Result.006 file - promoters50/5664294
gataaatg

SEQ ID NO: 197802 - DNA, 9 bp, Unknown
  misc_feature (1)..( 9): Result.006 file - promoters50/5664294
cattaaaat

SEQ ID NO: 197803 - DNA, 9 bp, Unknown
  misc_feature (1)..( 9): Result.006 file - promoters50/5664294
ctttataat

SEQ ID NO: 197804 - DNA, 10 bp, Unknown
  misc_feature (1)..( 10): Result.006 file - promoters50/5664302
acttcataga

SEQ ID NO: 197805 - DNA, 7 bp, Unknown
  misc_feature (1)..( 7): Result.006 file - promoters50/5664302
attaaaa

SEQ ID NO: 197806 - DNA, 7 bp, Unknown
  misc_feature (1)..( 7): Result.006 file - promoters50/5664302
cttaaaa

SEQ ID NO: 197807 - DNA, 7 bp, Unknown
  misc_feature (1)..( 7): Result.006 file - promoters50/5664302
attaaaa

SEQ ID NO: 197808 - DNA, 8 bp, Unknown
  misc_feature (1)..( 8): Result.006 file - promoters50/5664302
taaaccta

SEQ ID NO: 197809 - DNA, 8 bp, Unknown
  misc_feature (1)..( 8): Result.006 file - promoters50/5664302
aaaatcta

SEQ ID NO: 197810 - DNA, 8 bp, Unknown
  misc_feature (1)..( 8): Result.006 file - promoters50/5664302
aaaatcgt

SEQ ID NO: 197811 - DNA, 10 bp, Unknown
  misc_feature (1)..( 10): Result.006 file - promoters50/5664302
aaattcaaga

SEQ ID NO: 197812 - DNA, 10 bp, Unknown
  misc_feature (1)..( 10): Result.006 file - promoters50/5664302
aaaatcataa

SEQ ID NO: 197813 - DNA, 10 bp, Unknown
  misc_feature (1)..( 10): Result.006 file - promoters50/5664302
taattataaa

SEQ ID NO: 197814 - DNA, 9 bp, Unknown
  misc_feature (1)..( 9): Result.006 file - promoters50/5664302
attcataaa

SEQ ID NO: 197815 - DNA, 9 bp, Unknown
  misc_feature (1)..( 9): Result.006 file - promoters50/5664302
aatcataaa

SEQ ID NO: 197816 - DNA, 9 bp, Unknown
  misc_feature (1)..( 9): Result.006 file - promoters50/5664302
aattataaa

SEQ ID NO: 197817 - DNA, 10 bp, Unknown
  misc_feature (1)..( 10): Result.006 file - promoters50/5664302
caataattca

SEQ ID NO: 197818 - DNA, 10 bp, Unknown
  misc_feature (1)..( 10): Result.006 file - promoters50/5664302
caaaaattca

SEQ ID NO: 197819 - DNA, 10 bp, Unknown
  misc_feature (1)..( 10): Result.006 file - promoters50/5664302
ttataattat

SEQ ID NO: 197820 - DNA, 6 bp, Unknown
  misc_feature (1)..( 6): Result.006 file - promoters50/5664302
aaaatc

SEQ ID NO: 197821 - DNA, 6 bp, Unknown
  misc_feature (1)..( 6): Result.006 file - promoters50/5664302
aaaatc

SEQ ID NO: 197822 - DNA, 6 bp, Unknown
  misc_feature (1)..( 6): Result.006 file - promoters50/5664311
aaaatc

SEQ ID NO: 197823 - DNA, 14 bp, Unknown
  misc_feature (1)..( 14): Result.006 file - promoters50/5664311
ttcattggatttct

SEQ ID NO: 197824 - DNA, 14 bp, Unknown
  misc_feature (1)..( 14): Result.006 file - promoters50/5664311
tgctttggattttg

SEQ ID NO: 197825 - DNA, 14 bp, Unknown
  misc_feature (1)..( 14): Result.006 file - promoters50/5664311
gagtttgtattcaa

SEQ ID NO: 197826 - DNA, 14 bp, Unknown
  misc_feature (1)..( 14): Result.006 file - promoters50/5664311
tgcttttgatctat

SEQ ID NO: 197827 - DNA, 14 bp, Unknown
  misc_feature (1)..( 14): Result.006 file - promoters50/5664311
actgagagatgttg

SEQ ID NO: 197828 - DNA, 14 bp, Unknown
  misc_feature (1)..( 14): Result.006 file - promoters50/5664318
ctcctctgcttgta

SEQ ID NO: 197829 - DNA, 10 bp, Unknown
  misc_feature (1)..( 10): Result.006 file - promoters50/5664318
ataagtaaac

SEQ ID NO: 197830 - DNA, 10 bp, Unknown
  misc_feature (1)..( 10): Result.006 file - promoters50/5664318
aaaagaaaat

SEQ ID NO: 197831 - DNA, 10 bp, Unknown
  misc_feature (1)..( 10): Result.006 file - promoters50/5664318
atatgtaaaa

SEQ ID NO: 197832 - DNA, 10 bp, Unknown
  misc_feature (1)..( 10): Result.006 file - promoters50/5664318
gaaaataaaa

SEQ ID NO: 197833 - DNA, 10 bp, Unknown
  misc_feature (1)..( 10): Result.006 file - promoters50/5664318
atatgtcttt

SEQ ID NO: 197834 - DNA, 10 bp, Unknown
  misc_feature (1)..( 10): Result.006 file - promoters50/5664318
atatgcaaaa

SEQ ID NO: 197835 - DNA, 10 bp, Unknown
  misc_feature (1)..( 10): Result.006 file - promoters50/5664318
ctttaaaaac

SEQ ID NO: 197836 - DNA, 10 bp, Unknown
  misc_feature (1)..( 10): Result.006 file - promoters50/5664318
atttaaatta

SEQ ID NO: 197837 - DNA, 10 bp, Unknown
  misc_feature (1)..( 10): Result.006 file - promoters50/5664318
atttaattga

SEQ ID NO: 197838 - DNA, 10 bp, Unknown
  misc_feature (1)..( 10): Result.006 file - promoters50/5664318
gtttgatttg

SEQ ID NO: 197839 - DNA, 10 bp, Unknown
  misc_feature (1)..( 10): Result.006 file - promoters50/5664318
ttatgaattg

SEQ ID NO: 197840 - DNA, 10 bp, Unknown
  misc_feature (1)..( 10): Result.006 file - promoters50/5664318
ccatgaatta

SEQ ID NO: 197841 - DNA, 12 bp, Unknown
  misc_feature (1)..( 12): Result.006 file - promoters50/5664318
tttgaattaaat

SEQ ID NO: 197842 - DNA, 12 bp, Unknown
  misc_feature (1)..( 12): Result.006 file - promoters50/5664318
caaaaataaaag

SEQ ID NO: 197843 - DNA, 12 bp, Unknown
  misc_feature (1)..( 12): Result.006 file - promoters50/5664318
gttagattagaa

SEQ ID NO: 197844 - DNA, 12 bp, Unknown
  misc_feature (1)..( 12): Result.006 file - promoters50/5664318
tttgtattatca

SEQ ID NO: 197845 - DNA, 12 bp, Unknown
  misc_feature (1)..( 12): Result.006 file - promoters50/5664318
tttgaattaaat

SEQ ID NO: 197846 - DNA, 12 bp, Unknown
  misc_feature (1)..( 12): Result.006 file - promoters50/5664318
aataagttgtgt

SEQ ID NO: 197847 - DNA, 11 bp, Unknown
  misc_feature (1)..( 11): Result.006 file - promoters50/5664318
ttaaattaatt

SEQ ID NO: 197848 - DNA, 11 bp, Unknown
  misc_feature (1)..( 11): Result.006 file - promoters50/5664318
ctaaattgcat

SEQ ID NO: 197849 - DNA, 11 bp, Unknown
  misc_feature (1)..( 11): Result.006 file - promoters50/5664318
ttagattagaa

SEQ ID NO: 197850 - DNA, 11 bp, Unknown
  misc_feature (1)..( 11): Result.006 file - promoters50/5664318
tgaaattgaaa

SEQ ID NO: 197851 - DNA, 11 bp, Unknown
  misc_feature (1)..( 11): Result.006 file - promoters50/5664318
ataagttgtgt

SEQ ID NO: 197852 - DNA, 11 bp, Unknown
  misc_feature (1)..( 11): Result.006 file - promoters50/5664318
tacagttttgt

SEQ ID NO: 197853 - DNA, 9 bp, Unknown
  misc_feature (1)..( 9): Result.006 file - promoters50/5664318
tttaattga

SEQ ID NO: 197854 - DNA, 9 bp, Unknown
  misc_feature (1)..( 9): Result.006 file - promoters50/5664318
tttgatttg

SEQ ID NO: 197855 - DNA, 9 bp, Unknown
  misc_feature (1)..( 9): Result.006 file - promoters50/5664318
tttcattga

SEQ ID NO: 197856 - DNA, 9 bp, Unknown
  misc_feature (1)..( 9): Result.006 file - promoters50/5664318
tttcattta

SEQ ID NO: 197857 - DNA, 9 bp, Unknown
  misc_feature (1)..( 9): Result.006 file - promoters50/5664318
attcttttg

SEQ ID NO: 197858 - DNA, 9 bp, Unknown
  misc_feature (1)..( 9): Result.006 file - promoters50/5664318
atgaattga

SEQ ID NO: 197859 - DNA, 9 bp, Unknown
  misc_feature (1)..( 9): Result.006 file - promoters50/5664318
atgaattag

SEQ ID NO: 197860 - DNA, 9 bp, Unknown
  misc_feature (1)..( 9): Result.006 file - promoters50/5664318
caccttttg

SEQ ID NO: 197861 - DNA, 12 bp, Unknown
  misc_feature (1)..( 12): Result.006 file - promoters50/5664318
aaaactttaaaa

SEQ ID NO: 197862 - DNA, 12 bp, Unknown
  misc_feature (1)..( 12): Result.006 file - promoters50/5664318
caaacgttatgc

SEQ ID NO: 197863 - DNA, 13 bp, Unknown
  misc_feature (1)..( 13): Result.006 file - promoters50/5664318
aaatacttacaac

SEQ ID NO: 197864 - DNA, 13 bp, Unknown
  misc_feature (1)..( 13): Result.006 file - promoters50/5664318
attaccgtgatga

SEQ ID NO: 197865 - DNA, 13 bp, Unknown
  misc_feature (1)..( 13): Result.006 file - promoters50/5664318
cgaggattgatga

SEQ ID NO: 197866 - DNA, 13 bp, Unknown
  misc_feature (1)..( 13): Result.006 file - promoters50/5664318
tcgtaatttatga

SEQ ID NO: 197867 - DNA, 14 bp, Unknown
  misc_feature (1)..( 14): Result.006 file - promoters50/5664318
atatcaaacccgaa

SEQ ID NO: 197868 - DNA, 14 bp, Unknown
  misc_feature (1)..( 14): Result.006 file - promoters50/5664318
aaatcaaaatctaa

SEQ ID NO: 197869 - DNA, 14 bp, Unknown
  misc_feature (1)..( 14): Result.006 file - promoters50/5664318
ggatcaaagttggc

SEQ ID NO: 197870 - DNA, 14 bp, Unknown
  misc_feature (1)..( 14): Result.006 file - promoters50/5664318
aaattaaaaatggg

SEQ ID NO: 197871 - DNA, 14 bp, Unknown
  misc_feature (1)..( 14): Result.006 file - promoters50/5664318
cttttaaaaaaggg

SEQ ID NO: 197872 - DNA, 14 bp, Unknown
  misc_feature (1)..( 14): Result.006 file - promoters50/5664318
ccatcaatgttgat

SEQ ID NO: 197873 - DNA, 9 bp, Unknown
  misc_feature (1)..( 9): Result.006 file - promoters50/5664318
tgtgattgc

SEQ ID NO: 197874 - DNA, 9 bp, Unknown
  misc_feature (1)..( 9): Result.006 file - promoters50/5664318
tgtgtttgt

SEQ ID NO: 197875 - DNA, 9 bp, Unknown
  misc_feature (1)..( 9): Result.006 file - promoters50/5664318
cgtgttttt

SEQ ID NO: 197876 - DNA, 9 bp, Unknown
  misc_feature (1)..( 9): Result.006 file - promoters50/5664318
tgtatttgt

SEQ ID NO: 197877 - DNA, 9 bp, Unknown
  misc_feature (1)..( 9): Result.006 file - promoters50/5664318
tttgtttgt

SEQ ID NO: 197878 - DNA, 9 bp, Unknown
  misc_feature (1)..( 9): Result.006 file - promoters50/5664329
ttttttttt

SEQ ID NO: 197879 - DNA, 10 bp, Unknown
  misc_feature (1)..( 10): Result.006 file - promoters50/5664329
ataaaataaa

SEQ ID NO: 197880 - DNA, 10 bp, Unknown
  misc_feature (1)..( 10): Result.006 file - promoters50/5664329
agcaaataat

SEQ ID NO: 197881 - DNA, 11 bp, Unknown
  misc_feature (1)..( 11): Result.006 file - promoters50/5664329
tttaagatatt

SEQ ID NO: 197882 - DNA, 11 bp, Unknown
  misc_feature (1)..( 11): Result.006 file - promoters50/5664329
tggaaaagaat

SEQ ID NO: 197883 - DNA, 11 bp, Unknown
  misc_feature (1)..( 11): Result.006 file - promoters50/5664329
tttcagaggaa

SEQ ID NO: 197884 - DNA, 11 bp, Unknown
  misc_feature (1)..( 11): Result.006 file - promoters50/5664337
agaaaaagaag

SEQ ID NO: 197885 - DNA, 9 bp, Unknown
  misc_feature (1)..( 9): Result.006 file - promoters50/5664337
gatgtgtag

SEQ ID NO: 197886 - DNA, 9 bp, Unknown
  misc_feature (1)..( 9): Result.006 file - promoters50/5664337
gatttgttt

SEQ ID NO: 197887 - DNA, 9 bp, Unknown
  misc_feature (1)..( 9): Result.006 file - promoters50/5664337
tatgtttag

SEQ ID NO: 197888 - DNA, 7 bp, Unknown
  misc_feature (1)..( 7): Result.006 file - promoters50/5664337
aaatgtc

SEQ ID NO: 197889 - DNA, 7 bp, Unknown
  misc_feature (1)..( 7): Result.006 file - promoters50/5664337
aaatgtt

SEQ ID NO: 197890 - DNA, 7 bp, Unknown
  misc_feature (1)..( 7): Result.006 file - promoters50/5664337
gaatgtc

SEQ ID NO: 197891 - DNA, 7 bp, Unknown
  misc_feature (1)..( 7): Result.006 file - promoters50/5664337
aaattcc

SEQ ID NO: 197892 - DNA, 7 bp, Unknown
  misc_feature (1)..( 7): Result.006 file - promoters50/5664337
aaaatcc

SEQ ID NO: 197893 - DNA, 7 bp, Unknown
  misc_feature (1)..( 7): Result.006 file - promoters50/5664341
caaatcc

SEQ ID NO: 197894 - DNA, 8 bp, Unknown
  misc_feature (1)..( 8): Result.006 file - promoters50/5664341
tttttcat

SEQ ID NO: 197895 - DNA, 8 bp, Unknown
  misc_feature (1)..( 8): Result.006 file - promoters50/5664341
atttccat

SEQ ID NO: 197896 - DNA, 9 bp, Unknown
  misc_feature (1)..( 9): Result.006 file - promoters50/5664341
cttcttcct

SEQ ID NO: 197897 - DNA, 8 bp, Unknown
  misc_feature (1)..( 8): Result.006 file - promoters50/5664341
cctttttc

SEQ ID NO: 197898 - DNA, 8 bp, Unknown
  misc_feature (1)..( 8): Result.006 file - promoters50/5664341
tgtttttc

SEQ ID NO: 197899 - DNA, 8 bp, Unknown
  misc_feature (1)..( 8): Result.006 file - promoters50/5664345
tgtctttg

SEQ ID NO: 197900 - DNA, 7 bp, Unknown
  misc_feature (1)..( 7): Result.006 file - promoters50/5664345
gaaaatg

SEQ ID NO: 197901 - DNA, 7 bp, Unknown
  misc_feature (1)..( 7): Result.006 file - promoters50/5664345
taaaatg

SEQ ID NO: 197902 - DNA, 7 bp, Unknown
  misc_feature (1)..( 7): Result.006 file - promoters50/5664352
taaaata

SEQ ID NO: 197903 - DNA, 12 bp, Unknown
  misc_feature (1)..( 12): Result.006 file - promoters50/5664352
tgaatctctttc

SEQ ID NO: 197904 - DNA, 12 bp, Unknown
  misc_feature (1)..( 12): Result.006 file - promoters50/5664352
tgattcttttct

SEQ ID NO: 197905 - DNA, 12 bp, Unknown
  misc_feature (1)..( 12): Result.006 file - promoters50/5664352
ataatttctttc

SEQ ID NO: 197906 - DNA, 12 bp, Unknown
  misc_feature (1)..( 12): Result.006 file - promoters50/5664352
aaaatgtctaca

SEQ ID NO: 197907 - DNA, 12 bp, Unknown
  misc_feature (1)..( 12): Result.006 file - promoters50/5664352
aaaatctgttta

SEQ ID NO: 197908 - DNA, 12 bp, Unknown
  misc_feature (1)..( 12): Result.006 file - promoters50/5664352
aaaatattttaa

SEQ ID NO: 197909 - DNA, 12 bp, Unknown
  misc_feature (1)..( 12): Result.006 file - promoters50/5664352
aatctctttctg

SEQ ID NO: 197910 - DNA, 12 bp, Unknown
  misc_feature (1)..( 12): Result.006 file - promoters50/5664352
tagctcttgctg

SEQ ID NO: 197911 - DNA, 12 bp, Unknown
  misc_feature (1)..( 12): Result.006 file - promoters50/5664352
aatttctttcaa

SEQ ID NO: 197912 - DNA, 12 bp, Unknown
  misc_feature (1)..( 12): Result.006 file - promoters50/5664352
aatctgtttacc

SEQ ID NO: 197913 - DNA, 12 bp, Unknown
  misc_feature (1)..( 12): Result.006 file - promoters50/5664352
tgtttcttactt

SEQ ID NO: 197914 - DNA, 12 bp, Unknown
  misc_feature (1)..( 12): Result.006 file - promoters50/5664352
tctttttttttg

SEQ ID NO: 197915 - DNA, 12 bp, Unknown
  misc_feature (1)..( 12): Result.006 file - promoters50/5664352
aatattttaata

SEQ ID NO: 197916 - DNA, 10 bp, Unknown
  misc_feature (1)..( 10): Result.006 file - promoters50/5664352
gtgtagaacc

SEQ ID NO: 197917 - DNA, 10 bp, Unknown
  misc_feature (1)..( 10): Result.006 file - promoters50/5664352
gcatagaaca

SEQ ID NO: 197918 - DNA, 10 bp, Unknown
  misc_feature (1)..( 10): Result.006 file - promoters50/5664352
gtggagaaca

SEQ ID NO: 197919 - DNA, 10 bp, Unknown
  misc_feature (1)..( 10): Result.006 file - promoters50/5664352
gcaaagaaag

SEQ ID NO: 197920 - DNA, 10 bp, Unknown
  misc_feature (1)..( 10): Result.006 file - promoters50/5664352
atggggaagc

SEQ ID NO: 197921 - DNA, 10 bp, Unknown
  misc_feature (1)..( 10): Result.006 file - promoters50/5664362
acatacaaca

SEQ ID NO: 197922 - DNA, 10 bp, Unknown
  misc_feature (1)..( 10): Result.006 file - promoters50/5664362
ttgttttcta

SEQ ID NO: 197923 - DNA, 10 bp, Unknown
  misc_feature (1)..( 10): Result.006 file - promoters50/5664362
gcgttttctg

SEQ ID NO: 197924 - DNA, 10 bp, Unknown
  misc_feature (1)..( 10): Result.006 file - promoters50/5664362
ttgttttaag

SEQ ID NO: 197925 - DNA, 10 bp, Unknown
  misc_feature (1)..( 10): Result.006 file - promoters50/5664362
ttgtgttctt

SEQ ID NO: 197926 - DNA, 10 bp, Unknown
  misc_feature (1)..( 10): Result.006 file - promoters50/5664362
ttgttttgaa

SEQ ID NO: 197927 - DNA, 10 bp, Unknown
  misc_feature (1)..( 10): Result.006 file - promoters50/5664362
gaatttttgt

SEQ ID NO: 197928 - DNA, 10 bp, Unknown
  misc_feature (1)..( 10): Result.006 file - promoters50/5664362
aaatatatat

SEQ ID NO: 197929 - DNA, 10 bp, Unknown
  misc_feature (1)..( 10): Result.006 file - promoters50/5664362
taatttatga

SEQ ID NO: 197930 - DNA, 10 bp, Unknown
  misc_feature (1)..( 10): Result.006 file - promoters50/5664362
aaaaatacac

SEQ ID NO: 197931 - DNA, 10 bp, Unknown
  misc_feature (1)..( 10): Result.006 file - promoters50/5664362
gaaagtattc

SEQ ID NO: 197932 - DNA, 10 bp, Unknown
  misc_feature (1)..( 10): Result.006 file - promoters50/5664362
aaaaacaaat

SEQ ID NO: 197933 - DNA, 10 bp, Unknown
  misc_feature (1)..( 10): Result.006 file - promoters50/5664362
caatttttga

SEQ ID NO: 197934 - DNA, 10 bp, Unknown
  misc_feature (1)..( 10): Result.006 file - promoters50/5664362
attcttttga

SEQ ID NO: 197935 - DNA, 10 bp, Unknown
  misc_feature (1)..( 10): Result.006 file - promoters50/5664362
ttaaagatat

SEQ ID NO: 197936 - DNA, 10 bp, Unknown
  misc_feature (1)..( 10): Result.006 file - promoters50/5664362
agaaaaataa

SEQ ID NO: 197937 - DNA, 10 bp, Unknown
  misc_feature (1)..( 10): Result.006 file - promoters50/5664362
accaaaataa

SEQ ID NO: 197938 - DNA, 10 bp, Unknown
  misc_feature (1)..( 10): Result.006 file - promoters50/5664362
agaaaaaaaa

SEQ ID NO: 197939 - DNA, 10 bp, Unknown
  misc_feature (1)..( 10): Result.006 file - promoters50/5664362
cacaatatac

SEQ ID NO: 197940 - DNA, 10 bp, Unknown
  misc_feature (1)..( 10): Result.006 file - promoters50/5664369
ggcaaaatcg

SEQ ID NO: 197941 - DNA, 10 bp, Unknown
  misc_feature (1)..( 10): Result.006 file - promoters50/5664369
aatattatta

SEQ ID NO: 197942 - DNA, 10 bp, Unknown
  misc_feature (1)..( 10): Result.006 file - promoters50/5664369
acagttatta

SEQ ID NO: 197943 - DNA, 10 bp, Unknown
  misc_feature (1)..( 10): Result.006 file - promoters50/5664369
aatataattt

SEQ ID NO: 197944 - DNA, 11 bp, Unknown
  misc_feature (1)..( 11): Result.006 file - promoters50/5664369
caaaaaaattg

SEQ ID NO: 197945 - DNA, 11 bp, Unknown
  misc_feature (1)..( 11): Result.006 file - promoters50/5664369
taaaaaacttg

SEQ ID NO: 197946 - DNA, 11 bp, Unknown
  misc_feature (1)..( 11): Result.006 file - promoters50/5664369
caagaaacact

SEQ ID NO: 197947 - DNA, 6 bp, Unknown
  misc_feature (1)..( 6): Result.006 file - promoters50/5664369
aatttt

SEQ ID NO: 197948 - DNA, 6 bp, Unknown
  misc_feature (1)..( 6): Result.006 file - promoters50/5664369
aatttt

SEQ ID NO: 197949 - DNA, 7 bp, Unknown
  misc_feature (1)..( 7): Result.006 file - promoters50/5664369
aatattt

SEQ ID NO: 197950 - DNA, 7 bp, Unknown
  misc_feature (1)..( 7): Result.006 file - promoters50/5664369
tatgaac

SEQ ID NO: 197951 - DNA, 7 bp, Unknown
  misc_feature (1)..( 7): Result.006 file - promoters50/5664369
tatgaaa

SEQ ID NO: 197952 - DNA, 7 bp, Unknown
  misc_feature (1)..( 7): Result.006 file - promoters50/5664390
tattaaa

SEQ ID NO: 197953 - DNA, 7 bp, Unknown
  misc_feature (1)..( 7): Result.006 file - promoters50/5664390
aattaca

SEQ ID NO: 197954 - DNA, 7 bp, Unknown
  misc_feature (1)..( 7): Result.006 file - promoters50/5664390
aattact

SEQ ID NO: 197955 - DNA, 6 bp, Unknown
  misc_feature (1)..( 6): Result.006 file - promoters50/5664390
attaca

SEQ ID NO: 197956 - DNA, 9 bp, Unknown
  misc_feature (1)..( 9): Result.006 file - promoters50/5664390
ttattttgc

SEQ ID NO: 197957 - DNA, 9 bp, Unknown
  misc_feature (1)..( 9): Result.006 file - promoters50/5664390
ttatttact

SEQ ID NO: 197958 - DNA, 9 bp, Unknown
  misc_feature (1)..( 9): Result.006 file - promoters50/5664390
ttaattact

SEQ ID NO: 197959 - DNA, 13 bp, Unknown
  misc_feature (1)..( 13): Result.006 file - promoters50/5664390
actttatacacga

SEQ ID NO: 197960 - DNA, 13 bp, Unknown
  misc_feature (1)..( 13): Result.006 file - promoters50/5664390
acttaataacagt

SEQ ID NO: 197961 - DNA, 13 bp, Unknown
  misc_feature (1)..( 13): Result.006 file - promoters50/5664402
gattaattactaa

SEQ ID NO: 197962 - DNA, 12 bp, Unknown
  misc_feature (1)..( 12): Result.006 file - promoters50/5664402
aaaattaaattt

SEQ ID NO: 197963 - DNA, 12 bp, Unknown
  misc_feature (1)..( 12): Result.006 file - promoters50/5664402
aaaattgaattt

SEQ ID NO: 197964 - DNA, 12 bp, Unknown
  misc_feature (1)..( 12): Result.006 file - promoters50/5664402
ttaatgaaaatc

SEQ ID NO: 197965 - DNA, 12 bp, Unknown
  misc_feature (1)..( 12): Result.006 file - promoters50/5664402
taccttagtgac

SEQ ID NO: 197966 - DNA, 10 bp, Unknown
  misc_feature (1)..( 10): Result.006 file - promoters50/5664402
taaattaaaa

SEQ ID NO: 197967 - DNA, 10 bp, Unknown
  misc_feature (1)..( 10): Result.006 file - promoters50/5664402
ttaatgaaaa

SEQ ID NO: 197968 - DNA, 10 bp, Unknown
  misc_feature (1)..( 10): Result.006 file - promoters50/5664402
ggtgtgaaaa

SEQ ID NO: 197969 - DNA, 10 bp, Unknown
  misc_feature (1)..( 10): Result.006 file - promoters50/5664435
ttagtgactc

SEQ ID NO: 197970 - DNA, 8 bp, Unknown
  misc_feature (1)..( 8): Result.006 file - promoters50/5664435
tttagtta

SEQ ID NO: 197971 - DNA, 8 bp, Unknown
  misc_feature (1)..( 8): Result.006 file - promoters50/5664435
tttagtag

SEQ ID NO: 197972 - DNA, 8 bp, Unknown
  misc_feature (1)..( 8): Result.006 file - promoters50/5664435
cttaatta

SEQ ID NO: 197973 - DNA, 8 bp, Unknown
  misc_feature (1)..( 8): Result.006 file - promoters50/5664435
attaattt

SEQ ID NO: 197974 - DNA, 12 bp, Unknown
  misc_feature (1)..( 12): Result.006 file - promoters50/5664435
acaattttagtg

SEQ ID NO: 197975 - DNA, 12 bp, Unknown
  misc_feature (1)..( 12): Result.006 file - promoters50/5664435
acaagtttacag

SEQ ID NO: 197976 - DNA, 12 bp, Unknown
  misc_feature (1)..( 12): Result.006 file - promoters50/5664435
atccttttagtg

SEQ ID NO: 197977 - DNA, 12 bp, Unknown
  misc_feature (1)..( 12): Result.006 file - promoters50/5664435
acaattactgtt

SEQ ID NO: 197978 - DNA, 9 bp, Unknown
  misc_feature (1)..( 9): Result.006 file - promoters50/5664435
aattttggt

SEQ ID NO: 197979 - DNA, 9 bp, Unknown
  misc_feature (1)..( 9): Result.006 file - promoters50/5664435
gattctggt

SEQ ID NO: 197980 - DNA, 9 bp, Unknown
  misc_feature (1)..( 9): Result.006 file - promoters50/5664435
aatttttag

SEQ ID NO: 197981 - DNA, 9 bp, Unknown
  misc_feature (1)..( 9): Result.006 file - promoters50/5664435
tattttttc

SEQ ID NO: 197982 - DNA, 12 bp, Unknown
  misc_feature (1)..( 12): Result.006 file - promoters50/5664435
tattaagaaata

SEQ ID NO: 197983 - DNA, 12 bp, Unknown
  misc_feature (1)..( 12): Result.006 file - promoters50/5664435
tataaagagact

SEQ ID NO: 197984 - DNA, 12 bp, Unknown
  misc_feature (1)..( 12): Result.006 file - promoters50/5664435
caaaaagaccaa

SEQ ID NO: 197985 - DNA, 12 bp, Unknown
  misc_feature (1)..( 12): Result.006 file - promoters50/5664435
tgtcaagaacaa

SEQ ID NO: 197986 - DNA, 11 bp, Unknown
  misc_feature (1)..( 11): Result.006 file - promoters50/5664435
gtaaattttta

SEQ ID NO: 197987 - DNA, 11 bp, Unknown
  misc_feature (1)..( 11): Result.006 file - promoters50/5664435
gtatattaggc

SEQ ID NO: 197988 - DNA, 11 bp, Unknown
  misc_feature (1)..( 11): Result.006 file - promoters50/5664435
gtaaatttatt

SEQ ID NO: 197989 - DNA, 11 bp, Unknown
  misc_feature (1)..( 11): Result.006 file - promoters50/5664438
caaaatctatt

SEQ ID NO: 197990 - DNA, 8 bp, Unknown
  misc_feature (1)..( 8): Result.006 file - promoters50/5664438
ttataata

SEQ ID NO: 197991 - DNA, 8 bp, Unknown
  misc_feature (1)..( 8): Result.006 file - promoters50/5664438
ttagaatg

SEQ ID NO: 197992 - DNA, 8 bp, Unknown
  misc_feature (1)..( 8): Result.006 file - promoters50/5664438
ctataata

SEQ ID NO: 197993 - DNA, 8 bp, Unknown
  misc_feature (1)..( 8): Result.006 file - promoters50/5664438
aattcttt

SEQ ID NO: 197994 - DNA, 8 bp, Unknown
  misc_feature (1)..( 8): Result.006 file - promoters50/5664438
aattcttc

SEQ ID NO: 197995 - DNA, 8 bp, Unknown
  misc_feature (1)..( 8): Result.006 file - promoters50/5664438
aatttttt

SEQ ID NO: 197996 - DNA, 11 bp, Unknown
  misc_feature (1)..( 11): Result.006 file - promoters50/5664438
taataaataaa

SEQ ID NO: 197997 - DNA, 11 bp, Unknown
  misc_feature (1)..( 11): Result.006 file - promoters50/5664438
taacaaatatc

SEQ ID NO: 197998 - DNA, 11 bp, Unknown
  misc_feature (1)..( 11): Result.006 file - promoters50/5664457
actaaaatatc

SEQ ID NO: 197999 - DNA, 8 bp, Unknown
  misc_feature (1)..( 8): Result.006 file - promoters50/5664457
acaataaa

SEQ ID NO: 198000 - DNA, 8 bp, Unknown
  misc_feature (1)..( 8): Result.006 file - promoters50/5664457
ataataaa

SEQ ID NO: 198001 - DNA, 8 bp, Unknown
  misc_feature (1)..( 8): Result.006 file - promoters50/5664472
acagtaag

SEQ ID NO: 198002 - DNA, 9 bp, Unknown
  misc_feature (1)..( 9): Result.006 file - promoters50/5664472
tattttttt

SEQ ID NO: 198003 - DNA, 9 bp, Unknown
  misc_feature (1)..( 9): Result.006 file - promoters50/5664472
tattcttta

SEQ ID NO: 198004 - DNA, 10 bp, Unknown
  misc_feature (1)..( 10): Result.006 file - promoters50/5664472
cttttgtttt

SEQ ID NO: 198005 - DNA, 10 bp, Unknown
  misc_feature (1)..( 10): Result.006 file - promoters50/5664472
tttttatttt

SEQ ID NO: 198006 - DNA, 11 bp, Unknown
  misc_feature (1)..( 11): Result.006 file - promoters50/5664472
attttgctcga

SEQ ID NO: 198007 - DNA, 11 bp, Unknown
  misc_feature (1)..( 11): Result.006 file - promoters50/5664472
attttgaaaat

SEQ ID NO: 198008 - DNA, 11 bp, Unknown
  misc_feature (1)..( 11): Result.006 file - promoters50/5664472
ctttagctgtc

SEQ ID NO: 198009 - DNA, 11 bp, Unknown
  misc_feature (1)..( 11): Result.006 file - promoters50/5664480
cttttgttttt

SEQ ID NO: 198010 - DNA, 11 bp, Unknown
  misc_feature (1)..( 11): Result.006 file - promoters50/5664480
gtttatgtgga

SEQ ID NO: 198011 - DNA, 11 bp, Unknown
  misc_feature (1)..( 11): Result.006 file - promoters50/5664480
tattatttgga

SEQ ID NO: 198012 - DNA, 12 bp, Unknown
  misc_feature (1)..( 12): Result.006 file - promoters50/5664480
tgttgatgtaaa

SEQ ID NO: 198013 - DNA, 12 bp, Unknown
  misc_feature (1)..( 12): Result.006 file - promoters50/5664480
tttgtattttat

SEQ ID NO: 198014 - DNA, 12 bp, Unknown
  misc_feature (1)..( 12): Result.006 file - promoters50/5664480
ggttaatgttca

SEQ ID NO: 198015 - DNA, 13 bp, Unknown
  misc_feature (1)..( 13): Result.006 file - promoters50/5664480
attacatgaacag

SEQ ID NO: 198016 - DNA, 13 bp, Unknown
  misc_feature (1)..( 13): Result.006 file - promoters50/5664480
gttaaatgaagat

SEQ ID NO: 198017 - DNA, 13 bp, Unknown
  misc_feature (1)..( 13): Result.006 file - promoters50/5664480
taataatgatgat

SEQ ID NO: 198018 - DNA, 13 bp, Unknown
  misc_feature (1)..( 13): Result.006 file - promoters50/5664480
gttaaaatgttga

SEQ ID NO: 198019 - DNA, 9 bp, Unknown
  misc_feature (1)..( 9): Result.006 file - promoters50/5664480
gtttataaa

SEQ ID NO: 198020 - DNA, 9 bp, Unknown
  misc_feature (1)..( 9): Result.006 file - promoters50/5664480
gtctataaa

SEQ ID NO: 198021 - DNA, 9 bp, Unknown
  misc_feature (1)..( 9): Result.006 file - promoters50/5664480
tcttataaa

SEQ ID NO: 198022 - DNA, 9 bp, Unknown
  misc_feature (1)..( 9): Result.006 file - promoters50/5664488
tcttttaag

SEQ ID NO: 198023 - DNA, 14 bp, Unknown
  misc_feature (1)..( 14): Result.006 file - promoters50/5664488
ataagtatatgagg

SEQ ID NO: 198024 - DNA, 14 bp, Unknown
  misc_feature (1)..( 14): Result.006 file - promoters50/5664488
tttcttgtatgagt

SEQ ID NO: 198025 - DNA, 14 bp, Unknown
  misc_feature (1)..( 14): Result.006 file - promoters50/5664488
ataagtgtatgagg

SEQ ID NO: 198026 - DNA, 14 bp, Unknown
  misc_feature (1)..( 14): Result.006 file - promoters50/5664488
tttactatttgaca

SEQ ID NO: 198027 - DNA, 14 bp, Unknown
  misc_feature (1)..( 14): Result.006 file - promoters50/5664505
accaaaatttgaaa

SEQ ID NO: 198028 - DNA, 8 bp, Unknown
  misc_feature (1)..( 8): Result.006 file - promoters50/5664505
attatctg

SEQ ID NO: 198029 - DNA, 8 bp, Unknown
  misc_feature (1)..( 8): Result.006 file - promoters50/5664505
attatccg

SEQ ID NO: 198030 - DNA, 8 bp, Unknown
  misc_feature (1)..( 8): Result.006 file - promoters50/5664535
attaaccg

SEQ ID NO: 198031 - DNA, 13 bp, Unknown
  misc_feature (1)..( 13): Result.006 file - promoters50/5664535
aattatcaataat

SEQ ID NO: 198032 - DNA, 13 bp, Unknown
  misc_feature (1)..( 13): Result.006 file - promoters50/5664535
aaaattgaataat

SEQ ID NO: 198033 - DNA, 13 bp, Unknown
  misc_feature (1)..( 13): Result.006 file - promoters50/5664535
aaaagtgattaaa

SEQ ID NO: 198034 - DNA, 9 bp, Unknown
  misc_feature (1)..( 9): Result.006 file - promoters50/5664535
taataacta

SEQ ID NO: 198035 - DNA, 9 bp, Unknown
  misc_feature (1)..( 9): Result.006 file - promoters50/5664535
taaaaacta

SEQ ID NO: 198036 - DNA, 9 bp, Unknown
  misc_feature (1)..( 9): Result.006 file - promoters50/5664535
taaacactc

SEQ ID NO: 198037 - DNA, 8 bp, Unknown
  misc_feature (1)..( 8): Result.006 file - promoters50/5664535
aataaaga

SEQ ID NO: 198038 - DNA, 8 bp, Unknown
  misc_feature (1)..( 8): Result.006 file - promoters50/5664535
aataaacc

SEQ ID NO: 198039 - DNA, 8 bp, Unknown
  misc_feature (1)..( 8): Result.006 file - promoters50/5664535
cataaacc

SEQ ID NO: 198040 - DNA, 9 bp, Unknown
  misc_feature (1)..( 9): Result.006 file - promoters50/5664535
tatttaaac

SEQ ID NO: 198041 - DNA, 9 bp, Unknown
  misc_feature (1)..( 9): Result.006 file - promoters50/5664535
ggtttaaac

SEQ ID NO: 198042 - DNA, 9 bp, Unknown
  misc_feature (1)..( 9): Result.006 file - promoters50/5664535
ggtctaatc

SEQ ID NO: 198043 - DNA, 8 bp, Unknown
  misc_feature (1)..( 8): Result.006 file - promoters50/5664535
tataaacc

SEQ ID NO: 198044 - DNA, 8 bp, Unknown
  misc_feature (1)..( 8): Result.006 file - promoters50/5664535
tataaata

SEQ ID NO: 198045 - DNA, 8 bp, Unknown
  misc_feature (1)..( 8): Result.006 file - promoters50/5664633
tataaata

SEQ ID NO: 198046 - DNA, 7 bp, Unknown
  misc_feature (1)..( 7): Result.006 file - promoters50/5664633
tatttta

SEQ ID NO: 198047 - DNA, 7 bp, Unknown
  misc_feature (1)..( 7): Result.006 file - promoters50/5664633
catttta

SEQ ID NO: 198048 - DNA, 7 bp, Unknown
  misc_feature (1)..( 7): Result.006 file - promoters50/5664633
tattttc

SEQ ID NO: 198049 - DNA, 9 bp, Unknown
  misc_feature (1)..( 9): Result.006 file - promoters50/5664633
tattttatc

SEQ ID NO: 198050 - DNA, 9 bp, Unknown
  misc_feature (1)..( 9): Result.006 file - promoters50/5664633
tattttttt

SEQ ID NO: 198051 - DNA, 10 bp, Unknown
  misc_feature (1)..( 10): Result.006 file - promoters50/5664633
tatgttttta

SEQ ID NO: 198052 - DNA, 14 bp, Unknown
  misc_feature (1)..( 14): Result.006 file - promoters50/5664633
tccgatttcatttt

SEQ ID NO: 198053 - DNA, 14 bp, Unknown
  misc_feature (1)..( 14): Result.006 file - promoters50/5664633
atttttttccttta

SEQ ID NO: 198054 - DNA, 14 bp, Unknown
  misc_feature (1)..( 14): Result.006 file - promoters50/5664633
tccgatttcttttt

SEQ ID NO: 198055 - DNA, 14 bp, Unknown
  misc_feature (1)..( 14): Result.006 file - promoters50/5664633
tatgatttcttaaa

SEQ ID NO: 198056 - DNA, 8 bp, Unknown
  misc_feature (1)..( 8): Result.006 file - promoters50/5664633
aaaattaa

SEQ ID NO: 198057 - DNA, 8 bp, Unknown
  misc_feature (1)..( 8): Result.006 file - promoters50/5664633
aaaattaa

SEQ ID NO: 198058 - DNA, 8 bp, Unknown
  misc_feature (1)..( 8): Result.006 file - promoters50/5664633
caaactaa

SEQ ID NO: 198059 - DNA, 7 bp, Unknown
  misc_feature (1)..( 7): Result.006 file - promoters50/5664633
ttgaata

SEQ ID NO: 198060 - DNA, 7 bp, Unknown
  misc_feature (1)..( 7): Result.006 file - promoters50/5664633
ttgaatt

SEQ ID NO: 198061 - DNA, 6 bp, Unknown
  misc_feature (1)..( 6): Result.006 file - promoters50/5664633
tgaatt

SEQ ID NO: 198062 - DNA, 10 bp, Unknown
  misc_feature (1)..( 10): Result.006 file - promoters50/5664633
aaaaaaatta

SEQ ID NO: 198063 - DNA, 10 bp, Unknown
  misc_feature (1)..( 10): Result.006 file - promoters50/5664633
atgaaaatta

SEQ ID NO: 198064 - DNA, 10 bp, Unknown
  misc_feature (1)..( 10): Result.006 file - promoters50/5664633
aaataaattg

SEQ ID NO: 198065 - DNA, 9 bp, Unknown
  misc_feature (1)..( 9): Result.006 file - promoters50/5664633
cgatttcat

SEQ ID NO: 198066 - DNA, 9 bp, Unknown
  misc_feature (1)..( 9): Result.006 file - promoters50/5664633
tgatttctt

SEQ ID NO: 198067 - DNA, 9 bp, Unknown
  misc_feature (1)..( 9): Result.006 file - promoters50/5664633
tgatttttt

SEQ ID NO: 198068 - DNA, 9 bp, Unknown
  misc_feature (1)..( 9): Result.006 file - promoters50/5664657
cgatttctt

SEQ ID NO: 198069 - DNA, 10 bp, Unknown
  misc_feature (1)..( 10): Result.006 file - promoters50/5664657
tgctaaaaga

SEQ ID NO: 198070 - DNA, 10 bp, Unknown
  misc_feature (1)..( 10): Result.006 file - promoters50/5664657
taaaaaaaga

SEQ ID NO: 198071 - DNA, 10 bp, Unknown
  misc_feature (1)..( 10): Result.006 file - promoters50/5664657
taataaaagt

SEQ ID NO: 198072 - DNA, 10 bp, Unknown
  misc_feature (1)..( 10): Result.006 file - promoters50/5664657
aattaaatat

SEQ ID NO: 198073 - DNA, 12 bp, Unknown
  misc_feature (1)..( 12): Result.006 file - promoters50/5664657
tggggtttgaag

SEQ ID NO: 198074 - DNA, 12 bp, Unknown
  misc_feature (1)..( 12): Result.006 file - promoters50/5664657
atttgtttgaaa

SEQ ID NO: 198075 - DNA, 12 bp, Unknown
  misc_feature (1)..( 12): Result.006 file - promoters50/5664657
atttttttgttt

SEQ ID NO: 198076 - DNA, 12 bp, Unknown
  misc_feature (1)..( 12): Result.006 file - promoters50/5664657
cgagttttagtt

SEQ ID NO: 198077 - DNA, 8 bp, Unknown
  misc_feature (1)..( 8): Result.006 file - promoters50/5664657
cttgaaaa

SEQ ID NO: 198078 - DNA, 8 bp, Unknown
  misc_feature (1)..( 8): Result.006 file - promoters50/5664657
ctttaaaa

SEQ ID NO: 198079 - DNA, 8 bp, Unknown
  misc_feature (1)..( 8): Result.006 file - promoters50/5664657
atttaaat

SEQ ID NO: 198080 - DNA, 8 bp, Unknown
  misc_feature (1)..( 8): Result.006 file - promoters50/5664703
ttttaaaa

SEQ ID NO: 198081 - DNA, 9 bp, Unknown
  misc_feature (1)..( 9): Result.006 file - promoters50/5664703
attgtatct

SEQ ID NO: 198082 - DNA, 9 bp, Unknown
  misc_feature (1)..( 9): Result.006 file - promoters50/5664703
tttgtatat

SEQ ID NO: 198083 - DNA, 9 bp, Unknown
  misc_feature (1)..( 9): Result.006 file - promoters50/5664703
tttgtttat

SEQ ID NO: 198084 - DNA, 8 bp, Unknown
  misc_feature (1)..( 8): Result.006 file - promoters50/5664703
tctgaatt

SEQ ID NO: 198085 - DNA, 8 bp, Unknown
  misc_feature (1)..( 8): Result.006 file - promoters50/5664703
tctgaaca

SEQ ID NO: 198086 - DNA, 8 bp, Unknown
  misc_feature (1)..( 8): Result.006 file - promoters50/5664703
gctggatt

SEQ ID NO: 198087 - DNA, 12 bp, Unknown
  misc_feature (1)..( 12): Result.006 file - promoters50/5664703
cttattgtataa

SEQ ID NO: 198088 - DNA, 12 bp, Unknown
  misc_feature (1)..( 12): Result.006 file - promoters50/5664703
ctttttgtttat

SEQ ID NO: 198089 - DNA, 12 bp, Unknown
  misc_feature (1)..( 12): Result.006 file - promoters50/5664721
tgatttgtatat

SEQ ID NO: 198090 - DNA, 11 bp, Unknown
  misc_feature (1)..( 11): Result.006 file - promoters50/5664721
taataataata

SEQ ID NO: 198091 - DNA, 11 bp, Unknown
  misc_feature (1)..( 11): Result.006 file - promoters50/5664721
ctctaataagt

SEQ ID NO: 198092 - DNA, 11 bp, Unknown
  misc_feature (1)..( 11): Result.006 file - promoters50/5664721
aaattataatg

SEQ ID NO: 198093 - DNA, 11 bp, Unknown
  misc_feature (1)..( 11): Result.006 file - promoters50/5664721
aaattaatatt

SEQ ID NO: 198094 - DNA, 11 bp, Unknown
  misc_feature (1)..( 11): Result.006 file - promoters50/5664749
cgctaaaaagt

SEQ ID NO: 198095 - DNA, 9 bp, Unknown
  misc_feature (1)..( 9): Result.006 file - promoters50/5664749
attgcttat

SEQ ID NO: 198096 - DNA, 9 bp, Unknown
  misc_feature (1)..( 9): Result.006 file - promoters50/5664749
attacttac

SEQ ID NO: 198097 - DNA, 9 bp, Unknown
  misc_feature (1)..( 9): Result.006 file - promoters50/5664749
cacacttac

SEQ ID NO: 198098 - DNA, 11 bp, Unknown
  misc_feature (1)..( 11): Result.006 file - promoters50/5664749
aaaactaaatc

SEQ ID NO: 198099 - DNA, 11 bp, Unknown
  misc_feature (1)..( 11): Result.006 file - promoters50/5664749
tttactcaatc

SEQ ID NO: 198100 - DNA, 11 bp, Unknown
  misc_feature (1)..( 11): Result.006 file - promoters50/5664749
tttactcacca

SEQ ID NO: 198101 - DNA, 7 bp, Unknown
  misc_feature (1)..( 7): Result.006 file - promoters50/5664749
attgtct

SEQ ID NO: 198102 - DNA, 7 bp, Unknown
  misc_feature (1)..( 7): Result.006 file - promoters50/5664749
attctct

SEQ ID NO: 198103 - DNA, 7 bp, Unknown
  misc_feature (1)..( 7): Result.006 file - promoters50/5664787
tttctct

SEQ ID NO: 198104 - DNA, 11 bp, Unknown
  misc_feature (1)..( 11): Result.006 file - promoters50/5664787
ctaaaaagtaa

SEQ ID NO: 198105 - DNA, 11 bp, Unknown
  misc_feature (1)..( 11): Result.006 file - promoters50/5664787
atataaattaa

SEQ ID NO: 198106 - DNA, 11 bp, Unknown
  misc_feature (1)..( 11): Result.006 file - promoters50/5664787
atatatattct

SEQ ID NO: 198107 - DNA, 13 bp, Unknown
  misc_feature (1)..( 13): Result.006 file - promoters50/5664787
taatgaaaacaac

SEQ ID NO: 198108 - DNA, 13 bp, Unknown
  misc_feature (1)..( 13): Result.006 file - promoters50/5664787
aaattaaaatggt

SEQ ID NO: 198109 - DNA, 13 bp, Unknown
  misc_feature (1)..( 13): Result.006 file - promoters50/5664806
aaactaaaaaggt

SEQ ID NO: 198110 - DNA, 10 bp, Unknown
  misc_feature (1)..( 10): Result.006 file - promoters50/5664806
aaagaaagga

SEQ ID NO: 198111 - DNA, 10 bp, Unknown
  misc_feature (1)..( 10): Result.006 file - promoters50/5664806
gcagaaagca

SEQ ID NO: 198112 - DNA, 10 bp, Unknown
  misc_feature (1)..( 10): Result.006 file - promoters50/5664806
aaaggaagga

SEQ ID NO: 198113 - DNA, 11 bp, Unknown
  misc_feature (1)..( 11): Result.006 file - promoters50/5664806
atctggaaaac

SEQ ID NO: 198114 - DNA, 11 bp, Unknown
  misc_feature (1)..( 11): Result.006 file - promoters50/5664806
accaagaaaac

SEQ ID NO: 198115 - DNA, 11 bp, Unknown
  misc_feature (1)..( 11): Result.006 file - promoters50/5664806
accaataaaag

SEQ ID NO: 198116 - DNA, 11 bp, Unknown
  misc_feature (1)..( 11): Result.006 file - promoters50/5664806
tcttatttttt

SEQ ID NO: 198117 - DNA, 11 bp, Unknown
  misc_feature (1)..( 11): Result.006 file - promoters50/5664806
tcttctttttt

SEQ ID NO: 198118 - DNA, 11 bp, Unknown
  misc_feature (1)..( 11): Result.006 file - promoters50/5664806
ccatattttct

SEQ ID NO: 198119 - DNA, 10 bp, Unknown
  misc_feature (1)..( 10): Result.006 file - promoters50/5664806
atgaatgaac

SEQ ID NO: 198120 - DNA, 10 bp, Unknown
  misc_feature (1)..( 10): Result.006 file - promoters50/5664806
tataattaac

SEQ ID NO: 198121 - DNA, 10 bp, Unknown
  misc_feature (1)..( 10): Result.006 file - promoters50/5664806
tataaataat

SEQ ID NO: 198122 - DNA, 8 bp, Unknown
  misc_feature (1)..( 8): Result.006 file - promoters50/5664806
tcatgaaa

SEQ ID NO: 198123 - DNA, 8 bp, Unknown
  misc_feature (1)..( 8): Result.006 file - promoters50/5664806
ttatgaaa

SEQ ID NO: 198124 - DNA, 8 bp, Unknown
  misc_feature (1)..( 8): Result.006 file - promoters50/5664814
tcataaaa

SEQ ID NO: 198125 - DNA, 7 bp, Unknown
  misc_feature (1)..( 7): Result.006 file - promoters50/5664814
aaaaaat

SEQ ID NO: 198126 - DNA, 7 bp, Unknown
  misc_feature (1)..( 7): Result.006 file - promoters50/5664814
aaaaaaa

SEQ ID NO: 198127 - DNA, 8 bp, Unknown
  misc_feature (1)..( 8): Result.006 file - promoters50/5664814
aaataaaa

SEQ ID NO: 198128 - DNA, 8 bp, Unknown
  misc_feature (1)..( 8): Result.006 file - promoters50/5664814
taataaat

SEQ ID NO: 198129 - DNA, 8 bp, Unknown
  misc_feature (1)..( 8): Result.006 file - promoters50/5664814
aattaaat

SEQ ID NO: 198130 - DNA, 8 bp, Unknown
  misc_feature (1)..( 8): Result.006 file - promoters50/5664814
gattaaat

SEQ ID NO: 198131 - DNA, 12 bp, Unknown
  misc_feature (1)..( 12): Result.006 file - promoters50/5664814
attattttcttg

SEQ ID NO: 198132 - DNA, 12 bp, Unknown
  misc_feature (1)..( 12): Result.006 file - promoters50/5664814
tttatttttcat

SEQ ID NO: 198133 - DNA, 12 bp, Unknown
  misc_feature (1)..( 12): Result.006 file - promoters50/5664814
gggattttctta

SEQ ID NO: 198134 - DNA, 12 bp, Unknown
  misc_feature (1)..( 12): Result.006 file - promoters50/5664814
aatattttagtt

SEQ ID NO: 198135 - DNA, 12 bp, Unknown
  misc_feature (1)..( 12): Result.006 file - promoters50/5664814
tttattttattt

SEQ ID NO: 198136 - DNA, 12 bp, Unknown
  misc_feature (1)..( 12): Result.006 file - promoters50/5664814
attattattaga

SEQ ID NO: 198137 - DNA, 12 bp, Unknown
  misc_feature (1)..( 12): Result.006 file - promoters50/5664865
acaattttgttg

SEQ ID NO: 198138 - DNA, 8 bp, Unknown
  misc_feature (1)..( 8): Result.006 file - promoters50/5664865
ggattaaa

SEQ ID NO: 198139 - DNA, 8 bp, Unknown
  misc_feature (1)..( 8): Result.006 file - promoters50/5664865
ggattaat

SEQ ID NO: 198140 - DNA, 8 bp, Unknown
  misc_feature (1)..( 8): Result.006 file - promoters50/5664869
ttattaaa

SEQ ID NO: 198141 - DNA, 7 bp, Unknown
  misc_feature (1)..( 7): Result.006 file - promoters50/5664869
aatattt

SEQ ID NO: 198142 - DNA, 7 bp, Unknown
  misc_feature (1)..( 7): Result.006 file - promoters50/5664869
aatatta

SEQ ID NO: 198143 - DNA, 7 bp, Unknown
  misc_feature (1)..( 7): Result.006 file - promoters50/5664869
aattttt

SEQ ID NO: 198144 - DNA, 8 bp, Unknown
  misc_feature (1)..( 8): Result.006 file - promoters50/5664869
aacagaaa

SEQ ID NO: 198145 - DNA, 8 bp, Unknown
  misc_feature (1)..( 8): Result.006 file - promoters50/5664869
gacagaaa

SEQ ID NO: 198146 - DNA, 8 bp, Unknown
  misc_feature (1)..( 8): Result.006 file - promoters50/5664873
aacagaga

SEQ ID NO: 198147 - DNA, 13 bp, Unknown
  misc_feature (1)..( 13): Result.006 file - promoters50/5664873
gcaaagaaagaca

SEQ ID NO: 198148 - DNA, 13 bp, Unknown
  misc_feature (1)..( 13): Result.006 file - promoters50/5664873
caaaataaaataa

SEQ ID NO: 198149 - DNA, 13 bp, Unknown
  misc_feature (1)..( 13): Result.006 file - promoters50/5664873
cgaaataaatgac

SEQ ID NO: 198150 - DNA, 13 bp, Unknown
  misc_feature (1)..( 13): Result.006 file - promoters50/5664873
aaaaataaactaa

SEQ ID NO: 198151 - DNA, 13 bp, Unknown
  misc_feature (1)..( 13): Result.006 file - promoters50/5664873
aaaaatcgtaaaa

SEQ ID NO: 198152 - DNA, 13 bp, Unknown
  misc_feature (1)..( 13): Result.006 file - promoters50/5664873
ataaccaaaaata

SEQ ID NO: 198153 - DNA, 12 bp, Unknown
  misc_feature (1)..( 12): Result.006 file - promoters50/5664873
tcctataaatat

SEQ ID NO: 198154 - DNA, 12 bp, Unknown
  misc_feature (1)..( 12): Result.006 file - promoters50/5664873
ttctatatatat

SEQ ID NO: 198155 - DNA, 12 bp, Unknown
  misc_feature (1)..( 12): Result.006 file - promoters50/5664873
tcctataataaa

SEQ ID NO: 198156 - DNA, 12 bp, Unknown
  misc_feature (1)..( 12): Result.006 file - promoters50/5664873
tcctatatatca

SEQ ID NO: 198157 - DNA, 12 bp, Unknown
  misc_feature (1)..( 12): Result.006 file - promoters50/5664873
tcttatatattc

SEQ ID NO: 198158 - DNA, 12 bp, Unknown
  misc_feature (1)..( 12): Result.006 file - promoters50/5664873
gcctttaaaaaa

SEQ ID NO: 198159 - DNA, 15 bp, Unknown
  misc_feature (1)..( 15): Result.006 file - promoters50/5664873
tttacaaatgtacaa

SEQ ID NO: 198160 - DNA, 15 bp, Unknown
  misc_feature (1)..( 15): Result.006 file - promoters50/5664873
tttaaaaaactttat

SEQ ID NO: 198161 - DNA, 15 bp, Unknown
  misc_feature (1)..( 15): Result.006 file - promoters50/5664873
tttaaacgccgtcgt

SEQ ID NO: 198162 - DNA, 15 bp, Unknown
  misc_feature (1)..( 15): Result.006 file - promoters50/5664873
gttaaaaattgttga

SEQ ID NO: 198163 - DNA, 15 bp, Unknown
  misc_feature (1)..( 15): Result.006 file - promoters50/5664873
accaaaaaaggaaga

SEQ ID NO: 198164 - DNA, 15 bp, Unknown
  misc_feature (1)..( 15): Result.006 file - promoters50/5664893
aacaaaatttggtga

SEQ ID NO: 198165 - DNA, 9 bp, Unknown
  misc_feature (1)..( 9): Result.006 file - promoters50/5664893
ttttcaata

SEQ ID NO: 198166 - DNA, 9 bp, Unknown
  misc_feature (1)..( 9): Result.006 file - promoters50/5664893
aattccata

SEQ ID NO: 198167 - DNA, 9 bp, Unknown
  misc_feature (1)..( 9): Result.006 file - promoters50/5664942
aatgccagg

SEQ ID NO: 198168 - DNA, 6 bp, Unknown
  misc_feature (1)..( 6): Result.006 file - promoters50/5664942
aaaatc

SEQ ID NO: 198169 - DNA, 6 bp, Unknown
  misc_feature (1)..( 6): Result.006 file - promoters50/5664942
aaaatc

SEQ ID NO: 198170 - DNA, 6 bp, Unknown
  misc_feature (1)..( 6): Result.006 file - promoters50/5664942
aaaatc

SEQ ID NO: 198171 - DNA, 9 bp, Unknown
  misc_feature (1)..( 9): Result.006 file - promoters50/5664942
ctcaactta

SEQ ID NO: 198172 - DNA, 9 bp, Unknown
  misc_feature (1)..( 9): Result.006 file - promoters50/5664942
aggaactta

SEQ ID NO: 198173 - DNA, 9 bp, Unknown
  misc_feature (1)..( 9): Result.006 file - promoters50/5665027
ctcatcttc

SEQ ID NO: 198174 - DNA, 11 bp, Unknown
  misc_feature (1)..( 11): Result.006 file - promoters50/5665027
ttccttataaa

SEQ ID NO: 198175 - DNA, 11 bp, Unknown
  misc_feature (1)..( 11): Result.006 file - promoters50/5665027
ctccttataaa

SEQ ID NO: 198176 - DNA, 11 bp, Unknown
  misc_feature (1)..( 11): Result.006 file - promoters50/5665027
ctccctataaa

SEQ ID NO: 198177 - DNA, 9 bp, Unknown
  misc_feature (1)..( 9): Result.006 file - promoters50/5665027
tttattctt

SEQ ID NO: 198178 - DNA, 9 bp, Unknown
  misc_feature (1)..( 9): Result.006 file - promoters50/5665027
cttattcat

SEQ ID NO: 198179 - DNA, 9 bp, Unknown
  misc_feature (1)..( 9): Result.006 file - promoters50/5665027
tttattctt

SEQ ID NO: 198180 - DNA, 8 bp, Unknown
  misc_feature (1)..( 8): Result.006 file - promoters50/5665027
ttttcttc

SEQ ID NO: 198181 - DNA, 8 bp, Unknown
  misc_feature (1)..( 8): Result.006 file - promoters50/5665027
ttttctta

SEQ ID NO: 198182 - DNA, 8 bp, Unknown
  misc_feature (1)..( 8): Result.006 file - promoters50/5665027
ttttttta

SEQ ID NO: 198183 - DNA, 13 bp, Unknown
  misc_feature (1)..( 13): Result.006 file - promoters50/5665027
tgatcaaaagttt

SEQ ID NO: 198184 - DNA, 13 bp, Unknown
  misc_feature (1)..( 13): Result.006 file - promoters50/5665027
aaaccaaaatttt

SEQ ID NO: 198185 - DNA, 13 bp, Unknown
  misc_feature (1)..( 13): Result.006 file - promoters50/5665071
aaaccaaaatacc

SEQ ID NO: 198186 - DNA, 9 bp, Unknown
  misc_feature (1)..( 9): Result.006 file - promoters50/5665071
ttaaacaat

SEQ ID NO: 198187 - DNA, 9 bp, Unknown
  misc_feature (1)..( 9): Result.006 file - promoters50/5665071
ttaatcaat

SEQ ID NO: 198188 - DNA, 9 bp, Unknown
  misc_feature (1)..( 9): Result.006 file - promoters50/5665071
ttattcatg

SEQ ID NO: 198189 - DNA, 9 bp, Unknown
  misc_feature (1)..( 9): Result.006 file - promoters50/5665071
tcttaagct

SEQ ID NO: 198190 - DNA, 9 bp, Unknown
  misc_feature (1)..( 9): Result.006 file - promoters50/5665071
gattaagct

SEQ ID NO: 198191 - DNA, 9 bp, Unknown
  misc_feature (1)..( 9): Result.006 file - promoters50/5665071
gataaaggg

SEQ ID NO: 198192 - DNA, 16 bp, Unknown
  misc_feature (1)..( 16): Result.006 file - promoters50/5665071
caacaacacaagaaga

SEQ ID NO: 198193 - DNA, 16 bp, Unknown
  misc_feature (1)..( 16): Result.006 file - promoters50/5665071
caaaaactcaagattt

SEQ ID NO: 198194 - DNA, 16 bp, Unknown
  misc_feature (1)..( 16): Result.006 file - promoters50/5665083
agagctctcaaggttt

SEQ ID NO: 198195 - DNA, 7 bp, Unknown
  misc_feature (1)..( 7): Result.006 file - promoters50/5665083
gttttta

SEQ ID NO: 198196 - DNA, 7 bp, Unknown
  misc_feature (1)..( 7): Result.006 file - promoters50/5665083
tttttta

SEQ ID NO: 198197 - DNA, 7 bp, Unknown
  misc_feature (1)..( 7): Result.006 file - promoters50/5665087
gttttta

SEQ ID NO: 198198 - DNA, 8 bp, Unknown
  misc_feature (1)..( 8): Result.006 file - promoters50/5665087
acaacatc

SEQ ID NO: 198199 - DNA, 8 bp, Unknown
  misc_feature (1)..( 8): Result.006 file - promoters50/5665087
tcaaaatc

SEQ ID NO: 198200 - DNA, 8 bp, Unknown
  misc_feature (1)..( 8): Result.006 file - promoters50/5665087
tcataata

SEQ ID NO: 198201 - DNA, 6 bp, Unknown
  misc_feature (1)..( 6): Result.006 file - promoters50/5665087
aaaact

SEQ ID NO: 198202 - DNA, 6 bp, Unknown
  misc_feature (1)..( 6): Result.006 file - promoters50/5665087
aaaact

SEQ ID NO: 198203 - DNA, 6 bp, Unknown
  misc_feature (1)..( 6): Result.006 file - promoters50/5665087
aaaact

SEQ ID NO: 198204 - DNA, 11 bp, Unknown
  misc_feature (1)..( 11): Result.006 file - promoters50/5665087
ttttgtttatt

SEQ ID NO: 198205 - DNA, 11 bp, Unknown
  misc_feature (1)..( 11): Result.006 file - promoters50/5665087
ttttgattaaa

SEQ ID NO: 198206 - DNA, 11 bp, Unknown
  misc_feature (1)..( 11): Result.006 file - promoters50/5665140
ccgcgtttatt

SEQ ID NO: 198207 - DNA, 14 bp, Unknown
  misc_feature (1)..( 14): Result.006 file - promoters50/5665140
cagtgttttcaaac

SEQ ID NO: 198208 - DNA, 14 bp, Unknown
  misc_feature (1)..( 14): Result.006 file - promoters50/5665140
agccctttacaaat

SEQ ID NO: 198209 - DNA, 14 bp, Unknown
  misc_feature (1)..( 14): Result.006 file - promoters50/5665140
gagtatttttaaaa

SEQ ID NO: 198210 - DNA, 14 bp, Unknown
  misc_feature (1)..( 14): Result.006 file - promoters50/5665140
gagaattgagtaca

SEQ ID NO: 198211 - DNA, 14 bp, Unknown
  misc_feature (1)..( 14): Result.006 file - promoters50/5665140
atttttttttattt

SEQ ID NO: 198212 - DNA, 14 bp, Unknown
  misc_feature (1)..( 14): Result.006 file - promoters50/5665140
atctgttttcaaaa

SEQ ID NO: 198213 - DNA, 14 bp, Unknown
  misc_feature (1)..( 14): Result.006 file - promoters50/5665140
ctccatttaatttt

SEQ ID NO: 198214 - DNA, 14 bp, Unknown
  misc_feature (1)..( 14): Result.006 file - promoters50/5665140
gttgatttaatcat

SEQ ID NO: 198215 - DNA, 14 bp, Unknown
  misc_feature (1)..( 14): Result.006 file - promoters50/5665140
gaaactttaatgaa

SEQ ID NO: 198216 - DNA, 14 bp, Unknown
  misc_feature (1)..( 14): Result.006 file - promoters50/5665140
gtgatttgaattaa

SEQ ID NO: 198217 - DNA, 14 bp, Unknown
  misc_feature (1)..( 14): Result.006 file - promoters50/5665140
gaaagtttaaaaag

SEQ ID NO: 198218 - DNA, 14 bp, Unknown
  misc_feature (1)..( 14): Result.006 file - promoters50/5665140
gaaaattttttttt

SEQ ID NO: 198219 - DNA, 11 bp, Unknown
  misc_feature (1)..( 11): Result.006 file - promoters50/5665140
gttaaatgtat

SEQ ID NO: 198220 - DNA, 11 bp, Unknown
  misc_feature (1)..( 11): Result.006 file - promoters50/5665140
gtttaatgtta

SEQ ID NO: 198221 - DNA, 11 bp, Unknown
  misc_feature (1)..( 11): Result.006 file - promoters50/5665140
attacatgttc

SEQ ID NO: 198222 - DNA, 11 bp, Unknown
  misc_feature (1)..( 11): Result.006 file - promoters50/5665140
accaaatctta

SEQ ID NO: 198223 - DNA, 11 bp, Unknown
  misc_feature (1)..( 11): Result.006 file - promoters50/5665140
aataaagctta

SEQ ID NO: 198224 - DNA, 11 bp, Unknown
  misc_feature (1)..( 11): Result.006 file - promoters50/5665199
atttattgttt

SEQ ID NO: 198225 - DNA, 8 bp, Unknown
  misc_feature (1)..( 8): Result.006 file - promoters50/5665199
aaaaaata

SEQ ID NO: 198226 - DNA, 8 bp, Unknown
  misc_feature (1)..( 8): Result.006 file - promoters50/5665199
aaacaatt

SEQ ID NO: 198227 - DNA, 8 bp, Unknown
  misc_feature (1)..( 8): Result.006 file - promoters50/5665199
aaaatata

SEQ ID NO: 198228 - DNA, 8 bp, Unknown
  misc_feature (1)..( 8): Result.006 file - promoters50/5665199
cttgaaaa

SEQ ID NO: 198229 - DNA, 8 bp, Unknown
  misc_feature (1)..( 8): Result.006 file - promoters50/5665199
actgaaaa

SEQ ID NO: 198230 - DNA, 8 bp, Unknown
  misc_feature (1)..( 8): Result.006 file - promoters50/5665199
actcaaat

SEQ ID NO: 198231 - DNA, 9 bp, Unknown
  misc_feature (1)..( 9): Result.006 file - promoters50/5665199
tacataata

SEQ ID NO: 198232 - DNA, 9 bp, Unknown
  misc_feature (1)..( 9): Result.006 file - promoters50/5665199
aacaaaata

SEQ ID NO: 198233 - DNA, 9 bp, Unknown
  misc_feature (1)..( 9): Result.006 file - promoters50/5665199
aacaaacaa

SEQ ID NO: 198234 - DNA, 8 bp, Unknown
  misc_feature (1)..( 8): Result.006 file - promoters50/5665199
tgggccaa

SEQ ID NO: 198235 - DNA, 8 bp, Unknown
  misc_feature (1)..( 8): Result.006 file - promoters50/5665199
tggcccaa

SEQ ID NO: 198236 - DNA, 8 bp, Unknown
  misc_feature (1)..( 8): Result.006 file - promoters50/5665260
aggcccac

SEQ ID NO: 198237 - DNA, 7 bp, Unknown
  misc_feature (1)..( 7): Result.006 file - promoters50/5665260
tgaatta

SEQ ID NO: 198238 - DNA, 7 bp, Unknown
  misc_feature (1)..( 7): Result.006 file - promoters50/5665260
tgaattg

SEQ ID NO: 198239 - DNA, 7 bp, Unknown
  misc_feature (1)..( 7): Result.006 file - promoters50/5665260
tgaatta

SEQ ID NO: 198240 - DNA, 7 bp, Unknown
  misc_feature (1)..( 7): Result.006 file - promoters50/5665260
gaagata

SEQ ID NO: 198241 - DNA, 7 bp, Unknown
  misc_feature (1)..( 7): Result.006 file - promoters50/5665260
gaagatg

SEQ ID NO: 198242 - DNA, 7 bp, Unknown
  misc_feature (1)..( 7): Result.006 file - promoters50/5665279
gaagata

SEQ ID NO: 198243 - DNA, 11 bp, Unknown
  misc_feature (1)..( 11): Result.006 file - promoters50/5665279
gctagagtctc

SEQ ID NO: 198244 - DNA, 11 bp, Unknown
  misc_feature (1)..( 11): Result.006 file - promoters50/5665279
actatagtttg

SEQ ID NO: 198245 - DNA, 11 bp, Unknown
  misc_feature (1)..( 11): Result.006 file - promoters50/5665279
actatagaaac

SEQ ID NO: 198246 - DNA, 11 bp, Unknown
  misc_feature (1)..( 11): Result.006 file - promoters50/5665279
ccaatagtttg

SEQ ID NO: 198247 - DNA, 12 bp, Unknown
  misc_feature (1)..( 12): Result.006 file - promoters50/5665279
ttattttttcct

SEQ ID NO: 198248 - DNA, 12 bp, Unknown
  misc_feature (1)..( 12): Result.006 file - promoters50/5665279
ttattctttgat

SEQ ID NO: 198249 - DNA, 12 bp, Unknown
  misc_feature (1)..( 12): Result.006 file - promoters50/5665279
tagttcattgat

SEQ ID NO: 198250 - DNA, 12 bp, Unknown
  misc_feature (1)..( 12): Result.006 file - promoters50/5665283
atatacttgaat

SEQ ID NO: 198251 - DNA, 13 bp, Unknown
  misc_feature (1)..( 13): Result.006 file - promoters50/5665283
attgtatacatat

SEQ ID NO: 198252 - DNA, 13 bp, Unknown
  misc_feature (1)..( 13): Result.006 file - promoters50/5665283
attggatagatat

SEQ ID NO: 198253 - DNA, 13 bp, Unknown
  misc_feature (1)..( 13): Result.006 file - promoters50/5665283
attttataatata

SEQ ID NO: 198254 - DNA, 13 bp, Unknown
  misc_feature (1)..( 13): Result.006 file - promoters50/5665283
cttagacacattt

SEQ ID NO: 198255 - DNA, 13 bp, Unknown
  misc_feature (1)..( 13): Result.006 file - promoters50/5665283
cttggattctaat

SEQ ID NO: 198256 - DNA, 9 bp, Unknown
  misc_feature (1)..( 9): Result.006 file - promoters50/5665283
attaatatt

SEQ ID NO: 198257 - DNA, 9 bp, Unknown
  misc_feature (1)..( 9): Result.006 file - promoters50/5665283
tttaataat

SEQ ID NO: 198258 - DNA, 9 bp, Unknown
  misc_feature (1)..( 9): Result.006 file - promoters50/5665283
tttactatt

SEQ ID NO: 198259 - DNA, 9 bp, Unknown
  misc_feature (1)..( 9): Result.006 file - promoters50/5665283
atttatatt

SEQ ID NO: 198260 - DNA, 9 bp, Unknown
  misc_feature (1)..( 9): Result.006 file - promoters50/5665306
attgatatt

SEQ ID NO: 198261 - DNA, 8 bp, Unknown
  misc_feature (1)..( 8): Result.006 file - promoters50/5665306
aaaaagaa

SEQ ID NO: 198262 - DNA, 8 bp, Unknown
  misc_feature (1)..( 8): Result.006 file - promoters50/5665306
gaaacgaa

SEQ ID NO: 198263 - DNA, 8 bp, Unknown
  misc_feature (1)..( 8): Result.006 file - promoters50/5665306
gaaacgtt

SEQ ID NO: 198264 - DNA, 10 bp, Unknown
  misc_feature (1)..( 10): Result.006 file - promoters50/5665306
attcgatttg

SEQ ID NO: 198265 - DNA, 10 bp, Unknown
  misc_feature (1)..( 10): Result.006 file - promoters50/5665306
attcgttttg

SEQ ID NO: 198266 - DNA, 10 bp, Unknown
  misc_feature (1)..( 10): Result.006 file - promoters50/5665314
cgtcgtttaa

SEQ ID NO: 198267 - DNA, 8 bp, Unknown
  misc_feature (1)..( 8): Result.006 file - promoters50/5665314
agaaggag

SEQ ID NO: 198268 - DNA, 8 bp, Unknown
  misc_feature (1)..( 8): Result.006 file - promoters50/5665314
taaaggag

SEQ ID NO: 198269 - DNA, 8 bp, Unknown
  misc_feature (1)..( 8): Result.006 file - promoters50/5665314
taaaggat

SEQ ID NO: 198270 - DNA, 8 bp, Unknown
  misc_feature (1)..( 8): Result.006 file - promoters50/5665314
ttttgagt

SEQ ID NO: 198271 - DNA, 8 bp, Unknown
  misc_feature (1)..( 8): Result.006 file - promoters50/5665314
gtttgagt

SEQ ID NO: 198272 - DNA, 8 bp, Unknown
  misc_feature (1)..( 8): Result.006 file - promoters50/5665326
ttttgata

SEQ ID NO: 198273 - DNA, 11 bp, Unknown
  misc_feature (1)..( 11): Result.006 file - promoters50/5665326
aaatcattatt

SEQ ID NO: 198274 - DNA, 11 bp, Unknown
  misc_feature (1)..( 11): Result.006 file - promoters50/5665326
taattattata

SEQ ID NO: 198275 - DNA, 11 bp, Unknown
  misc_feature (1)..( 11): Result.006 file - promoters50/5665326
tatatataata

SEQ ID NO: 198276 - DNA, 11 bp, Unknown
  misc_feature (1)..( 11): Result.006 file - promoters50/5665326
gtcatataaca

SEQ ID NO: 198277 - DNA, 11 bp, Unknown
  misc_feature (1)..( 11): Result.006 file - promoters50/5665326
taattatctca

SEQ ID NO: 198278 - DNA, 11 bp, Unknown
  misc_feature (1)..( 11): Result.006 file - promoters50/5665326
taattaagttt

SEQ ID NO: 198279 - DNA, 12 bp, Unknown
  misc_feature (1)..( 12): Result.006 file - promoters50/5665326
aaaaagcataca

SEQ ID NO: 198280 - DNA, 12 bp, Unknown
  misc_feature (1)..( 12): Result.006 file - promoters50/5665326
tgaaatcataat

SEQ ID NO: 198281 - DNA, 12 bp, Unknown
  misc_feature (1)..( 12): Result.006 file - promoters50/5665326
caaaaccatttg

SEQ ID NO: 198282 - DNA, 12 bp, Unknown
  misc_feature (1)..( 12): Result.006 file - promoters50/5665326
cttactcataat

SEQ ID NO: 198283 - DNA, 12 bp, Unknown
  misc_feature (1)..( 12): Result.006 file - promoters50/5665326
ccctatcatata

SEQ ID NO: 198284 - DNA, 12 bp, Unknown
  misc_feature (1)..( 12): Result.006 file - promoters50/5665326
tgacatctgatc

SEQ ID NO: 198285 - DNA, 12 bp, Unknown
  misc_feature (1)..( 12): Result.006 file - promoters50/5665343
ggaattcactga

SEQ ID NO: 198286 - DNA, 11 bp, Unknown
  misc_feature (1)..( 11): Result.006 file - promoters50/5665343
tttttttattt

SEQ ID NO: 198287 - DNA, 11 bp, Unknown
  misc_feature (1)..( 11): Result.006 file - promoters50/5665343
ttttttttttt

SEQ ID NO: 198288 - DNA, 11 bp, Unknown
  misc_feature (1)..( 11): Result.006 file - promoters50/5665343
tttttttaata

SEQ ID NO: 198289 - DNA, 8 bp, Unknown
  misc_feature (1)..( 8): Result.006 file - promoters50/5665343
acttattt

SEQ ID NO: 198290 - DNA, 8 bp, Unknown
  misc_feature (1)..( 8): Result.006 file - promoters50/5665343
acttcttt

SEQ ID NO: 198291 - DNA, 8 bp, Unknown
  misc_feature (1)..( 8): Result.006 file - promoters50/5665343
acttatta

SEQ ID NO: 198292 - DNA, 13 bp, Unknown
  misc_feature (1)..( 13): Result.006 file - promoters50/5665343
ctaaatactttga

SEQ ID NO: 198293 - DNA, 13 bp, Unknown
  misc_feature (1)..( 13): Result.006 file - promoters50/5665343
ctaaaaactatga

SEQ ID NO: 198294 - DNA, 13 bp, Unknown
  misc_feature (1)..( 13): Result.006 file - promoters50/5665343
aaaaaaactagtt

SEQ ID NO: 198295 - DNA, 7 bp, Unknown
  misc_feature (1)..( 7): Result.006 file - promoters50/5665343
ttgttta

SEQ ID NO: 198296 - DNA, 7 bp, Unknown
  misc_feature (1)..( 7): Result.006 file - promoters50/5665343
ttgtttc

SEQ ID NO: 198297 - DNA, 7 bp, Unknown
  misc_feature (1)..( 7): Result.006 file - promoters50/5665343
ttgattc

SEQ ID NO: 198298 - DNA, 7 bp, Unknown
  misc_feature (1)..( 7): Result.006 file - promoters50/5665343
gaggaaa

SEQ ID NO: 198299 - DNA, 7 bp, Unknown
  misc_feature (1)..( 7): Result.006 file - promoters50/5665343
gagaaaa

SEQ ID NO: 198300 - DNA, 7 bp, Unknown
  misc_feature (1)..( 7): Result.006 file - promoters50/5665343
gaagaaa

SEQ ID NO: 198301 - DNA, 8 bp, Unknown
  misc_feature (1)..( 8): Result.006 file - promoters50/5665343
cctaagtt

SEQ ID NO: 198302 - DNA, 8 bp, Unknown
  misc_feature (1)..( 8): Result.006 file - promoters50/5665343
tttaagtt

SEQ ID NO: 198303 - DNA, 8 bp, Unknown
  misc_feature (1)..( 8): Result.006 file - promoters50/5665347
ttttagtg

SEQ ID NO: 198304 - DNA, 12 bp, Unknown
  misc_feature (1)..( 12): Result.006 file - promoters50/5665347
actataaatact

SEQ ID NO: 198305 - DNA, 12 bp, Unknown
  misc_feature (1)..( 12): Result.006 file - promoters50/5665347
tatataaatcct

SEQ ID NO: 198306 - DNA, 12 bp, Unknown
  misc_feature (1)..( 12): Result.006 file - promoters50/5665347
ggtatatatata

SEQ ID NO: 198307 - DNA, 12 bp, Unknown
  misc_feature (1)..( 12): Result.006 file - promoters50/5665347
actataaacaaa

SEQ ID NO: 198308 - DNA, 12 bp, Unknown
  misc_feature (1)..( 12): Result.006 file - promoters50/5665347
tttatgaatcca

SEQ ID NO: 198309 - DNA, 12 bp, Unknown
  misc_feature (1)..( 12): Result.006 file - promoters50/5665347
ccaataaaaagc

SEQ ID NO: 198310 - DNA, 12 bp, Unknown
  misc_feature (1)..( 12): Result.006 file - promoters50/5665347
tatatttatata

SEQ ID NO: 198311 - DNA, 14 bp, Unknown
  misc_feature (1)..( 14): Result.006 file - promoters50/5665347
tcaatttaatcaat

SEQ ID NO: 198312 - DNA, 14 bp, Unknown
  misc_feature (1)..( 14): Result.006 file - promoters50/5665347
aagggaaaatgaat

SEQ ID NO: 198313 - DNA, 14 bp, Unknown
  misc_feature (1)..( 14): Result.006 file - promoters50/5665347
taattttattcagg

SEQ ID NO: 198314 - DNA, 14 bp, Unknown
  misc_feature (1)..( 14): Result.006 file - promoters50/5665347
gtaatttattttcc

SEQ ID NO: 198315 - DNA, 14 bp, Unknown
  misc_feature (1)..( 14): Result.006 file - promoters50/5665347
caaaagttatgaat

SEQ ID NO: 198316 - DNA, 14 bp, Unknown
  misc_feature (1)..( 14): Result.006 file - promoters50/5665347
agttataaatcgtt

SEQ ID NO: 198317 - DNA, 14 bp, Unknown
  misc_feature (1)..( 14): Result.006 file - promoters50/5665351
tggttttattattc

SEQ ID NO: 198318 - DNA, 10 bp, Unknown
  misc_feature (1)..( 10): Result.006 file - promoters50/5665351
attgtatctt

SEQ ID NO: 198319 - DNA, 10 bp, Unknown
  misc_feature (1)..( 10): Result.006 file - promoters50/5665351
attggatccg

SEQ ID NO: 198320 - DNA, 10 bp, Unknown
  misc_feature (1)..( 10): Result.006 file - promoters50/5665351
attatatagg

SEQ ID NO: 198321 - DNA, 10 bp, Unknown
  misc_feature (1)..( 10): Result.006 file - promoters50/5665351
tctgtttctt

SEQ ID NO: 198322 - DNA, 10 bp, Unknown
  misc_feature (1)..( 10): Result.006 file - promoters50/5665367
attataacgt

SEQ ID NO: 198323 - DNA, 11 bp, Unknown
  misc_feature (1)..( 11): Result.006 file - promoters50/5665367
caaaattagac

SEQ ID NO: 198324 - DNA, 11 bp, Unknown
  misc_feature (1)..( 11): Result.006 file - promoters50/5665367
ataaaataggt

SEQ ID NO: 198325 - DNA, 11 bp, Unknown
  misc_feature (1)..( 11): Result.006 file - promoters50/5665367
agaaaatagaa

SEQ ID NO: 198326 - DNA, 11 bp, Unknown
  misc_feature (1)..( 11): Result.006 file - promoters50/5665367
tttaataagac

SEQ ID NO: 198327 - DNA, 11 bp, Unknown
  misc_feature (1)..( 11): Result.006 file - promoters50/5665367
ataaaatgtag

SEQ ID NO: 198328 - DNA, 11 bp, Unknown
  misc_feature (1)..( 11): Result.006 file - promoters50/5665367
tataagtaaat

SEQ ID NO: 198329 - DNA, 11 bp, Unknown
  misc_feature (1)..( 11): Result.006 file - promoters50/5665367
gttaagaaaac

SEQ ID NO: 198330 - DNA, 11 bp, Unknown
  misc_feature (1)..( 11): Result.006 file - promoters50/5665367
ataacgtaaat

SEQ ID NO: 198331 - DNA, 11 bp, Unknown
  misc_feature (1)..( 11): Result.006 file - promoters50/5665367
atacaaaatta

SEQ ID NO: 198332 - DNA, 11 bp, Unknown
  misc_feature (1)..( 11): Result.006 file - promoters50/5665367
caacaaaatag

SEQ ID NO: 198333 - DNA, 11 bp, Unknown
  misc_feature (1)..( 11): Result.006 file - promoters50/5665367
agcgaaagtta

SEQ ID NO: 198334 - DNA, 11 bp, Unknown
  misc_feature (1)..( 11): Result.006 file - promoters50/5665367
ttataaaataa

SEQ ID NO: 198335 - DNA, 11 bp, Unknown
  misc_feature (1)..( 11): Result.006 file - promoters50/5665367
ttagaaaatgc

SEQ ID NO: 198336 - DNA, 11 bp, Unknown
  misc_feature (1)..( 11): Result.006 file - promoters50/5665367
atagacaatta

SEQ ID NO: 198337 - DNA, 11 bp, Unknown
  misc_feature (1)..( 11): Result.006 file - promoters50/5665367
tgataaactaa

SEQ ID NO: 198338 - DNA, 10 bp, Unknown
  misc_feature (1)..( 10): Result.006 file - promoters50/5665367
actatataaa

SEQ ID NO: 198339 - DNA, 10 bp, Unknown
  misc_feature (1)..( 10): Result.006 file - promoters50/5665367
tgtatatata

SEQ ID NO: 198340 - DNA, 10 bp, Unknown
  misc_feature (1)..( 10): Result.006 file - promoters50/5665367
aatatatata

SEQ ID NO: 198341 - DNA, 10 bp, Unknown
  misc_feature (1)..( 10): Result.006 file - promoters50/5665367
ctaatataaa

SEQ ID NO: 198342 - DNA, 10 bp, Unknown
  misc_feature (1)..( 10): Result.006 file - promoters50/5665367
actatatata

SEQ ID NO: 198343 - DNA, 10 bp, Unknown
  misc_feature (1)..( 10): Result.006 file - promoters50/5665371
tctatataaa

SEQ ID NO: 198344 - DNA, 9 bp, Unknown
  misc_feature (1)..( 9): Result.006 file - promoters50/5665371
aaaatttct

SEQ ID NO: 198345 - DNA, 9 bp, Unknown
  misc_feature (1)..( 9): Result.006 file - promoters50/5665371
aaactttaa

SEQ ID NO: 198346 - DNA, 9 bp, Unknown
  misc_feature (1)..( 9): Result.006 file - promoters50/5665371
aaaatctct

SEQ ID NO: 198347 - DNA, 8 bp, Unknown
  misc_feature (1)..( 8): Result.006 file - promoters50/5665371
tgtgaaac

SEQ ID NO: 198348 - DNA, 8 bp, Unknown
  misc_feature (1)..( 8): Result.006 file - promoters50/5665371
tttgaaac

SEQ ID NO: 198349 - DNA, 8 bp, Unknown
  misc_feature (1)..( 8): Result.006 file - promoters50/5665371
tgtgaaaa

SEQ ID NO: 198350 - DNA, 9 bp, Unknown
  misc_feature (1)..( 9): Result.006 file - promoters50/5665371
aaaatttct

SEQ ID NO: 198351 - DNA, 9 bp, Unknown
  misc_feature (1)..( 9): Result.006 file - promoters50/5665371
gatatttct

SEQ ID NO: 198352 - DNA, 9 bp, Unknown
  misc_feature (1)..( 9): Result.006 file - promoters50/5665371
aaaatctct

SEQ ID NO: 198353 - DNA, 9 bp, Unknown
  misc_feature (1)..( 9): Result.006 file - promoters50/5665371
tatcaaaat

SEQ ID NO: 198354 - DNA, 9 bp, Unknown
  misc_feature (1)..( 9): Result.006 file - promoters50/5665371
tttcaaaat

SEQ ID NO: 198355 - DNA, 9 bp, Unknown
  misc_feature (1)..( 9): Result.006 file - promoters50/5665374
ttttaaaat

SEQ ID NO: 198356 - DNA, 12 bp, Unknown
  misc_feature (1)..( 12): Result.006 file - promoters50/5665374
taatacatttat

SEQ ID NO: 198357 - DNA, 12 bp, Unknown
  misc_feature (1)..( 12): Result.006 file - promoters50/5665374
taaaacaaaaaa

SEQ ID NO: 198358 - DNA, 12 bp, Unknown
  misc_feature (1)..( 12): Result.006 file - promoters50/5665374
caaaacaaaaaa

SEQ ID NO: 198359 - DNA, 12 bp, Unknown
  misc_feature (1)..( 12): Result.006 file - promoters50/5665374
caaaacaaattt

SEQ ID NO: 198360 - DNA, 12 bp, Unknown
  misc_feature (1)..( 12): Result.006 file - promoters50/5665374
caaaaccagttt

SEQ ID NO: 198361 - DNA, 11 bp, Unknown
  misc_feature (1)..( 11): Result.006 file - promoters50/5665374
cactatctaaa

SEQ ID NO: 198362 - DNA, 11 bp, Unknown
  misc_feature (1)..( 11): Result.006 file - promoters50/5665374
agctatctaaa

SEQ ID NO: 198363 - DNA, 11 bp, Unknown
  misc_feature (1)..( 11): Result.006 file - promoters50/5665374
tactttctctg

SEQ ID NO: 198364 - DNA, 11 bp, Unknown
  misc_feature (1)..( 11): Result.006 file - promoters50/5665374
cataatcaaaa

SEQ ID NO: 198365 - DNA, 11 bp, Unknown
  misc_feature (1)..( 11): Result.006 file - promoters50/5665374
tactttaggat

SEQ ID NO: 198366 - DNA, 12 bp, Unknown
  misc_feature (1)..( 12): Result.006 file - promoters50/5665374
ttagaaaatatg

SEQ ID NO: 198367 - DNA, 12 bp, Unknown
  misc_feature (1)..( 12): Result.006 file - promoters50/5665374
accgaaaaaatg

SEQ ID NO: 198368 - DNA, 12 bp, Unknown
  misc_feature (1)..( 12): Result.006 file - promoters50/5665374
ttggaaaataaa

SEQ ID NO: 198369 - DNA, 12 bp, Unknown
  misc_feature (1)..( 12): Result.006 file - promoters50/5665374
gagagaaataaa

SEQ ID NO: 198370 - DNA, 13 bp, Unknown
  misc_feature (1)..( 13): Result.006 file - promoters50/5665374
agagaaagaaacg

SEQ ID NO: 198371 - DNA, 11 bp, Unknown
  misc_feature (1)..( 11): Result.006 file - promoters50/5665374
ttaacaaacca

SEQ ID NO: 198372 - DNA, 11 bp, Unknown
  misc_feature (1)..( 11): Result.006 file - promoters50/5665374
aaaacaaaaaa

SEQ ID NO: 198373 - DNA, 11 bp, Unknown
  misc_feature (1)..( 11): Result.006 file - promoters50/5665374
ttaccaattcc

SEQ ID NO: 198374 - DNA, 11 bp, Unknown
  misc_feature (1)..( 11): Result.006 file - promoters50/5665374
aaaacaaaaaa

SEQ ID NO: 198375 - DNA, 11 bp, Unknown
  misc_feature (1)..( 11): Result.006 file - promoters50/5665374
aaaacaaattt

SEQ ID NO: 198376 - DNA, 10 bp, Unknown
  misc_feature (1)..( 10): Result.006 file - promoters50/5665374
aaattcagaa

SEQ ID NO: 198377 - DNA, 10 bp, Unknown
  misc_feature (1)..( 10): Result.006 file - promoters50/5665374
gaatttagat

SEQ ID NO: 198378 - DNA, 10 bp, Unknown
  misc_feature (1)..( 10): Result.006 file - promoters50/5665374
ggatttttgg

SEQ ID NO: 198379 - DNA, 10 bp, Unknown
  misc_feature (1)..( 10): Result.006 file - promoters50/5665374
tcattttttg

SEQ ID NO: 198380 - DNA, 10 bp, Unknown
  misc_feature (1)..( 10): Result.006 file - promoters50/5665382
ctttttgttg

SEQ ID NO: 198381 - DNA, 8 bp, Unknown
  misc_feature (1)..( 8): Result.006 file - promoters50/5665382
tttataaa

SEQ ID NO: 198382 - DNA, 8 bp, Unknown
  misc_feature (1)..( 8): Result.006 file - promoters50/5665382
gatataaa

SEQ ID NO: 198383 - DNA, 8 bp, Unknown
  misc_feature (1)..( 8): Result.006 file - promoters50/5665382
ataataaa

SEQ ID NO: 198384 - DNA, 10 bp, Unknown
  misc_feature (1)..( 10): Result.006 file - promoters50/5665382
ttacttttag

SEQ ID NO: 198385 - DNA, 10 bp, Unknown
  misc_feature (1)..( 10): Result.006 file - promoters50/5665382
ttaatttgat

SEQ ID NO: 198386 - DNA, 10 bp, Unknown
  misc_feature (1)..( 10): Result.006 file - promoters50/5665386
tgaatctgat

SEQ ID NO: 198387 - DNA, 11 bp, Unknown
  misc_feature (1)..( 11): Result.006 file - promoters50/5665386
aataaataaaa

SEQ ID NO: 198388 - DNA, 11 bp, Unknown
  misc_feature (1)..( 11): Result.006 file - promoters50/5665386
aataaagtcct

SEQ ID NO: 198389 - DNA, 11 bp, Unknown
  misc_feature (1)..( 11): Result.006 file - promoters50/5665386
tataatgtcct

SEQ ID NO: 198390 - DNA, 9 bp, Unknown
  misc_feature (1)..( 9): Result.006 file - promoters50/5665386
tatcttttt

SEQ ID NO: 198391 - DNA, 9 bp, Unknown
  misc_feature (1)..( 9): Result.006 file - promoters50/5665386
cttctattt

SEQ ID NO: 198392 - DNA, 9 bp, Unknown
  misc_feature (1)..( 9): Result.006 file - promoters50/5665386
cttcttttt

SEQ ID NO: 198393 - DNA, 9 bp, Unknown
  misc_feature (1)..( 9): Result.006 file - promoters50/5665386
tttcagtca

SEQ ID NO: 198394 - DNA, 9 bp, Unknown
  misc_feature (1)..( 9): Result.006 file - promoters50/5665386
tctcaatca

SEQ ID NO: 198395 - DNA, 9 bp, Unknown
  misc_feature (1)..( 9): Result.006 file - promoters50/5665386
tttgagttg

SEQ ID NO: 198396 - DNA, 8 bp, Unknown
  misc_feature (1)..( 8): Result.006 file - promoters50/5665386
caaaaatc

SEQ ID NO: 198397 - DNA, 8 bp, Unknown
  misc_feature (1)..( 8): Result.006 file - promoters50/5665386
caaagatc

SEQ ID NO: 198398 - DNA, 8 bp, Unknown
  misc_feature (1)..( 8): Result.006 file - promoters50/5665386
aaaaaata

SEQ ID NO: 198399 - DNA, 9 bp, Unknown
  misc_feature (1)..( 9): Result.006 file - promoters50/5665386
agtatctta

SEQ ID NO: 198400 - DNA, 9 bp, Unknown
  misc_feature (1)..( 9): Result.006 file - promoters50/5665386
agtttctta

SEQ ID NO: 198401 - DNA, 9 bp, Unknown
  misc_feature (1)..( 9): Result.006 file - promoters50/5665390
aatatatta

SEQ ID NO: 198402 - DNA, 7 bp, Unknown
  misc_feature (1)..( 7): Result.006 file - promoters50/5665390
attaatt

SEQ ID NO: 198403 - DNA, 7 bp, Unknown
  misc_feature (1)..( 7): Result.006 file - promoters50/5665390
tttaatt

SEQ ID NO: 198404 - DNA, 7 bp, Unknown
  misc_feature (1)..( 7): Result.006 file - promoters50/5665390
tttcatt

SEQ ID NO: 198405 - DNA, 9 bp, Unknown
  misc_feature (1)..( 9): Result.006 file - promoters50/5665390
ataaacaaa

SEQ ID NO: 198406 - DNA, 9 bp, Unknown
  misc_feature (1)..( 9): Result.006 file - promoters50/5665390
atatacatg

SEQ ID NO: 198407 - DNA, 9 bp, Unknown
  misc_feature (1)..( 9): Result.006 file - promoters50/5665390
ctacacaaa

SEQ ID NO: 198408 - DNA, 8 bp, Unknown
  misc_feature (1)..( 8): Result.006 file - promoters50/5665390
attattaa

SEQ ID NO: 198409 - DNA, 8 bp, Unknown
  misc_feature (1)..( 8): Result.006 file - promoters50/5665390
atttttac

SEQ ID NO: 198410 - DNA, 8 bp, Unknown
  misc_feature (1)..( 8): Result.006 file - promoters50/5665390
tattttac

SEQ ID NO: 198411 - DNA, 7 bp, Unknown
  misc_feature (1)..( 7): Result.006 file - promoters50/5665390
atttact

SEQ ID NO: 198412 - DNA, 7 bp, Unknown
  misc_feature (1)..( 7): Result.006 file - promoters50/5665390
attcact

SEQ ID NO: 198413 - DNA, 7 bp, Unknown
  misc_feature (1)..( 7): Result.006 file - promoters50/5665390
cttcact

SEQ ID NO: 198414 - DNA, 6 bp, Unknown
  misc_feature (1)..( 6): Result.006 file - promoters50/5665390
tttata

SEQ ID NO: 198415 - DNA, 6 bp, Unknown
  misc_feature (1)..( 6): Result.006 file - promoters50/5665390
tttata

SEQ ID NO: 198416 - DNA, 6 bp, Unknown
  misc_feature (1)..( 6): Result.006 file - promoters50/5665390
tttata

SEQ ID NO: 198417 - DNA, 11 bp, Unknown
  misc_feature (1)..( 11): Result.006 file - promoters50/5665390
cataaagaaaa

SEQ ID NO: 198418 - DNA, 11 bp, Unknown
  misc_feature (1)..( 11): Result.006 file - promoters50/5665390
cattaagggga

SEQ ID NO: 198419 - DNA, 11 bp, Unknown
  misc_feature (1)..( 11): Result.006 file - promoters50/5665390
attaaagcaaa

SEQ ID NO: 198420 - DNA, 10 bp, Unknown
  misc_feature (1)..( 10): Result.006 file - promoters50/5665390
aaaactaaag

SEQ ID NO: 198421 - DNA, 10 bp, Unknown
  misc_feature (1)..( 10): Result.006 file - promoters50/5665390
aaaattaaag

SEQ ID NO: 198422 - DNA, 11 bp, Unknown
  misc_feature (1)..( 11): Result.006 file - promoters50/5665404
aaaacttaaaa

SEQ ID NO: 198423 - DNA, 8 bp, Unknown
  misc_feature (1)..( 8): Result.006 file - promoters50/5665404
cttgcttt

SEQ ID NO: 198424 - DNA, 8 bp, Unknown
  misc_feature (1)..( 8): Result.006 file - promoters50/5665404
aatgcttt

SEQ ID NO: 198425 - DNA, 8 bp, Unknown
  misc_feature (1)..( 8): Result.006 file - promoters50/5665404
tttgtttt

SEQ ID NO: 198426 - DNA, 8 bp, Unknown
  misc_feature (1)..( 8): Result.006 file - promoters50/5665404
gtttattt

SEQ ID NO: 198427 - DNA, 8 bp, Unknown
  misc_feature (1)..( 8): Result.006 file - promoters50/5665404
gtttatgg

SEQ ID NO: 198428 - DNA, 10 bp, Unknown
  misc_feature (1)..( 10): Result.006 file - promoters50/5665404
ttttaaaatt

SEQ ID NO: 198429 - DNA, 10 bp, Unknown
  misc_feature (1)..( 10): Result.006 file - promoters50/5665404
aaataaaata

SEQ ID NO: 198430 - DNA, 10 bp, Unknown
  misc_feature (1)..( 10): Result.006 file - promoters50/5665404
aaatgaaata

SEQ ID NO: 198431 - DNA, 10 bp, Unknown
  misc_feature (1)..( 10): Result.006 file - promoters50/5665412
taatacaatt

SEQ ID NO: 198432 - DNA, 8 bp, Unknown
  misc_feature (1)..( 8): Result.006 file - promoters50/5665412
ttttcttg

SEQ ID NO: 198433 - DNA, 8 bp, Unknown
  misc_feature (1)..( 8): Result.006 file - promoters50/5665412
ttttctac

SEQ ID NO: 198434 - DNA, 8 bp, Unknown
  misc_feature (1)..( 8): Result.006 file - promoters50/5665412
atttgttg

SEQ ID NO: 198435 - DNA, 8 bp, Unknown
  misc_feature (1)..( 8): Result.006 file - promoters50/5665412
tttctttt

SEQ ID NO: 198436 - DNA, 8 bp, Unknown
  misc_feature (1)..( 8): Result.006 file - promoters50/5665412
tttcttct

SEQ ID NO: 198437 - DNA, 8 bp, Unknown
  misc_feature (1)..( 8): Result.006 file - promoters50/5665420
cttcttct

SEQ ID NO: 198438 - DNA, 12 bp, Unknown
  misc_feature (1)..( 12): Result.006 file - promoters50/5665420
ttttattttatt

SEQ ID NO: 198439 - DNA, 12 bp, Unknown
  misc_feature (1)..( 12): Result.006 file - promoters50/5665420
acacattttaca

SEQ ID NO: 198440 - DNA, 12 bp, Unknown
  misc_feature (1)..( 12): Result.006 file - promoters50/5665420
tttttttttagt

SEQ ID NO: 198441 - DNA, 12 bp, Unknown
  misc_feature (1)..( 12): Result.006 file - promoters50/5665420
ttgcatttttaa

SEQ ID NO: 198442 - DNA, 12 bp, Unknown
  misc_feature (1)..( 12): Result.006 file - promoters50/5665420
caacactttaca

SEQ ID NO: 198443 - DNA, 12 bp, Unknown
  misc_feature (1)..( 12): Result.006 file - promoters50/5665436
aacaactataca

SEQ ID NO: 198444 - DNA, 11 bp, Unknown
  misc_feature (1)..( 11): Result.006 file - promoters50/5665436
cataataattt

SEQ ID NO: 198445 - DNA, 11 bp, Unknown
  misc_feature (1)..( 11): Result.006 file - promoters50/5665436
attaataatta

SEQ ID NO: 198446 - DNA, 11 bp, Unknown
  misc_feature (1)..( 11): Result.006 file - promoters50/5665436
aataataacaa

SEQ ID NO: 198447 - DNA, 11 bp, Unknown
  misc_feature (1)..( 11): Result.006 file - promoters50/5665436
tataatatttt

SEQ ID NO: 198448 - DNA, 11 bp, Unknown
  misc_feature (1)..( 11): Result.006 file - promoters50/5665436
ttcaatgatta

SEQ ID NO: 198449 - DNA, 11 bp, Unknown
  misc_feature (1)..( 11): Result.006 file - promoters50/5665436
tttaatatgaa

SEQ ID NO: 198450 - DNA, 11 bp, Unknown
  misc_feature (1)..( 11): Result.006 file - promoters50/5665507
tataaaataca

SEQ ID NO: 198451 - DNA, 9 bp, Unknown
  misc_feature (1)..( 9): Result.006 file - promoters50/5665507
caatatccc

SEQ ID NO: 198452 - DNA, 9 bp, Unknown
  misc_feature (1)..( 9): Result.006 file - promoters50/5665507
aaatatctt

SEQ ID NO: 198453 - DNA, 9 bp, Unknown
  misc_feature (1)..( 9): Result.006 file - promoters50/5665507
ttatatcca

SEQ ID NO: 198454 - DNA, 9 bp, Unknown
  misc_feature (1)..( 9): Result.006 file - promoters50/5665507
tcatatcct

SEQ ID NO: 198455 - DNA, 9 bp, Unknown
  misc_feature (1)..( 9): Result.006 file - promoters50/5665507
ttatatctt

SEQ ID NO: 198456 - DNA, 9 bp, Unknown
  misc_feature (1)..( 9): Result.006 file - promoters50/5665507
aaatattag

SEQ ID NO: 198457 - DNA, 13 bp, Unknown
  misc_feature (1)..( 13): Result.006 file - promoters50/5665507
ctttttgatattt

SEQ ID NO: 198458 - DNA, 13 bp, Unknown
  misc_feature (1)..( 13): Result.006 file - promoters50/5665507
attttagattttt

SEQ ID NO: 198459 - DNA, 13 bp, Unknown
  misc_feature (1)..( 13): Result.006 file - promoters50/5665507
tactttgatcatt

SEQ ID NO: 198460 - DNA, 13 bp, Unknown
  misc_feature (1)..( 13): Result.006 file - promoters50/5665507
attttaagaaagc

SEQ ID NO: 198461 - DNA, 13 bp, Unknown
  misc_feature (1)..( 13): Result.006 file - promoters50/5665507
atttttgttccat

SEQ ID NO: 198462 - DNA, 13 bp, Unknown
  misc_feature (1)..( 13): Result.006 file - promoters50/5665507
gtgtttaatcaaa

SEQ ID NO: 198463 - DNA, 14 bp, Unknown
  misc_feature (1)..( 14): Result.006 file - promoters50/5665507
gtctagaaaatggt

SEQ ID NO: 198464 - DNA, 14 bp, Unknown
  misc_feature (1)..( 14): Result.006 file - promoters50/5665507
gtcgagaatacata

SEQ ID NO: 198465 - DNA, 14 bp, Unknown
  misc_feature (1)..( 14): Result.006 file - promoters50/5665507
aactataaagcaaa

SEQ ID NO: 198466 - DNA, 14 bp, Unknown
  misc_feature (1)..( 14): Result.006 file - promoters50/5665507
atcgcgaaatcgga

SEQ ID NO: 198467 - DNA, 14 bp, Unknown
  misc_feature (1)..( 14): Result.006 file - promoters50/5665507
cgcgacaataaata

SEQ ID NO: 198468 - DNA, 14 bp, Unknown
  misc_feature (1)..( 14): Result.006 file - promoters50/5665507
tcgaagaatgaatt

SEQ ID NO: 198469 - DNA, 14 bp, Unknown
  misc_feature (1)..( 14): Result.006 file - promoters50/5665507
tccgagaaaaaaca

SEQ ID NO: 198470 - DNA, 11 bp, Unknown
  misc_feature (1)..( 11): Result.006 file - promoters50/5665507
aacttgaaatt

SEQ ID NO: 198471 - DNA, 11 bp, Unknown
  misc_feature (1)..( 11): Result.006 file - promoters50/5665507
acattgaaaga

SEQ ID NO: 198472 - DNA, 11 bp, Unknown
  misc_feature (1)..( 11): Result.006 file - promoters50/5665507
aactttaaata

SEQ ID NO: 198473 - DNA, 11 bp, Unknown
  misc_feature (1)..( 11): Result.006 file - promoters50/5665507
aaacttagata

SEQ ID NO: 198474 - DNA, 11 bp, Unknown
  misc_feature (1)..( 11): Result.006 file - promoters50/5665507
ggctttaacca

SEQ ID NO: 198475 - DNA, 11 bp, Unknown
  misc_feature (1)..( 11): Result.006 file - promoters50/5665507
gcaagtaaata

SEQ ID NO: 198476 - DNA, 9 bp, Unknown
  misc_feature (1)..( 9): Result.006 file - promoters50/5665507
gctttaaaa

SEQ ID NO: 198477 - DNA, 9 bp, Unknown
  misc_feature (1)..( 9): Result.006 file - promoters50/5665507
tatttaaag

SEQ ID NO: 198478 - DNA, 9 bp, Unknown
  misc_feature (1)..( 9): Result.006 file - promoters50/5665507
actttaaat

SEQ ID NO: 198479 - DNA, 9 bp, Unknown
  misc_feature (1)..( 9): Result.006 file - promoters50/5665507
cagttaaat

SEQ ID NO: 198480 - DNA, 9 bp, Unknown
  misc_feature (1)..( 9): Result.006 file - promoters50/5665507
tatataaaa

SEQ ID NO: 198481 - DNA, 9 bp, Unknown
  misc_feature (1)..( 9): Result.006 file - promoters50/5665796
catatatta

SEQ ID NO: 198482 - DNA, 11 bp, Unknown
  misc_feature (1)..( 11): Result.006 file - promoters50/5665796
ttttatccacc

SEQ ID NO: 198483 - DNA, 11 bp, Unknown
  misc_feature (1)..( 11): Result.006 file - promoters50/5665796
cagcatccaca

SEQ ID NO: 198484 - DNA, 11 bp, Unknown
  misc_feature (1)..( 11): Result.006 file - promoters50/5665796
tagcaaccaca

SEQ ID NO: 198485 - DNA, 11 bp, Unknown
  misc_feature (1)..( 11): Result.006 file - promoters50/5665796
cagaatccatt

SEQ ID NO: 198486 - DNA, 11 bp, Unknown
  misc_feature (1)..( 11): Result.006 file - promoters50/5665796
ttgaatcctat

SEQ ID NO: 198487 - DNA, 11 bp, Unknown
  misc_feature (1)..( 11): Result.006 file - promoters50/5665796
taaaatccaat

SEQ ID NO: 198488 - DNA, 11 bp, Unknown
  misc_feature (1)..( 11): Result.006 file - promoters50/5665796
tatccaccaca

SEQ ID NO: 198489 - DNA, 11 bp, Unknown
  misc_feature (1)..( 11): Result.006 file - promoters50/5665796
tagcaaccaca

SEQ ID NO: 198490 - DNA, 11 bp, Unknown
  misc_feature (1)..( 11): Result.006 file - promoters50/5665796
cagcatccaca

SEQ ID NO: 198491 - DNA, 11 bp, Unknown
  misc_feature (1)..( 11): Result.006 file - promoters50/5665796
cagaatccatt

SEQ ID NO: 198492 - DNA, 11 bp, Unknown
  misc_feature (1)..( 11): Result.006 file - promoters50/5665796
ttgaatcctat

SEQ ID NO: 198493 - DNA, 11 bp, Unknown
  misc_feature (1)..( 11): Result.006 file - promoters50/5665796
taaaatccaat

SEQ ID NO: 198494 - DNA, 9 bp, Unknown
  misc_feature (1)..( 9): Result.006 file - promoters50/5665796
gtatcagta

SEQ ID NO: 198495 - DNA, 9 bp, Unknown
  misc_feature (1)..( 9): Result.006 file - promoters50/5665796
ttatcaggc

SEQ ID NO: 198496 - DNA, 9 bp, Unknown
  misc_feature (1)..( 9): Result.006 file - promoters50/5665796
atataagta

SEQ ID NO: 198497 - DNA, 9 bp, Unknown
  misc_feature (1)..( 9): Result.006 file - promoters50/5665796
ttaacagtt

SEQ ID NO: 198498 - DNA, 9 bp, Unknown
  misc_feature (1)..( 9): Result.006 file - promoters50/5665796
atataaacc

SEQ ID NO: 198499 - DNA, 9 bp, Unknown
  misc_feature (1)..( 9): Result.006 file - promoters50/5666614
gtgtaagta

SEQ ID NO: 198500 - DNA, 8 bp, Unknown
  misc_feature (1)..( 8): Result.006 file - promoters50/5666614
ttaaaaaa

SEQ ID NO: 198501 - DNA, 8 bp, Unknown
  misc_feature (1)..( 8): Result.006 file - promoters50/5666614
ttataaac

SEQ ID NO: 198502 - DNA, 8 bp, Unknown
  misc_feature (1)..( 8): Result.006 file - promoters50/5666614
taataaaa

SEQ ID NO: 198503 - DNA, 7 bp, Unknown
  misc_feature (1)..( 7): Result.006 file - promoters50/5666614
gtttaac

SEQ ID NO: 198504 - DNA, 7 bp, Unknown
  misc_feature (1)..( 7): Result.006 file - promoters50/5666614
gttaaac

SEQ ID NO: 198505 - DNA, 7 bp, Unknown
  misc_feature (1)..( 7): Result.006 file - promoters50/5666614
ttttaac

SEQ ID NO: 198506 - DNA, 8 bp, Unknown
  misc_feature (1)..( 8): Result.006 file - promoters50/5666614
taatttcg

SEQ ID NO: 198507 - DNA, 8 bp, Unknown
  misc_feature (1)..( 8): Result.006 file - promoters50/5666614
aaatctcg

SEQ ID NO: 198508 - DNA, 8 bp, Unknown
  misc_feature (1)..( 8): Result.006 file - promoters50/5666614
taacttcc

SEQ ID NO: 198509 - DNA, 8 bp, Unknown
  misc_feature (1)..( 8): Result.006 file - promoters50/5666614
taacttct

SEQ ID NO: 198510 - DNA, 9 bp, Unknown
  misc_feature (1)..( 9): Result.006 file - promoters50/5666614
cgttagact

SEQ ID NO: 198511 - DNA, 9 bp, Unknown
  misc_feature (1)..( 9): Result.006 file - promoters50/5666614
gtttacact

SEQ ID NO: 198512 - DNA, 9 bp, Unknown
  misc_feature (1)..( 9): Result.006 file - promoters50/5666614
gtttacaag

SEQ ID NO: 198513 - DNA, 10 bp, Unknown
  misc_feature (1)..( 10): Result.006 file - promoters50/5666614
ttgtttacaa

SEQ ID NO: 198514 - DNA, 10 bp, Unknown
  misc_feature (1)..( 10): Result.006 file - promoters50/5666614
ttgcttacct

SEQ ID NO: 198515 - DNA, 10 bp, Unknown
  misc_feature (1)..( 10): Result.006 file - promoters50/5666614
tgctttacaa

SEQ ID NO: 198516 - DNA, 8 bp, Unknown
  misc_feature (1)..( 8): Result.006 file - promoters50/5666614
ctttcttc

SEQ ID NO: 198517 - DNA, 8 bp, Unknown
  misc_feature (1)..( 8): Result.006 file - promoters50/5666614
atttcttc

SEQ ID NO: 198518 - DNA, 8 bp, Unknown
  misc_feature (1)..( 8): Result.006 file - promoters50/5667083
atttctta

SEQ ID NO: 198519 - DNA, 10 bp, Unknown
  misc_feature (1)..( 10): Result.006 file - promoters50/5667083
gaggtattgc

SEQ ID NO: 198520 - DNA, 10 bp, Unknown
  misc_feature (1)..( 10): Result.006 file - promoters50/5667083
gaggcattgc

SEQ ID NO: 198521 - DNA, 10 bp, Unknown
  misc_feature (1)..( 10): Result.006 file - promoters50/5667083
gagttatgta

SEQ ID NO: 198522 - DNA, 11 bp, Unknown
  misc_feature (1)..( 11): Result.006 file - promoters50/5667083
gctaaaatgtt

SEQ ID NO: 198523 - DNA, 11 bp, Unknown
  misc_feature (1)..( 11): Result.006 file - promoters50/5667083
tttaaattgtt

SEQ ID NO: 198524 - DNA, 11 bp, Unknown
  misc_feature (1)..( 11): Result.006 file - promoters50/5667083
gttgaaataag

SEQ ID NO: 198525 - DNA, 11 bp, Unknown
  misc_feature (1)..( 11): Result.006 file - promoters50/5667083
cccaaactgtc

SEQ ID NO: 198526 - DNA, 7 bp, Unknown
  misc_feature (1)..( 7): Result.006 file - promoters50/5667083
agaataa

SEQ ID NO: 198527 - DNA, 7 bp, Unknown
  misc_feature (1)..( 7): Result.006 file - promoters50/5667083
agagtaa

SEQ ID NO: 198528 - DNA, 7 bp, Unknown
  misc_feature (1)..( 7): Result.006 file - promoters50/5667083
agagtat

SEQ ID NO: 198529 - DNA, 8 bp, Unknown
  misc_feature (1)..( 8): Result.006 file - promoters50/5667083
aatgagaa

SEQ ID NO: 198530 - DNA, 8 bp, Unknown
  misc_feature (1)..( 8): Result.006 file - promoters50/5667083
aatgcgaa

SEQ ID NO: 198531 - DNA, 8 bp, Unknown
  misc_feature (1)..( 8): Result.006 file - promoters50/5667152
aatacgaa

SEQ ID NO: 198532 - DNA, 13 bp, Unknown
  misc_feature (1)..( 13): Result.006 file - promoters50/5667152
gttcctggtctgt

SEQ ID NO: 198533 - DNA, 13 bp, Unknown
  misc_feature (1)..( 13): Result.006 file - promoters50/5667152
attattggtttgt

SEQ ID NO: 198534 - DNA, 13 bp, Unknown
  misc_feature (1)..( 13): Result.006 file - promoters50/5667152
ttgtttgatttgt

SEQ ID NO: 198535 - DNA, 13 bp, Unknown
  misc_feature (1)..( 13): Result.006 file - promoters50/5667152
ttgcttgatgttg

SEQ ID NO: 198536 - DNA, 12 bp, Unknown
  misc_feature (1)..( 12): Result.006 file - promoters50/5667152
tttcttcttctt

SEQ ID NO: 198537 - DNA, 12 bp, Unknown
  misc_feature (1)..( 12): Result.006 file - promoters50/5667152
tttcttcatatg

SEQ ID NO: 198538 - DNA, 12 bp, Unknown
  misc_feature (1)..( 12): Result.006 file - promoters50/5667152
attcttcttctt

SEQ ID NO: 198539 - DNA, 12 bp, Unknown
  misc_feature (1)..( 12): Result.006 file - promoters50/5667426
tctcttctgcaa

SEQ ID NO: 198540 - DNA, 8 bp, Unknown
  misc_feature (1)..( 8): Result.006 file - promoters50/5667426
tgtatgtg

SEQ ID NO: 198541 - DNA, 8 bp, Unknown
  misc_feature (1)..( 8): Result.006 file - promoters50/5667426
tgtttgta

SEQ ID NO: 198542 - DNA, 8 bp, Unknown
  misc_feature (1)..( 8): Result.006 file - promoters50/5667426
agttggta

SEQ ID NO: 198543 - DNA, 8 bp, Unknown
  misc_feature (1)..( 8): Result.006 file - promoters50/5667426
aaaactaa

SEQ ID NO: 198544 - DNA, 8 bp, Unknown
  misc_feature (1)..( 8): Result.006 file - promoters50/5667426
aaaactca

SEQ ID NO: 198545 - DNA, 8 bp, Unknown
  misc_feature (1)..( 8): Result.006 file - promoters50/5667426
aaatctca

SEQ ID NO: 198546 - DNA, 7 bp, Unknown
  misc_feature (1)..( 7): Result.006 file - promoters50/5667426
gtttgtt

SEQ ID NO: 198547 - DNA, 7 bp, Unknown
  misc_feature (1)..( 7): Result.006 file - promoters50/5667426
atttgtt

SEQ ID NO: 198548 - DNA, 7 bp, Unknown
  misc_feature (1)..( 7): Result.006 file - promoters50/5667426
atttgtc

SEQ ID NO: 198549 - DNA, 8 bp, Unknown
  misc_feature (1)..( 8): Result.006 file - promoters50/5667426
tttattgt

SEQ ID NO: 198550 - DNA, 8 bp, Unknown
  misc_feature (1)..( 8): Result.006 file - promoters50/5667426
tttattca

SEQ ID NO: 198551 - DNA, 8 bp, Unknown
  misc_feature (1)..( 8): Result.006 file - promoters50/5667570
tttattat

SEQ ID NO: 198552 - DNA, 12 bp, Unknown
  misc_feature (1)..( 12): Result.006 file - promoters50/5667570
gaaataagccaa

SEQ ID NO: 198553 - DNA, 12 bp, Unknown
  misc_feature (1)..( 12): Result.006 file - promoters50/5667570
taaaaaagaaat

SEQ ID NO: 198554 - DNA, 12 bp, Unknown
  misc_feature (1)..( 12): Result.006 file - promoters50/5667570
ataataagttgt

SEQ ID NO: 198555 - DNA, 12 bp, Unknown
  misc_feature (1)..( 12): Result.006 file - promoters50/5667570
taaatagagaac

SEQ ID NO: 198556 - DNA, 12 bp, Unknown
  misc_feature (1)..( 12): Result.006 file - promoters50/5667570
gagaaaagagta

SEQ ID NO: 198557 - DNA, 12 bp, Unknown
  misc_feature (1)..( 12): Result.006 file - promoters50/5667570
ccaaaaagtaat

SEQ ID NO: 198558 - DNA, 12 bp, Unknown
  misc_feature (1)..( 12): Result.006 file - promoters50/5667570
caaaaacttaac

SEQ ID NO: 198559 - DNA, 13 bp, Unknown
  misc_feature (1)..( 13): Result.006 file - promoters50/5667570
gccaaacaaatta

SEQ ID NO: 198560 - DNA, 13 bp, Unknown
  misc_feature (1)..( 13): Result.006 file - promoters50/5667570
aaaaaagaaatga

SEQ ID NO: 198561 - DNA, 13 bp, Unknown
  misc_feature (1)..( 13): Result.006 file - promoters50/5667570
gaacaacgaatta

SEQ ID NO: 198562 - DNA, 13 bp, Unknown
  misc_feature (1)..( 13): Result.006 file - promoters50/5667570
agaaaagagtaat

SEQ ID NO: 198563 - DNA, 13 bp, Unknown
  misc_feature (1)..( 13): Result.006 file - promoters50/5667570
caaaaagtaatta

SEQ ID NO: 198564 - DNA, 13 bp, Unknown
  misc_feature (1)..( 13): Result.006 file - promoters50/5667570
caaaaacttaacc

SEQ ID NO: 198565 - DNA, 14 bp, Unknown
  misc_feature (1)..( 14): Result.006 file - promoters50/5667570
ctatatatataaac

SEQ ID NO: 198566 - DNA, 14 bp, Unknown
  misc_feature (1)..( 14): Result.006 file - promoters50/5667570
tcctatatataaac

SEQ ID NO: 198567 - DNA, 14 bp, Unknown
  misc_feature (1)..( 14): Result.006 file - promoters50/5667570
ctataaatatgaac

SEQ ID NO: 198568 - DNA, 14 bp, Unknown
  misc_feature (1)..( 14): Result.006 file - promoters50/5667570
ctctatatatatat

SEQ ID NO: 198569 - DNA, 14 bp, Unknown
  misc_feature (1)..( 14): Result.006 file - promoters50/5667570
attgtcctataaat

SEQ ID NO: 198570 - DNA, 14 bp, Unknown
  misc_feature (1)..( 14): Result.006 file - promoters50/5667588
tctagtatataaat

SEQ ID NO: 198571 - DNA, 10 bp, Unknown
  misc_feature (1)..( 10): Result.006 file - promoters50/5667588
tatataaaca

SEQ ID NO: 198572 - DNA, 10 bp, Unknown
  misc_feature (1)..( 10): Result.006 file - promoters50/5667588
tatctaagtg

SEQ ID NO: 198573 - DNA, 10 bp, Unknown
  misc_feature (1)..( 10): Result.006 file - promoters50/5667588
gttctacgtg

SEQ ID NO: 198574 - DNA, 8 bp, Unknown
  misc_feature (1)..( 8): Result.006 file - promoters50/5667588
gttatata

SEQ ID NO: 198575 - DNA, 8 bp, Unknown
  misc_feature (1)..( 8): Result.006 file - promoters50/5667588
actatata

SEQ ID NO: 198576 - DNA, 8 bp, Unknown
  misc_feature (1)..( 8): Result.006 file - promoters50/5667588
actctata

SEQ ID NO: 198577 - DNA, 8 bp, Unknown
  misc_feature (1)..( 8): Result.006 file - promoters50/5667588
gctcaaga

SEQ ID NO: 198578 - DNA, 8 bp, Unknown
  misc_feature (1)..( 8): Result.006 file - promoters50/5667588
ggtcaaga

SEQ ID NO: 198579 - DNA, 8 bp, Unknown
  misc_feature (1)..( 8): Result.006 file - promoters50/5667674
ggtgaagg

SEQ ID NO: 198580 - DNA, 8 bp, Unknown
  misc_feature (1)..( 8): Result.006 file - promoters50/5667674
acaaaagt

SEQ ID NO: 198581 - DNA, 8 bp, Unknown
  misc_feature (1)..( 8): Result.006 file - promoters50/5667674
acaaaaag

SEQ ID NO: 198582 - DNA, 8 bp, Unknown
  misc_feature (1)..( 8): Result.006 file - promoters50/5667674
acacaagt

SEQ ID NO: 198583 - DNA, 9 bp, Unknown
  misc_feature (1)..( 9): Result.006 file - promoters50/5667674
acaaaagtt

SEQ ID NO: 198584 - DNA, 9 bp, Unknown
  misc_feature (1)..( 9): Result.006 file - promoters50/5667674
caaaaagtt

SEQ ID NO: 198585 - DNA, 9 bp, Unknown
  misc_feature (1)..( 9): Result.006 file - promoters50/5667674
acacaagtc

SEQ ID NO: 198586 - DNA, 8 bp, Unknown
  misc_feature (1)..( 8): Result.006 file - promoters50/5667674
agagaaaa

SEQ ID NO: 198587 - DNA, 8 bp, Unknown
  misc_feature (1)..( 8): Result.006 file - promoters50/5667674
agataaaa

SEQ ID NO: 198588 - DNA, 8 bp, Unknown
  misc_feature (1)..( 8): Result.006 file - promoters50/5667685
acataaaa

SEQ ID NO: 198589 - DNA, 10 bp, Unknown
  misc_feature (1)..( 10): Result.006 file - promoters50/5667685
aagtaaacaa

SEQ ID NO: 198590 - DNA, 10 bp, Unknown
  misc_feature (1)..( 10): Result.006 file - promoters50/5667685
ttgtaaccaa

SEQ ID NO: 198591 - DNA, 10 bp, Unknown
  misc_feature (1)..( 10): Result.006 file - promoters50/5667689
ttggaactgc

SEQ ID NO: 198592 - DNA, 7 bp, Unknown
  misc_feature (1)..( 7): Result.006 file - promoters50/5667689
taaaacc

SEQ ID NO: 198593 - DNA, 7 bp, Unknown
  misc_feature (1)..( 7): Result.006 file - promoters50/5667689
taaaaca

SEQ ID NO: 198594 - DNA, 7 bp, Unknown
  misc_feature (1)..( 7): Result.006 file - promoters50/5667705
taaaacc

SEQ ID NO: 198595 - DNA, 10 bp, Unknown
  misc_feature (1)..( 10): Result.006 file - promoters50/5667705
gatagaaagt

SEQ ID NO: 198596 - DNA, 10 bp, Unknown
  misc_feature (1)..( 10): Result.006 file - promoters50/5667705
aatagaatca

SEQ ID NO: 198597 - DNA, 10 bp, Unknown
  misc_feature (1)..( 10): Result.006 file - promoters50/5667705
aataaaatca

SEQ ID NO: 198598 - DNA, 9 bp, Unknown
  misc_feature (1)..( 9): Result.006 file - promoters50/5667705
tttgttccg

SEQ ID NO: 198599 - DNA, 9 bp, Unknown
  misc_feature (1)..( 9): Result.006 file - promoters50/5667705
ttttttccg

SEQ ID NO: 198600 - DNA, 9 bp, Unknown
  misc_feature (1)..( 9): Result.006 file - promoters50/5667705
ttcgttttc

SEQ ID NO: 198601 - DNA, 14 bp, Unknown
  misc_feature (1)..( 14): Result.006 file - promoters50/5667705
cgtttagatttttg

SEQ ID NO: 198602 - DNA, 14 bp, Unknown
  misc_feature (1)..( 14): Result.006 file - promoters50/5667705
cgtttagttttttg

SEQ ID NO: 198603 - DNA, 14 bp, Unknown
  misc_feature (1)..( 14): Result.006 file - promoters50/5667705
tcttgagatttgag

SEQ ID NO: 198604 - DNA, 8 bp, Unknown
  misc_feature (1)..( 8): Result.006 file - promoters50/5667705
gttggaag

SEQ ID NO: 198605 - DNA, 8 bp, Unknown
  misc_feature (1)..( 8): Result.006 file - promoters50/5667705
attgaaag

SEQ ID NO: 198606 - DNA, 8 bp, Unknown
  misc_feature (1)..( 8): Result.006 file - promoters50/5667720
attcaaag

SEQ ID NO: 198607 - DNA, 14 bp, Unknown
  misc_feature (1)..( 14): Result.006 file - promoters50/5667720
ttataaccaaaaat

SEQ ID NO: 198608 - DNA, 14 bp, Unknown
  misc_feature (1)..( 14): Result.006 file - promoters50/5667720
atttaaccaaaata

SEQ ID NO: 198609 - DNA, 14 bp, Unknown
  misc_feature (1)..( 14): Result.006 file - promoters50/5667720
aataaactaaacac

SEQ ID NO: 198610 - DNA, 15 bp, Unknown
  misc_feature (1)..( 15): Result.006 file - promoters50/5667720
ctataacccaaaatt

SEQ ID NO: 198611 - DNA, 15 bp, Unknown
  misc_feature (1)..( 15): Result.006 file - promoters50/5667720
ttttagccaatcagt

SEQ ID NO: 198612 - DNA, 15 bp, Unknown
  misc_feature (1)..( 15): Result.006 file - promoters50/5667720
ttttagttatatgac

SEQ ID NO: 198613 - DNA, 15 bp, Unknown
  misc_feature (1)..( 15): Result.006 file - promoters50/5667720
ataaatcgtaaaatt

SEQ ID NO: 198614 - DNA, 20 bp, Unknown
  misc_feature (1)..( 20): Result.006 file - promoters50/5667720
tataaccaaaaataatagta

SEQ ID NO: 198615 - DNA, 20 bp, Unknown
  misc_feature (1)..( 20): Result.006 file - promoters50/5667720
atttaaccaaaataaaataa

SEQ ID NO: 198616 - DNA, 20 bp, Unknown
  misc_feature (1)..( 20): Result.006 file - promoters50/5667720
tataacccaaaattgaccct

SEQ ID NO: 198617 - DNA, 20 bp, Unknown
  misc_feature (1)..( 20): Result.006 file - promoters50/5667720
tgagtttcgaaataaatgac

SEQ ID NO: 198618 - DNA, 20 bp, Unknown
  misc_feature (1)..( 20): Result.006 file - promoters50/5667720
ctctatgaaaaataaactaa

SEQ ID NO: 198619 - DNA, 19 bp, Unknown
  misc_feature (1)..( 19): Result.006 file - promoters50/5667720
agtaacaaaaacaaaagga

SEQ ID NO: 198620 - DNA, 13 bp, Unknown
  misc_feature (1)..( 13): Result.006 file - promoters50/5667720
caaaacaatttta

SEQ ID NO: 198621 - DNA, 16 bp, Unknown
  misc_feature (1)..( 16): Result.006 file - promoters50/5667720
ccaaaaaagaaatatg

SEQ ID NO: 198622 - DNA, 16 bp, Unknown
  misc_feature (1)..( 16): Result.006 file - promoters50/5667720
tttaataagaaataat

SEQ ID NO: 198623 - DNA, 16 bp, Unknown
  misc_feature (1)..( 16): Result.006 file - promoters50/5667720
taaccaaaaaaattaa

SEQ ID NO: 198624 - DNA, 16 bp, Unknown
  misc_feature (1)..( 16): Result.006 file - promoters50/5667720
gtatataagatatatg

SEQ ID NO: 198625 - DNA, 16 bp, Unknown
  misc_feature (1)..( 16): Result.006 file - promoters50/5667720
gtttaaaacaaaggtc

SEQ ID NO: 198626 - DNA, 16 bp, Unknown
  misc_feature (1)..( 16): Result.006 file - promoters50/5667720
tttactaaaaaagaag

SEQ ID NO: 198627 - DNA, 16 bp, Unknown
  misc_feature (1)..( 16): Result.006 file - promoters50/5667720
attaataaaacattta

SEQ ID NO: 198628 - DNA, 12 bp, Unknown
  misc_feature (1)..( 12): Result.006 file - promoters50/5667720
aaaaaaacaaat

SEQ ID NO: 198629 - DNA, 12 bp, Unknown
  misc_feature (1)..( 12): Result.006 file - promoters50/5667720
tgtaaaacaaga

SEQ ID NO: 198630 - DNA, 12 bp, Unknown
  misc_feature (1)..( 12): Result.006 file - promoters50/5667720
attggaacaaat

SEQ ID NO: 198631 - DNA, 12 bp, Unknown
  misc_feature (1)..( 12): Result.006 file - promoters50/5667720
ttaaaaacttaa

SEQ ID NO: 198632 - DNA, 12 bp, Unknown
  misc_feature (1)..( 12): Result.006 file - promoters50/5667720
aagattacaaag

SEQ ID NO: 198633 - DNA, 12 bp, Unknown
  misc_feature (1)..( 12): Result.006 file - promoters50/5667720
ttaaaaaacttt

SEQ ID NO: 198634 - DNA, 12 bp, Unknown
  misc_feature (1)..( 12): Result.006 file - promoters50/5667720
aataaatcttta

SEQ ID NO: 198635 - DNA, 17 bp, Unknown
  misc_feature (1)..( 17): Result.006 file - promoters50/5667720
taccaaaaaaggaagaa

SEQ ID NO: 198636 - DNA, 17 bp, Unknown
  misc_feature (1)..( 17): Result.006 file - promoters50/5667720
aagcaaacaagaaaacg

SEQ ID NO: 198637 - DNA, 17 bp, Unknown
  misc_feature (1)..( 17): Result.006 file - promoters50/5667720
ttttaaaaaactttatc

SEQ ID NO: 198638 - DNA, 17 bp, Unknown
  misc_feature (1)..( 17): Result.006 file - promoters50/5667720
ttacaaagagatagaga

SEQ ID NO: 198639 - DNA, 17 bp, Unknown
  misc_feature (1)..( 17): Result.006 file - promoters50/5667720
gtataataaatctttat

SEQ ID NO: 198640 - DNA, 17 bp, Unknown
  misc_feature (1)..( 17): Result.006 file - promoters50/5667720
tattaaaaacttaatca

SEQ ID NO: 198641 - DNA, 14 bp, Unknown
  misc_feature (1)..( 14): Result.006 file - promoters50/5667720
aaaaagtttttatt

SEQ ID NO: 198642 - DNA, 14 bp, Unknown
  misc_feature (1)..( 14): Result.006 file - promoters50/5667720
ccaatatttttacg

SEQ ID NO: 198643 - DNA, 14 bp, Unknown
  misc_feature (1)..( 14): Result.006 file - promoters50/5667720
actgatttttcatt

SEQ ID NO: 198644 - DNA, 14 bp, Unknown
  misc_feature (1)..( 14): Result.006 file - promoters50/5667720
gacagctttttata

SEQ ID NO: 198645 - DNA, 14 bp, Unknown
  misc_feature (1)..( 14): Result.006 file - promoters50/5667720
aaaaactttttacg

SEQ ID NO: 198646 - DNA, 14 bp, Unknown
  misc_feature (1)..( 14): Result.006 file - promoters50/5667720
caaatcctttcatt

SEQ ID NO: 198647 - DNA, 14 bp, Unknown
  misc_feature (1)..( 14): Result.006 file - promoters50/5667720
atgtaatgtatgta

SEQ ID NO: 198648 - DNA, 14 bp, Unknown
  misc_feature (1)..( 14): Result.006 file - promoters50/5667720
aacaaatttattaa

SEQ ID NO: 198649 - DNA, 14 bp, Unknown
  misc_feature (1)..( 14): Result.006 file - promoters50/5667720
aacaaatttaatag

SEQ ID NO: 198650 - DNA, 14 bp, Unknown
  misc_feature (1)..( 14): Result.006 file - promoters50/5667720
atgttattaaataa

SEQ ID NO: 198651 - DNA, 14 bp, Unknown
  misc_feature (1)..( 14): Result.006 file - promoters50/5667720
atcaaaaaaaggaa

SEQ ID NO: 198652 - DNA, 14 bp, Unknown
  misc_feature (1)..( 14): Result.006 file - promoters50/5667720
atttctttttttaa

SEQ ID NO: 198653 - DNA, 8 bp, Unknown
  misc_feature (1)..( 8): Result.006 file - promoters50/5667720
gttttttt

SEQ ID NO: 198654 - DNA, 8 bp, Unknown
  misc_feature (1)..( 8): Result.006 file - promoters50/5667720
atttgttt

SEQ ID NO: 198655 - DNA, 8 bp, Unknown
  misc_feature (1)..( 8): Result.006 file - promoters50/5667720
tgttattt

SEQ ID NO: 198656 - DNA, 8 bp, Unknown
  misc_feature (1)..( 8): Result.006 file - promoters50/5667720
cttttttt

SEQ ID NO: 198657 - DNA, 8 bp, Unknown
  misc_feature (1)..( 8): Result.006 file - promoters50/5667720
agtttttc

SEQ ID NO: 198658 - DNA, 8 bp, Unknown
  misc_feature (1)..( 8): Result.006 file - promoters50/5667720
ccttttta

SEQ ID NO: 198659 - DNA, 8 bp, Unknown
  misc_feature (1)..( 8): Result.006 file - promoters50/5667720
aatcatat

SEQ ID NO: 198660 - DNA, 8 bp, Unknown
  misc_feature (1)..( 8): Result.006 file - promoters50/5667720
aatgataa

SEQ ID NO: 198661 - DNA, 8 bp, Unknown
  misc_feature (1)..( 8): Result.006 file - promoters50/5667720
aatcatgc

SEQ ID NO: 198662 - DNA, 8 bp, Unknown
  misc_feature (1)..( 8): Result.006 file - promoters50/5667720
aatgatgg

SEQ ID NO: 198663 - DNA, 8 bp, Unknown
  misc_feature (1)..( 8): Result.006 file - promoters50/5667720
tatgttaa

SEQ ID NO: 198664 - DNA, 8 bp, Unknown
  misc_feature (1)..( 8): Result.006 file - promoters50/5667720
aataagtt

SEQ ID NO: 198665 - DNA, 11 bp, Unknown
  misc_feature (1)..( 11): Result.006 file - promoters50/5667720
ggaaactttat

SEQ ID NO: 198666 - DNA, 11 bp, Unknown
  misc_feature (1)..( 11): Result.006 file - promoters50/5667720
tgaaacttaaa

SEQ ID NO: 198667 - DNA, 11 bp, Unknown
  misc_feature (1)..( 11): Result.006 file - promoters50/5667720
ggaaactgaca

SEQ ID NO: 198668 - DNA, 11 bp, Unknown
  misc_feature (1)..( 11): Result.006 file - promoters50/5667720
gtaaaattttt

SEQ ID NO: 198669 - DNA, 11 bp, Unknown
  misc_feature (1)..( 11): Result.006 file - promoters50/5667720
ccaaaattgac

SEQ ID NO: 198670 - DNA, 11 bp, Unknown
  misc_feature (1)..( 11): Result.006 file - promoters50/5667733
ttttaatagac

SEQ ID NO: 198671 - DNA, 8 bp, Unknown
  misc_feature (1)..( 8): Result.006 file - promoters50/5667733
ttttatta

SEQ ID NO: 198672 - DNA, 8 bp, Unknown
  misc_feature (1)..( 8): Result.006 file - promoters50/5667733
tattatta

SEQ ID NO: 198673 - DNA, 8 bp, Unknown
  misc_feature (1)..( 8): Result.006 file - promoters50/5667733
tatcattt

SEQ ID NO: 198674 - DNA, 7 bp, Unknown
  misc_feature (1)..( 7): Result.006 file - promoters50/5667733
atttttt

SEQ ID NO: 198675 - DNA, 7 bp, Unknown
  misc_feature (1)..( 7): Result.006 file - promoters50/5667733
ctttttt

SEQ ID NO: 198676 - DNA, 7 bp, Unknown
  misc_feature (1)..( 7): Result.006 file - promoters50/5667737
ctttttg

SEQ ID NO: 198677 - DNA, 9 bp, Unknown
  misc_feature (1)..( 9): Result.006 file - promoters50/5667737
tctacaaca

SEQ ID NO: 198678 - DNA, 9 bp, Unknown
  misc_feature (1)..( 9): Result.006 file - promoters50/5667737
actacaaag

SEQ ID NO: 198679 - DNA, 9 bp, Unknown
  misc_feature (1)..( 9): Result.006 file - promoters50/5667737
tctaaaaag

SEQ ID NO: 198680 - DNA, 9 bp, Unknown
  misc_feature (1)..( 9): Result.006 file - promoters50/5667737
tctagaaat

SEQ ID NO: 198681 - DNA, 9 bp, Unknown
  misc_feature (1)..( 9): Result.006 file - promoters50/5667737
tttaataag

SEQ ID NO: 198682 - DNA, 9 bp, Unknown
  misc_feature (1)..( 9): Result.006 file - promoters50/5667737
cataataaa

SEQ ID NO: 198683 - DNA, 13 bp, Unknown
  misc_feature (1)..( 13): Result.006 file - promoters50/5667737
aacaaaaaccaaa

SEQ ID NO: 198684 - DNA, 13 bp, Unknown
  misc_feature (1)..( 13): Result.006 file - promoters50/5667737
tacaaagaccaaa

SEQ ID NO: 198685 - DNA, 13 bp, Unknown
  misc_feature (1)..( 13): Result.006 file - promoters50/5667737
tctaaaaagtatt

SEQ ID NO: 198686 - DNA, 13 bp, Unknown
  misc_feature (1)..( 13): Result.006 file - promoters50/5667737
tctagaaattcta

SEQ ID NO: 198687 - DNA, 13 bp, Unknown
  misc_feature (1)..( 13): Result.006 file - promoters50/5667737
tttaataagagtg

SEQ ID NO: 198688 - DNA, 13 bp, Unknown
  misc_feature (1)..( 13): Result.006 file - promoters50/5667741
cataataaattat

SEQ ID NO: 198689 - DNA, 10 bp, Unknown
  misc_feature (1)..( 10): Result.006 file - promoters50/5667741
gatagatata

SEQ ID NO: 198690 - DNA, 10 bp, Unknown
  misc_feature (1)..( 10): Result.006 file - promoters50/5667741
tatatatact

SEQ ID NO: 198691 - DNA, 10 bp, Unknown
  misc_feature (1)..( 10): Result.006 file - promoters50/5667741
tatgtattgt

SEQ ID NO: 198692 - DNA, 11 bp, Unknown
  misc_feature (1)..( 11): Result.006 file - promoters50/5667741
tatttactact

SEQ ID NO: 198693 - DNA, 11 bp, Unknown
  misc_feature (1)..( 11): Result.006 file - promoters50/5667741
aatacactaaa

SEQ ID NO: 198694 - DNA, 11 bp, Unknown
  misc_feature (1)..( 11): Result.006 file - promoters50/5667766
aatttattact

SEQ ID NO: 198695 - DNA, 7 bp, Unknown
  misc_feature (1)..( 7): Result.006 file - promoters50/5667766
atattcg

SEQ ID NO: 198696 - DNA, 7 bp, Unknown
  misc_feature (1)..( 7): Result.006 file - promoters50/5667766
atattca

SEQ ID NO: 198697 - DNA, 7 bp, Unknown
  misc_feature (1)..( 7): Result.006 file - promoters50/5667766
atagtca

SEQ ID NO: 198698 - DNA, 10 bp, Unknown
  misc_feature (1)..( 10): Result.006 file - promoters50/5667766
atttttgttg

SEQ ID NO: 198699 - DNA, 10 bp, Unknown
  misc_feature (1)..( 10): Result.006 file - promoters50/5667766
attgttgttt

SEQ ID NO: 198700 - DNA, 10 bp, Unknown
  misc_feature (1)..( 10): Result.006 file - promoters50/5667766
aggtttgttg

SEQ ID NO: 198701 - DNA, 14 bp, Unknown
  misc_feature (1)..( 14): Result.006 file - promoters50/5667766
cattcggatactgg

SEQ ID NO: 198702 - DNA, 14 bp, Unknown
  misc_feature (1)..( 14): Result.006 file - promoters50/5667766
catttggacttggt

SEQ ID NO: 198703 - DNA, 14 bp, Unknown
  misc_feature (1)..( 14): Result.006 file - promoters50/5667770
gtgtcggaaactgg

SEQ ID NO: 198704 - DNA, 10 bp, Unknown
  misc_feature (1)..( 10): Result.006 file - promoters50/5667770
aaatttattt

SEQ ID NO: 198705 - DNA, 10 bp, Unknown
  misc_feature (1)..( 10): Result.006 file - promoters50/5667770
aaatatattt

SEQ ID NO: 198706 - DNA, 10 bp, Unknown
  misc_feature (1)..( 10): Result.006 file - promoters50/5667785
aaacttaata

SEQ ID NO: 198707 - DNA, 8 bp, Unknown
  misc_feature (1)..( 8): Result.006 file - promoters50/5667785
gttcgtat

SEQ ID NO: 198708 - DNA, 8 bp, Unknown
  misc_feature (1)..( 8): Result.006 file - promoters50/5667785
gttagtat

SEQ ID NO: 198709 - DNA, 8 bp, Unknown
  misc_feature (1)..( 8): Result.006 file - promoters50/5667785
cttcgtaa

SEQ ID NO: 198710 - DNA, 8 bp, Unknown
  misc_feature (1)..( 8): Result.006 file - promoters50/5667812
gttcctaa

SEQ ID NO: 198711 - DNA, 14 bp, Unknown
  misc_feature (1)..( 14): Result.006 file - promoters50/5667812
aactggaagtatgt

SEQ ID NO: 198712 - DNA, 14 bp, Unknown
  misc_feature (1)..( 14): Result.006 file - promoters50/5667812
aaatagaaatatgt

SEQ ID NO: 198713 - DNA, 14 bp, Unknown
  misc_feature (1)..( 14): Result.006 file - promoters50/5667812
atatataaaaattt

SEQ ID NO: 198714 - DNA, 14 bp, Unknown
  misc_feature (1)..( 14): Result.006 file - promoters50/5667812
gagaagaaatttat

SEQ ID NO: 198715 - DNA, 14 bp, Unknown
  misc_feature (1)..( 14): Result.006 file - promoters50/5667812
aaaaagaaatgtag

SEQ ID NO: 198716 - DNA, 14 bp, Unknown
  misc_feature (1)..( 14): Result.006 file - promoters50/5667812
aattttatatatgt

SEQ ID NO: 198717 - DNA, 11 bp, Unknown
  misc_feature (1)..( 11): Result.006 file - promoters50/5667812
tatataaaaat

SEQ ID NO: 198718 - DNA, 11 bp, Unknown
  misc_feature (1)..( 11): Result.006 file - promoters50/5667812
aaaataaaaaa

SEQ ID NO: 198719 - DNA, 11 bp, Unknown
  misc_feature (1)..( 11): Result.006 file - promoters50/5667812
tctataaaaag

SEQ ID NO: 198720 - DNA, 11 bp, Unknown
  misc_feature (1)..( 11): Result.006 file - promoters50/5667812
ggtattaaaat

SEQ ID NO: 198721 - DNA, 11 bp, Unknown
  misc_feature (1)..( 11): Result.006 file - promoters50/5667812
aaaagaaaaag

SEQ ID NO: 198722 - DNA, 12 bp, Unknown
  misc_feature (1)..( 12): Result.006 file - promoters50/5667814
gggatccataac

SEQ ID NO: 198723 - DNA, 12 bp, Unknown
  misc_feature (1)..( 12): Result.006 file - promoters50/5667814
caaatcgaagaa

SEQ ID NO: 198724 - DNA, 12 bp, Unknown
  misc_feature (1)..( 12): Result.006 file - promoters50/5667814
aaaattgaaact

SEQ ID NO: 198725 - DNA, 12 bp, Unknown
  misc_feature (1)..( 12): Result.006 file - promoters50/5667814
tattttgatact

SEQ ID NO: 198726 - DNA, 12 bp, Unknown
  misc_feature (1)..( 12): Result.006 file - promoters50/5667814
tccgttgataaa

SEQ ID NO: 198727 - DNA, 12 bp, Unknown
  misc_feature (1)..( 12): Result.006 file - promoters50/5667814
tattttaatata

SEQ ID NO: 198728 - DNA, 12 bp, Unknown
  misc_feature (1)..( 12): Result.006 file - promoters50/5667822
cgacttgaaaac

SEQ ID NO: 198729 - DNA, 13 bp, Unknown
  misc_feature (1)..( 13): Result.006 file - promoters50/5667822
aaaattgaatttg

SEQ ID NO: 198730 - DNA, 13 bp, Unknown
  misc_feature (1)..( 13): Result.006 file - promoters50/5667822
tatattgaagttt

SEQ ID NO: 198731 - DNA, 13 bp, Unknown
  misc_feature (1)..( 13): Result.006 file - promoters50/5667822
aaaactgaaatca

SEQ ID NO: 198732 - DNA, 13 bp, Unknown
  misc_feature (1)..( 13): Result.006 file - promoters50/5667822
tttgttgactttg

SEQ ID NO: 198733 - DNA, 13 bp, Unknown
  misc_feature (1)..( 13): Result.006 file - promoters50/5667822
ctacttggcttgc

SEQ ID NO: 198734 - DNA, 13 bp, Unknown
  misc_feature (1)..( 13): Result.006 file - promoters50/5667822
gttactaaaagtt

SEQ ID NO: 198735 - DNA, 8 bp, Unknown
  misc_feature (1)..( 8): Result.006 file - promoters50/5667822
tataaaaa

SEQ ID NO: 198736 - DNA, 8 bp, Unknown
  misc_feature (1)..( 8): Result.006 file - promoters50/5667822
tatcaaat

SEQ ID NO: 198737 - DNA, 8 bp, Unknown
  misc_feature (1)..( 8): Result.006 file - promoters50/5667822
cataaaat

SEQ ID NO: 198738 - DNA, 8 bp, Unknown
  misc_feature (1)..( 8): Result.006 file - promoters50/5667822
gataaaat

SEQ ID NO: 198739 - DNA, 9 bp, Unknown
  misc_feature (1)..( 9): Result.006 file - promoters50/5667822
gataacaaa

SEQ ID NO: 198740 - DNA, 9 bp, Unknown
  misc_feature (1)..( 9): Result.006 file - promoters50/5667822
tatcaatgg

SEQ ID NO: 198741 - DNA, 15 bp, Unknown
  misc_feature (1)..( 15): Result.006 file - promoters50/5667822
agtatacaaaagctt

SEQ ID NO: 198742 - DNA, 15 bp, Unknown
  misc_feature (1)..( 15): Result.006 file - promoters50/5667822
tttataaaaaattga

SEQ ID NO: 198743 - DNA, 15 bp, Unknown
  misc_feature (1)..( 15): Result.006 file - promoters50/5667822
ttggaaaaaaataac

SEQ ID NO: 198744 - DNA, 15 bp, Unknown
  misc_feature (1)..( 15): Result.006 file - promoters50/5667822
ttcttaaaaaatcaa

SEQ ID NO: 198745 - DNA, 15 bp, Unknown
  misc_feature (1)..( 15): Result.006 file - promoters50/5667822
tttgtaataataact

SEQ ID NO: 198746 - DNA, 16 bp, Unknown
  misc_feature (1)..( 16): Result.006 file - promoters50/5667822
cttacaaagaaataac

SEQ ID NO: 198747 - DNA, 16 bp, Unknown
  misc_feature (1)..( 16): Result.006 file - promoters50/5667822
atcggaaagaagaaaa

SEQ ID NO: 198748 - DNA, 10 bp, Unknown
  misc_feature (1)..( 10): Result.006 file - promoters50/5667822
aaaaaccgtt

SEQ ID NO: 198749 - DNA, 10 bp, Unknown
  misc_feature (1)..( 10): Result.006 file - promoters50/5667822
aaaaacatta

SEQ ID NO: 198750 - DNA, 10 bp, Unknown
  misc_feature (1)..( 10): Result.006 file - promoters50/5667822
aaaaaaaaaa

SEQ ID NO: 198751 - DNA, 10 bp, Unknown
  misc_feature (1)..( 10): Result.006 file - promoters50/5667822
aaaaaaataa

SEQ ID NO: 198752 - DNA, 11 bp, Unknown
  misc_feature (1)..( 11): Result.006 file - promoters50/5667822
aaagaaataac

SEQ ID NO: 198753 - DNA, 11 bp, Unknown
  misc_feature (1)..( 11): Result.006 file - promoters50/5667849
aaagaagaaaa

SEQ ID NO: 198754 - DNA, 16 bp, Unknown
  misc_feature (1)..( 16): Result.006 file - promoters50/5667849
caacattttaaaatat

SEQ ID NO: 198755 - DNA, 16 bp, Unknown
  misc_feature (1)..( 16): Result.006 file - promoters50/5667849
caagattataaatcat

SEQ ID NO: 198756 - DNA, 16 bp, Unknown
  misc_feature (1)..( 16): Result.006 file - promoters50/5667849
cttctctatgaatcat

SEQ ID NO: 198757 - DNA, 16 bp, Unknown
  misc_feature (1)..( 16): Result.006 file - promoters50/5667849
tttgtctttgaacttc

SEQ ID NO: 198758 - DNA, 16 bp, Unknown
  misc_feature (1)..( 16): Result.006 file - promoters50/5667849
agattaaatgaatagt

SEQ ID NO: 198759 - DNA, 16 bp, Unknown
  misc_feature (1)..( 16): Result.006 file - promoters50/5667849
tgcttctttggattaa

SEQ ID NO: 198760 - DNA, 12 bp, Unknown
  misc_feature (1)..( 12): Result.006 file - promoters50/5667849
atgatgcatcca

SEQ ID NO: 198761 - DNA, 12 bp, Unknown
  misc_feature (1)..( 12): Result.006 file - promoters50/5667849
tctatgaatcat

SEQ ID NO: 198762 - DNA, 12 bp, Unknown
  misc_feature (1)..( 12): Result.006 file - promoters50/5667849
attataaatcat

SEQ ID NO: 198763 - DNA, 12 bp, Unknown
  misc_feature (1)..( 12): Result.006 file - promoters50/5667849
tctttgaacttc

SEQ ID NO: 198764 - DNA, 12 bp, Unknown
  misc_feature (1)..( 12): Result.006 file - promoters50/5667849
taaatgaatagt

SEQ ID NO: 198765 - DNA, 12 bp, Unknown
  misc_feature (1)..( 12): Result.006 file - promoters50/5668051
tctttggattaa

SEQ ID NO: 198766 - DNA, 8 bp, Unknown
  misc_feature (1)..( 8): Result.006 file - promoters50/5668051
taccttat

SEQ ID NO: 198767 - DNA, 8 bp, Unknown
  misc_feature (1)..( 8): Result.006 file - promoters50/5668051
aaccatat

SEQ ID NO: 198768 - DNA, 8 bp, Unknown
  misc_feature (1)..( 8): Result.006 file - promoters50/5668051
aacaataa

SEQ ID NO: 198769 - DNA, 8 bp, Unknown
  misc_feature (1)..( 8): Result.006 file - promoters50/5668065
aacaatgg

SEQ ID NO: 198770 - DNA, 15 bp, Unknown
  misc_feature (1)..( 15): Result.006 file - promoters50/5668065
cattttgggaaaaag

SEQ ID NO: 198771 - DNA, 15 bp, Unknown
  misc_feature (1)..( 15): Result.006 file - promoters50/5668065
aattctggtagaggt

SEQ ID NO: 198772 - DNA, 15 bp, Unknown
  misc_feature (1)..( 15): Result.006 file - promoters50/5668065
catcttggtccatat

SEQ ID NO: 198773 - DNA, 15 bp, Unknown
  misc_feature (1)..( 15): Result.006 file - promoters50/5668065
cattttattcaatta

SEQ ID NO: 198774 - DNA, 15 bp, Unknown
  misc_feature (1)..( 15): Result.006 file - promoters50/5668065
aatcctgcacaagtc

SEQ ID NO: 198775 - DNA, 15 bp, Unknown
  misc_feature (1)..( 15): Result.006 file - promoters50/5668065
tcttttgatttgatt

SEQ ID NO: 198776 - DNA, 10 bp, Unknown
  misc_feature (1)..( 10): Result.006 file - promoters50/5668065
ttcaaagtcg

SEQ ID NO: 198777 - DNA, 10 bp, Unknown
  misc_feature (1)..( 10): Result.006 file - promoters50/5668065
ttcaaaaaaa

SEQ ID NO: 198778 - DNA, 11 bp, Unknown
  misc_feature (1)..( 11): Result.006 file - promoters50/5668065
ttcgaaacaaa

SEQ ID NO: 198779 - DNA, 11 bp, Unknown
  misc_feature (1)..( 11): Result.006 file - promoters50/5668065
ttccaaaatat

SEQ ID NO: 198780 - DNA, 11 bp, Unknown
  misc_feature (1)..( 11): Result.006 file - promoters50/5668065
gatgaaacaga

SEQ ID NO: 198781 - DNA, 11 bp, Unknown
  misc_feature (1)..( 11): Result.006 file - promoters50/5668069
tacgaaacgtc

SEQ ID NO: 198782 - DNA, 7 bp, Unknown
  misc_feature (1)..( 7): Result.006 file - promoters50/5668069
ttttata

SEQ ID NO: 198783 - DNA, 7 bp, Unknown
  misc_feature (1)..( 7): Result.006 file - promoters50/5668069
ttttatt

SEQ ID NO: 198784 - DNA, 7 bp, Unknown
  misc_feature (1)..( 7): Result.006 file - promoters50/5668085
tttcatt

SEQ ID NO: 198785 - DNA, 13 bp, Unknown
  misc_feature (1)..( 13): Result.006 file - promoters50/5668085
ctcttcttctttt

SEQ ID NO: 198786 - DNA, 13 bp, Unknown
  misc_feature (1)..( 13): Result.006 file - promoters50/5668085
ctcgtcttccctt

SEQ ID NO: 198787 - DNA, 13 bp, Unknown
  misc_feature (1)..( 13): Result.006 file - promoters50/5668085
ttgatcttccctt

SEQ ID NO: 198788 - DNA, 7 bp, Unknown
  misc_feature (1)..( 7): Result.006 file - promoters50/5668085
gcggaat

SEQ ID NO: 198789 - DNA, 7 bp, Unknown
  misc_feature (1)..( 7): Result.006 file - promoters50/5668085
gcggaaa

SEQ ID NO: 198790 - DNA, 7 bp, Unknown
  misc_feature (1)..( 7): Result.006 file - promoters50/5668085
tcggaaa

SEQ ID NO: 198791 - DNA, 7 bp, Unknown
  misc_feature (1)..( 7): Result.006 file - promoters50/5668085
ttccttg

SEQ ID NO: 198792 - DNA, 7 bp, Unknown
  misc_feature (1)..( 7): Result.006 file - promoters50/5668085
ctccttg

SEQ ID NO: 198793 - DNA, 7 bp, Unknown
  misc_feature (1)..( 7): Result.006 file - promoters50/5668101
ctcgttg

SEQ ID NO: 198794 - DNA, 12 bp, Unknown
  misc_feature (1)..( 12): Result.006 file - promoters50/5668101
acttatttgacc

SEQ ID NO: 198795 - DNA, 12 bp, Unknown
  misc_feature (1)..( 12): Result.006 file - promoters50/5668101
agttatttatgt

SEQ ID NO: 198796 - DNA, 12 bp, Unknown
  misc_feature (1)..( 12): Result.006 file - promoters50/5668101
tgttattgatta

SEQ ID NO: 198797 - DNA, 12 bp, Unknown
  misc_feature (1)..( 12): Result.006 file - promoters50/5668101
tgtttttgctta

SEQ ID NO: 198798 - DNA, 10 bp, Unknown
  misc_feature (1)..( 10): Result.006 file - promoters50/5668101
ggacacgtgt

SEQ ID NO: 198799 - DNA, 10 bp, Unknown
  misc_feature (1)..( 10): Result.006 file - promoters50/5668101
ggacccgtga

SEQ ID NO: 198800 - DNA, 10 bp, Unknown
  misc_feature (1)..( 10): Result.006 file - promoters50/5668101
ccaccggtga

SEQ ID NO: 198801 - DNA, 8 bp, Unknown
  misc_feature (1)..( 8): Result.006 file - promoters50/5668101
tttatgtt

SEQ ID NO: 198802 - DNA, 8 bp, Unknown
  misc_feature (1)..( 8): Result.006 file - promoters50/5668101
tttatgtt

SEQ ID NO: 198803 - DNA, 8 bp, Unknown
  misc_feature (1)..( 8): Result.006 file - promoters50/5668101
attatgtt

SEQ ID NO: 198804 - DNA, 7 bp, Unknown
  misc_feature (1)..( 7): Result.006 file - promoters50/5668101
ataagtt

SEQ ID NO: 198805 - DNA, 7 bp, Unknown
  misc_feature (1)..( 7): Result.006 file - promoters50/5668101
ttaagtt

SEQ ID NO: 198806 - DNA, 7 bp, Unknown
  misc_feature (1)..( 7): Result.006 file - promoters50/5668101
ttatgtt

SEQ ID NO: 198807 - DNA, 12 bp, Unknown
  misc_feature (1)..( 12): Result.006 file - promoters50/5668101
cttttaactaca

SEQ ID NO: 198808 - DNA, 12 bp, Unknown
  misc_feature (1)..( 12): Result.006 file - promoters50/5668101
cttgtaaccaca

SEQ ID NO: 198809 - DNA, 12 bp, Unknown
  misc_feature (1)..( 12): Result.006 file - promoters50/5668111
catgttaccaat

SEQ ID NO: 198810 - DNA, 10 bp, Unknown
  misc_feature (1)..( 10): Result.006 file - promoters50/5668111
aattaaatat

SEQ ID NO: 198811 - DNA, 10 bp, Unknown
  misc_feature (1)..( 10): Result.006 file - promoters50/5668111
aattaagagc

SEQ ID NO: 198812 - DNA, 10 bp, Unknown
  misc_feature (1)..( 10): Result.006 file - promoters50/5668111
aattatataa

SEQ ID NO: 198813 - DNA, 10 bp, Unknown
  misc_feature (1)..( 10): Result.006 file - promoters50/5668111
aattatcaag

SEQ ID NO: 198814 - DNA, 10 bp, Unknown
  misc_feature (1)..( 10): Result.006 file - promoters50/5668111
aattattatg

SEQ ID NO: 198815 - DNA, 10 bp, Unknown
  misc_feature (1)..( 10): Result.006 file - promoters50/5668111
ttgtatataa

SEQ ID NO: 198816 - DNA, 11 bp, Unknown
  misc_feature (1)..( 11): Result.006 file - promoters50/5668111
ctcttaaaaac

SEQ ID NO: 198817 - DNA, 11 bp, Unknown
  misc_feature (1)..( 11): Result.006 file - promoters50/5668111
ctgataaaaag

SEQ ID NO: 198818 - DNA, 11 bp, Unknown
  misc_feature (1)..( 11): Result.006 file - promoters50/5668111
tctttaaactg

SEQ ID NO: 198819 - DNA, 11 bp, Unknown
  misc_feature (1)..( 11): Result.006 file - promoters50/5668111
gctcgaaaaag

SEQ ID NO: 198820 - DNA, 11 bp, Unknown
  misc_feature (1)..( 11): Result.006 file - promoters50/5668111
gttagaaaaat

SEQ ID NO: 198821 - DNA, 11 bp, Unknown
  misc_feature (1)..( 11): Result.006 file - promoters50/5668111
ggaggaacaat

SEQ ID NO: 198822 - DNA, 11 bp, Unknown
  misc_feature (1)..( 11): Result.006 file - promoters50/5668111
cgattaaatgt

SEQ ID NO: 198823 - DNA, 10 bp, Unknown
  misc_feature (1)..( 10): Result.006 file - promoters50/5668111
taaatcaatc

SEQ ID NO: 198824 - DNA, 10 bp, Unknown
  misc_feature (1)..( 10): Result.006 file - promoters50/5668111
aaaaccaaca

SEQ ID NO: 198825 - DNA, 10 bp, Unknown
  misc_feature (1)..( 10): Result.006 file - promoters50/5668111
ctaatcaaaa

SEQ ID NO: 198826 - DNA, 10 bp, Unknown
  misc_feature (1)..( 10): Result.006 file - promoters50/5668111
cgtatcaaaa

SEQ ID NO: 198827 - DNA, 10 bp, Unknown
  misc_feature (1)..( 10): Result.006 file - promoters50/5668111
taaacaaagc

SEQ ID NO: 198828 - DNA, 10 bp, Unknown
  misc_feature (1)..( 10): Result.006 file - promoters50/5668162
aaaacaaaaa

SEQ ID NO: 198829 - DNA, 8 bp, Unknown
  misc_feature (1)..( 8): Result.006 file - promoters50/5668162
ttttattt

SEQ ID NO: 198830 - DNA, 8 bp, Unknown
  misc_feature (1)..( 8): Result.006 file - promoters50/5668162
ttttattt

SEQ ID NO: 198831 - DNA, 8 bp, Unknown
  misc_feature (1)..( 8): Result.006 file - promoters50/5668277
attaattt

SEQ ID NO: 198832 - DNA, 8 bp, Unknown
  misc_feature (1)..( 8): Result.006 file - promoters50/5668277
tctatcat

SEQ ID NO: 198833 - DNA, 8 bp, Unknown
  misc_feature (1)..( 8): Result.006 file - promoters50/5668277
tctctcac

SEQ ID NO: 198834 - DNA, 8 bp, Unknown
  misc_feature (1)..( 8): Result.006 file - promoters50/5668294
attctcac

SEQ ID NO: 198835 - DNA, 9 bp, Unknown
  misc_feature (1)..( 9): Result.006 file - promoters50/5668294
cattgatat

SEQ ID NO: 198836 - DNA, 9 bp, Unknown
  misc_feature (1)..( 9): Result.006 file - promoters50/5668294
aattgattc

SEQ ID NO: 198837 - DNA, 9 bp, Unknown
  misc_feature (1)..( 9): Result.006 file - promoters50/5668294
catagattc

SEQ ID NO: 198838 - DNA, 9 bp, Unknown
  misc_feature (1)..( 9): Result.006 file - promoters50/5668294
cctagtttc

SEQ ID NO: 198839 - DNA, 9 bp, Unknown
  misc_feature (1)..( 9): Result.006 file - promoters50/5668294
catagagaa

SEQ ID NO: 198840 - DNA, 9 bp, Unknown
  misc_feature (1)..( 9): Result.006 file - promoters50/5668294
aatagatta

SEQ ID NO: 198841 - DNA, 12 bp, Unknown
  misc_feature (1)..( 12): Result.006 file - promoters50/5668294
ggtgaaaatgaa

SEQ ID NO: 198842 - DNA, 12 bp, Unknown
  misc_feature (1)..( 12): Result.006 file - promoters50/5668294
ggataaaatgtg

SEQ ID NO: 198843 - DNA, 12 bp, Unknown
  misc_feature (1)..( 12): Result.006 file - promoters50/5668294
tgacaaaatgga

SEQ ID NO: 198844 - DNA, 12 bp, Unknown
  misc_feature (1)..( 12): Result.006 file - promoters50/5668294
gattaaaatgtc

SEQ ID NO: 198845 - DNA, 12 bp, Unknown
  misc_feature (1)..( 12): Result.006 file - promoters50/5668294
caggaaaaagaa

SEQ ID NO: 198846 - DNA, 12 bp, Unknown
  misc_feature (1)..( 12): Result.006 file - promoters50/5668294
ctgtaacatggc

SEQ ID NO: 198847 - DNA, 12 bp, Unknown
  misc_feature (1)..( 12): Result.006 file - promoters50/5668294
aaacaaaaactc

SEQ ID NO: 198848 - DNA, 11 bp, Unknown
  misc_feature (1)..( 11): Result.006 file - promoters50/5668294
atagataaatg

SEQ ID NO: 198849 - DNA, 11 bp, Unknown
  misc_feature (1)..( 11): Result.006 file - promoters50/5668294
agggataaaat

SEQ ID NO: 198850 - DNA, 11 bp, Unknown
  misc_feature (1)..( 11): Result.006 file - promoters50/5668294
ggagataactt

SEQ ID NO: 198851 - DNA, 11 bp, Unknown
  misc_feature (1)..( 11): Result.006 file - promoters50/5668294
aaagaaaaaaa

SEQ ID NO: 198852 - DNA, 11 bp, Unknown
  misc_feature (1)..( 11): Result.006 file - promoters50/5668294
ggagatacatc

SEQ ID NO: 198853 - DNA, 11 bp, Unknown
  misc_feature (1)..( 11): Result.006 file - promoters50/5668306
ctaaacaaaaa

SEQ ID NO: 198854 - DNA, 10 bp, Unknown
  misc_feature (1)..( 10): Result.006 file - promoters50/5668306
atccaagaag

SEQ ID NO: 198855 - DNA, 10 bp, Unknown
  misc_feature (1)..( 10): Result.006 file - promoters50/5668306
atctaagata

SEQ ID NO: 198856 - DNA, 10 bp, Unknown
  misc_feature (1)..( 10): Result.006 file - promoters50/5668306
ttacaaaaag

SEQ ID NO: 198857 - DNA, 8 bp, Unknown
  misc_feature (1)..( 8): Result.006 file - promoters50/5668306
caacactc

SEQ ID NO: 198858 - DNA, 8 bp, Unknown
  misc_feature (1)..( 8): Result.006 file - promoters50/5668306
aaacactt

SEQ ID NO: 198859 - DNA, 8 bp, Unknown
  misc_feature (1)..( 8): Result.006 file - promoters50/5668310
aaaaactt

SEQ ID NO: 198860 - DNA, 8 bp, Unknown
  misc_feature (1)..( 8): Result.006 file - promoters50/5668310
tgagaaaa

SEQ ID NO: 198861 - DNA, 8 bp, Unknown
  misc_feature (1)..( 8): Result.006 file - promoters50/5668310
tgaggaaa

SEQ ID NO: 198862 - DNA, 8 bp, Unknown
  misc_feature (1)..( 8): Result.006 file - promoters50/5668310
tgatgaag

SEQ ID NO: 198863 - DNA, 9 bp, Unknown
  misc_feature (1)..( 9): Result.006 file - promoters50/5668310
tggattgtg

SEQ ID NO: 198864 - DNA, 9 bp, Unknown
  misc_feature (1)..( 9): Result.006 file - promoters50/5668310
tggtttgtc

SEQ ID NO: 198865 - DNA, 9 bp, Unknown
  misc_feature (1)..( 9): Result.006 file - promoters50/5668317
cccattgtg

SEQ ID NO: 198866 - DNA, 15 bp, Unknown
  misc_feature (1)..( 15): Result.006 file - promoters50/5668317
ctgaatctttaagcc

SEQ ID NO: 198867 - DNA, 15 bp, Unknown
  misc_feature (1)..( 15): Result.006 file - promoters50/5668317
aagaaactttgtgat

SEQ ID NO: 198868 - DNA, 15 bp, Unknown
  misc_feature (1)..( 15): Result.006 file - promoters50/5668317
acgaaacaaagaaac

SEQ ID NO: 198869 - DNA, 15 bp, Unknown
  misc_feature (1)..( 15): Result.006 file - promoters50/5668317
acgaaactactacta

SEQ ID NO: 198870 - DNA, 15 bp, Unknown
  misc_feature (1)..( 15): Result.006 file - promoters50/5668317
atcaaacttataagt

SEQ ID NO: 198871 - DNA, 15 bp, Unknown
  misc_feature (1)..( 15): Result.006 file - promoters50/5668317
tataaagtttagtat

SEQ ID NO: 198872 - DNA, 11 bp, Unknown
  misc_feature (1)..( 11): Result.006 file - promoters50/5668317
aaaagtgagtg

SEQ ID NO: 198873 - DNA, 11 bp, Unknown
  misc_feature (1)..( 11): Result.006 file - promoters50/5668317
caaagtgtgtg

SEQ ID NO: 198874 - DNA, 11 bp, Unknown
  misc_feature (1)..( 11): Result.006 file - promoters50/5668317
aaaagagtttt

SEQ ID NO: 198875 - DNA, 11 bp, Unknown
  misc_feature (1)..( 11): Result.006 file - promoters50/5668317
ttttgtgtgtg

SEQ ID NO: 198876 - DNA, 11 bp, Unknown
  misc_feature (1)..( 11): Result.006 file - promoters50/5668317
cttagtgggcc

SEQ ID NO: 198877 - DNA, 11 bp, Unknown
  misc_feature (1)..( 11): Result.006 file - promoters50/5668317
aaaagaccgta

SEQ ID NO: 198878 - DNA, 14 bp, Unknown
  misc_feature (1)..( 14): Result.006 file - promoters50/5668317
aaatgtaaattaat

SEQ ID NO: 198879 - DNA, 14 bp, Unknown
  misc_feature (1)..( 14): Result.006 file - promoters50/5668317
aaaaagaaattaaa

SEQ ID NO: 198880 - DNA, 14 bp, Unknown
  misc_feature (1)..( 14): Result.006 file - promoters50/5668317
attgaaagattaat

SEQ ID NO: 198881 - DNA, 14 bp, Unknown
  misc_feature (1)..( 14): Result.006 file - promoters50/5668317
cccaagacatttac

SEQ ID NO: 198882 - DNA, 14 bp, Unknown
  misc_feature (1)..( 14): Result.006 file - promoters50/5668317
aaaaagtaattagg

SEQ ID NO: 198883 - DNA, 14 bp, Unknown
  misc_feature (1)..( 14): Result.006 file - promoters50/5668325
tagatgcaagtaaa

SEQ ID NO: 198884 - DNA, 9 bp, Unknown
  misc_feature (1)..( 9): Result.006 file - promoters50/5668325
tttggagaa

SEQ ID NO: 198885 - DNA, 9 bp, Unknown
  misc_feature (1)..( 9): Result.006 file - promoters50/5668325
tttggattt

SEQ ID NO: 198886 - DNA, 9 bp, Unknown
  misc_feature (1)..( 9): Result.006 file - promoters50/5668325
tttgtattc

SEQ ID NO: 198887 - DNA, 9 bp, Unknown
  misc_feature (1)..( 9): Result.006 file - promoters50/5668325
attggattt

SEQ ID NO: 198888 - DNA, 14 bp, Unknown
  misc_feature (1)..( 14): Result.006 file - promoters50/5668325
tctgttattgtttt

SEQ ID NO: 198889 - DNA, 14 bp, Unknown
  misc_feature (1)..( 14): Result.006 file - promoters50/5668325
aatcaaattttttt

SEQ ID NO: 198890 - DNA, 14 bp, Unknown
  misc_feature (1)..( 14): Result.006 file - promoters50/5668325
aaaaacaaagttta

SEQ ID NO: 198891 - DNA, 14 bp, Unknown
  misc_feature (1)..( 14): Result.006 file - promoters50/5668348
tatactaaagtttc

SEQ ID NO: 198892 - DNA, 8 bp, Unknown
  misc_feature (1)..( 8): Result.006 file - promoters50/5668348
gattgcga

SEQ ID NO: 198893 - DNA, 8 bp, Unknown
  misc_feature (1)..( 8): Result.006 file - promoters50/5668348
aatttcga

SEQ ID NO: 198894 - DNA, 8 bp, Unknown
  misc_feature (1)..( 8): Result.006 file - promoters50/5668352
aatttcgt

SEQ ID NO: 198895 - DNA, 12 bp, Unknown
  misc_feature (1)..( 12): Result.006 file - promoters50/5668352
gaataaatagtt

SEQ ID NO: 198896 - DNA, 12 bp, Unknown
  misc_feature (1)..( 12): Result.006 file - promoters50/5668352
gaaaaaagatga

SEQ ID NO: 198897 - DNA, 12 bp, Unknown
  misc_feature (1)..( 12): Result.006 file - promoters50/5668352
gaagaaaaaaat

SEQ ID NO: 198898 - DNA, 12 bp, Unknown
  misc_feature (1)..( 12): Result.006 file - promoters50/5668352
gaataaagtaat

SEQ ID NO: 198899 - DNA, 12 bp, Unknown
  misc_feature (1)..( 12): Result.006 file - promoters50/5668352
aaataaaatatg

SEQ ID NO: 198900 - DNA, 12 bp, Unknown
  misc_feature (1)..( 12): Result.006 file - promoters50/5668352
aaacaaattttt

SEQ ID NO: 198901 - DNA, 12 bp, Unknown
  misc_feature (1)..( 12): Result.006 file - promoters50/5668352
atataacatatg

SEQ ID NO: 198902 - DNA, 13 bp, Unknown
  misc_feature (1)..( 13): Result.006 file - promoters50/5668352
ttttctttaactg

SEQ ID NO: 198903 - DNA, 13 bp, Unknown
  misc_feature (1)..( 13): Result.006 file - promoters50/5668352
gtatcttcaacta

SEQ ID NO: 198904 - DNA, 13 bp, Unknown
  misc_feature (1)..( 13): Result.006 file - promoters50/5668352
gtttttttatggc

SEQ ID NO: 198905 - DNA, 13 bp, Unknown
  misc_feature (1)..( 13): Result.006 file - promoters50/5668352
tcttcattatttg

SEQ ID NO: 198906 - DNA, 13 bp, Unknown
  misc_feature (1)..( 13): Result.006 file - promoters50/5668352
ttttgtttagtgt

SEQ ID NO: 198907 - DNA, 13 bp, Unknown
  misc_feature (1)..( 13): Result.006 file - promoters50/5668352
aattgaacaacta

SEQ ID NO: 198908 - DNA, 13 bp, Unknown
  misc_feature (1)..( 13): Result.006 file - promoters50/5668352
gcaattttatgtg

SEQ ID NO: 198909 - DNA, 15 bp, Unknown
  misc_feature (1)..( 15): Result.006 file - promoters50/5668352
ggaaaaacattatta

SEQ ID NO: 198910 - DNA, 15 bp, Unknown
  misc_feature (1)..( 15): Result.006 file - promoters50/5668352
taaaatacatgatta

SEQ ID NO: 198911 - DNA, 15 bp, Unknown
  misc_feature (1)..( 15): Result.006 file - promoters50/5668352
aaagaaagatttgta

SEQ ID NO: 198912 - DNA, 15 bp, Unknown
  misc_feature (1)..( 15): Result.006 file - promoters50/5668352
agtaatataaattag

SEQ ID NO: 198913 - DNA, 15 bp, Unknown
  misc_feature (1)..( 15): Result.006 file - promoters50/5668352
agtaacatatgatgc

SEQ ID NO: 198914 - DNA, 15 bp, Unknown
  misc_feature (1)..( 15): Result.006 file - promoters50/5668352
agtaatatttgagcg

SEQ ID NO: 198915 - DNA, 15 bp, Unknown
  misc_feature (1)..( 15): Result.006 file - promoters50/5668352
aaacatacaaaaaga

SEQ ID NO: 198916 - DNA, 11 bp, Unknown
  misc_feature (1)..( 11): Result.006 file - promoters50/5668352
agtaatataaa

SEQ ID NO: 198917 - DNA, 11 bp, Unknown
  misc_feature (1)..( 11): Result.006 file - promoters50/5668352
taaaatataaa

SEQ ID NO: 198918 - DNA, 11 bp, Unknown
  misc_feature (1)..( 11): Result.006 file - promoters50/5668352
agtaacatatg

SEQ ID NO: 198919 - DNA, 11 bp, Unknown
  misc_feature (1)..( 11): Result.006 file - promoters50/5668352
agtaatatttg

SEQ ID NO: 198920 - DNA, 11 bp, Unknown
  misc_feature (1)..( 11): Result.006 file - promoters50/5668352
aaacatacaaa

SEQ ID NO: 198921 - DNA, 11 bp, Unknown
  misc_feature (1)..( 11): Result.006 file - promoters50/5668356
ttgtatataaa

SEQ ID NO: 198922 - DNA, 7 bp, Unknown
  misc_feature (1)..( 7): Result.006 file - promoters50/5668356
aaaaatg

SEQ ID NO: 198923 - DNA, 7 bp, Unknown
  misc_feature (1)..( 7): Result.006 file - promoters50/5668356
aaaaatt

SEQ ID NO: 198924 - DNA, 7 bp, Unknown
  misc_feature (1)..( 7): Result.006 file - promoters50/5668356
gaaaatg

SEQ ID NO: 198925 - DNA, 7 bp, Unknown
  misc_feature (1)..( 7): Result.006 file - promoters50/5668359
gaaaatt

SEQ ID NO: 198926 - DNA, 8 bp, Unknown
  misc_feature (1)..( 8): Result.006 file - promoters50/5668359
atggatgt

SEQ ID NO: 198927 - DNA, 8 bp, Unknown
  misc_feature (1)..( 8): Result.006 file - promoters50/5668359
atggattt

SEQ ID NO: 198928 - DNA, 8 bp, Unknown
  misc_feature (1)..( 8): Result.006 file - promoters50/5668359
ttggattt

SEQ ID NO: 198929 - DNA, 8 bp, Unknown
  misc_feature (1)..( 8): Result.006 file - promoters50/5668359
taaactac

SEQ ID NO: 198930 - DNA, 8 bp, Unknown
  misc_feature (1)..( 8): Result.006 file - promoters50/5668359
taatctaa

SEQ ID NO: 198931 - DNA, 8 bp, Unknown
  misc_feature (1)..( 8): Result.006 file - promoters50/5668367
caatttaa

SEQ ID NO: 198932 - DNA, 13 bp, Unknown
  misc_feature (1)..( 13): Result.006 file - promoters50/5668367
tcaacataaatta

SEQ ID NO: 198933 - DNA, 13 bp, Unknown
  misc_feature (1)..( 13): Result.006 file - promoters50/5668367
gaggaccaaatta

SEQ ID NO: 198934 - DNA, 13 bp, Unknown
  misc_feature (1)..( 13): Result.006 file - promoters50/5668367
gagaaccacattt

SEQ ID NO: 198935 - DNA, 9 bp, Unknown
  misc_feature (1)..( 9): Result.006 file - promoters50/5668367
ttttttaaa

SEQ ID NO: 198936 - DNA, 9 bp, Unknown
  misc_feature (1)..( 9): Result.006 file - promoters50/5668367
tttttcaaa

SEQ ID NO: 198937 - DNA, 9 bp, Unknown
  misc_feature (1)..( 9): Result.006 file - promoters50/5668367
gattctaaa

SEQ ID NO: 198938 - DNA, 14 bp, Unknown
  misc_feature (1)..( 14): Result.006 file - promoters50/5668367
tttttataacattt

SEQ ID NO: 198939 - DNA, 14 bp, Unknown
  misc_feature (1)..( 14): Result.006 file - promoters50/5668367
tttttataccattc

SEQ ID NO: 198940 - DNA, 14 bp, Unknown
  misc_feature (1)..( 14): Result.006 file - promoters50/5668367
ctaaattaacattt

SEQ ID NO: 198941 - DNA, 11 bp, Unknown
  misc_feature (1)..( 11): Result.006 file - promoters50/5668367
taaaaccaatt

SEQ ID NO: 198942 - DNA, 11 bp, Unknown
  misc_feature (1)..( 11): Result.006 file - promoters50/5668367
gaaaaacaatt

SEQ ID NO: 198943 - DNA, 11 bp, Unknown
  misc_feature (1)..( 11): Result.006 file - promoters50/5668367
gaaaaatttaa

SEQ ID NO: 198944 - DNA, 9 bp, Unknown
  misc_feature (1)..( 9): Result.006 file - promoters50/5668367
aacatttta

SEQ ID NO: 198945 - DNA, 9 bp, Unknown
  misc_feature (1)..( 9): Result.006 file - promoters50/5668367
tacaattta

SEQ ID NO: 198946 - DNA, 9 bp, Unknown
  misc_feature (1)..( 9): Result.006 file - promoters50/5668367
aaaaattta

SEQ ID NO: 198947 - DNA, 7 bp, Unknown
  misc_feature (1)..( 7): Result.006 file - promoters50/5668367
gttttct

SEQ ID NO: 198948 - DNA, 7 bp, Unknown
  misc_feature (1)..( 7): Result.006 file - promoters50/5668367
gttttcc

SEQ ID NO: 198949 - DNA, 7 bp, Unknown
  misc_feature (1)..( 7): Result.006 file - promoters50/5668367
cttttcc

SEQ ID NO: 198950 - DNA, 10 bp, Unknown
  misc_feature (1)..( 10): Result.006 file - promoters50/5668367
attgaatgga

SEQ ID NO: 198951 - DNA, 10 bp, Unknown
  misc_feature (1)..( 10): Result.006 file - promoters50/5668367
atttaatttt

SEQ ID NO: 198952 - DNA, 10 bp, Unknown
  misc_feature (1)..( 10): Result.006 file - promoters50/5668367
ttttagtttt

SEQ ID NO: 198953 - DNA, 15 bp, Unknown
  misc_feature (1)..( 15): Result.006 file - promoters50/5668367
aataaatacatcaca

SEQ ID NO: 198954 - DNA, 15 bp, Unknown
  misc_feature (1)..( 15): Result.006 file - promoters50/5668367
aataaatacatcaca

SEQ ID NO: 198955 - DNA, 15 bp, Unknown
  misc_feature (1)..( 15): Result.006 file - promoters50/5668367
tataaattcatctct

SEQ ID NO: 198956 - DNA, 15 bp, Unknown
  misc_feature (1)..( 15): Result.006 file - promoters50/5668367
tataaaatttaatcc

SEQ ID NO: 198957 - DNA, 9 bp, Unknown
  misc_feature (1)..( 9): Result.006 file - promoters50/5668367
attattttc

SEQ ID NO: 198958 - DNA, 9 bp, Unknown
  misc_feature (1)..( 9): Result.006 file - promoters50/5668367
atttttttc

SEQ ID NO: 198959 - DNA, 9 bp, Unknown
  misc_feature (1)..( 9): Result.006 file - promoters50/5668367
cttaatatc

SEQ ID NO: 198960 - DNA, 9 bp, Unknown
  misc_feature (1)..( 9): Result.006 file - promoters50/5668367
aaataatat

SEQ ID NO: 198961 - DNA, 9 bp, Unknown
  misc_feature (1)..( 9): Result.006 file - promoters50/5668367
atatagtat

SEQ ID NO: 198962 - DNA, 9 bp, Unknown
  misc_feature (1)..( 9): Result.006 file - promoters50/5668367
atatagtgt

SEQ ID NO: 198963 - DNA, 7 bp, Unknown
  misc_feature (1)..( 7): Result.006 file - promoters50/5668367
aatgatc

SEQ ID NO: 198964 - DNA, 7 bp, Unknown
  misc_feature (1)..( 7): Result.006 file - promoters50/5668367
catgatc

SEQ ID NO: 198965 - DNA, 7 bp, Unknown
  misc_feature (1)..( 7): Result.006 file - promoters50/5668367
catgatt

SEQ ID NO: 198966 - DNA, 9 bp, Unknown
  misc_feature (1)..( 9): Result.006 file - promoters50/5668367
ttttaatat

SEQ ID NO: 198967 - DNA, 9 bp, Unknown
  misc_feature (1)..( 9): Result.006 file - promoters50/5668367
tttgaatgg

SEQ ID NO: 198968 - DNA, 9 bp, Unknown
  misc_feature (1)..( 9): Result.006 file - promoters50/5668371
tttgagtgg

SEQ ID NO: 198969 - DNA, 7 bp, Unknown
  misc_feature (1)..( 7): Result.006 file - promoters50/5668371
ttttaat

SEQ ID NO: 198970 - DNA, 7 bp, Unknown
  misc_feature (1)..( 7): Result.006 file - promoters50/5668371
tttaaat

SEQ ID NO: 198971 - DNA, 7 bp, Unknown
  misc_feature (1)..( 7): Result.006 file - promoters50/5668375
ttttaat

SEQ ID NO: 198972 - DNA, 8 bp, Unknown
  misc_feature (1)..( 8): Result.006 file - promoters50/5668375
tcttttct

SEQ ID NO: 198973 - DNA, 8 bp, Unknown
  misc_feature (1)..( 8): Result.006 file - promoters50/5668375
tcttttcc

SEQ ID NO: 198974 - DNA, 8 bp, Unknown
  misc_feature (1)..( 8): Result.006 file - promoters50/5668375
gtttttct

SEQ ID NO: 198975 - DNA, 8 bp, Unknown
  misc_feature (1)..( 8): Result.006 file - promoters50/5668375
atttttct

SEQ ID NO: 198976 - DNA, 8 bp, Unknown
  misc_feature (1)..( 8): Result.006 file - promoters50/5668397
tcttttgg

SEQ ID NO: 198977 - DNA, 9 bp, Unknown
  misc_feature (1)..( 9): Result.006 file - promoters50/5668397
cgattcaat

SEQ ID NO: 198978 - DNA, 9 bp, Unknown
  misc_feature (1)..( 9): Result.006 file - promoters50/5668397
agattgaat

SEQ ID NO: 198979 - DNA, 9 bp, Unknown
  misc_feature (1)..( 9): Result.006 file - promoters50/5668397
agatattgc

SEQ ID NO: 198980 - DNA, 8 bp, Unknown
  misc_feature (1)..( 8): Result.006 file - promoters50/5668397
tcaacttc

SEQ ID NO: 198981 - DNA, 8 bp, Unknown
  misc_feature (1)..( 8): Result.006 file - promoters50/5668397
tcaacttt

SEQ ID NO: 198982 - DNA, 8 bp, Unknown
  misc_feature (1)..( 8): Result.006 file - promoters50/5668397
acaatttt

SEQ ID NO: 198983 - DNA, 11 bp, Unknown
  misc_feature (1)..( 11): Result.006 file - promoters50/5668397
taatctcttgt

SEQ ID NO: 198984 - DNA, 11 bp, Unknown
  misc_feature (1)..( 11): Result.006 file - promoters50/5668397
taatttctttt

SEQ ID NO: 198985 - DNA, 11 bp, Unknown
  misc_feature (1)..( 11): Result.006 file - promoters50/5668397
tgatttgtttt

SEQ ID NO: 198986 - DNA, 10 bp, Unknown
  misc_feature (1)..( 10): Result.006 file - promoters50/5668397
ttgaatcaat

SEQ ID NO: 198987 - DNA, 10 bp, Unknown
  misc_feature (1)..( 10): Result.006 file - promoters50/5668397
tggaaacaat

SEQ ID NO: 198988 - DNA, 10 bp, Unknown
  misc_feature (1)..( 10): Result.006 file - promoters50/5668435
tggagacagc

SEQ ID NO: 198989 - DNA, 9 bp, Unknown
  misc_feature (1)..( 9): Result.006 file - promoters50/5668435
ccaaacaac

SEQ ID NO: 198990 - DNA, 9 bp, Unknown
  misc_feature (1)..( 9): Result.006 file - promoters50/5668435
ccaaacaaa

SEQ ID NO: 198991 - DNA, 9 bp, Unknown
  misc_feature (1)..( 9): Result.006 file - promoters50/5668435
agaaacaaa

SEQ ID NO: 198992 - DNA, 9 bp, Unknown
  misc_feature (1)..( 9): Result.006 file - promoters50/5668435
aaaaacaaa

SEQ ID NO: 198993 - DNA, 9 bp, Unknown
  misc_feature (1)..( 9): Result.006 file - promoters50/5668435
tcaaagaaa

SEQ ID NO: 198994 - DNA, 10 bp, Unknown
  misc_feature (1)..( 10): Result.006 file - promoters50/5668439
taaaaccaag

SEQ ID NO: 198995 - DNA, 11 bp, Unknown
  misc_feature (1)..( 11): Result.006 file - promoters50/5668439
ttttcagaaag

SEQ ID NO: 198996 - DNA, 11 bp, Unknown
  misc_feature (1)..( 11): Result.006 file - promoters50/5668439
tttttagatgt

SEQ ID NO: 198997 - DNA, 11 bp, Unknown
  misc_feature (1)..( 11): Result.006 file - promoters50/5668439
ttttgatcagt

SEQ ID NO: 198998 - DNA, 11 bp, Unknown
  misc_feature (1)..( 11): Result.006 file - promoters50/5668439
gaattagctgt

SEQ ID NO: 198999 - DNA, 12 bp, Unknown
  misc_feature (1)..( 12): Result.006 file - promoters50/5668439
aattaaataaaa

SEQ ID NO: 199000 - DNA, 12 bp, Unknown
  misc_feature (1)..( 12): Result.006 file - promoters50/5668439
cattagataaaa

SEQ ID NO: 199001 - DNA, 12 bp, Unknown
  misc_feature (1)..( 12): Result.006 file - promoters50/5668439
cattaggttcaa

SEQ ID NO: 199002 - DNA, 7 bp, Unknown
  misc_feature (1)..( 7): Result.006 file - promoters50/5668439
aaaagaa

SEQ ID NO: 199003 - DNA, 7 bp, Unknown
  misc_feature (1)..( 7): Result.006 file - promoters50/5668439
aaaagag

SEQ ID NO: 199004 - DNA, 7 bp, Unknown
  misc_feature (1)..( 7): Result.006 file - promoters50/5668439
aaaggaa

SEQ ID NO: 199005 - DNA, 7 bp, Unknown
  misc_feature (1)..( 7): Result.006 file - promoters50/5668439
tatgaca

SEQ ID NO: 199006 - DNA, 7 bp, Unknown
  misc_feature (1)..( 7): Result.006 file - promoters50/5668439
gatgaca

SEQ ID NO: 199007 - DNA, 7 bp, Unknown
  misc_feature (1)..( 7): Result.006 file - promoters50/5668454
gataaca

SEQ ID NO: 199008 - DNA, 9 bp, Unknown
  misc_feature (1)..( 9): Result.006 file - promoters50/5668454
aaaaataaa

SEQ ID NO: 199009 - DNA, 9 bp, Unknown
  misc_feature (1)..( 9): Result.006 file - promoters50/5668454
taaaataat

SEQ ID NO: 199010 - DNA, 9 bp, Unknown
  misc_feature (1)..( 9): Result.006 file - promoters50/5668454
aaaaattcc

SEQ ID NO: 199011 - DNA, 9 bp, Unknown
  misc_feature (1)..( 9): Result.006 file - promoters50/5668454
taaattaat

SEQ ID NO: 199012 - DNA, 9 bp, Unknown
  misc_feature (1)..( 9): Result.006 file - promoters50/5668454
ataaataat

SEQ ID NO: 199013 - DNA, 9 bp, Unknown
  misc_feature (1)..( 9): Result.006 file - promoters50/5668454
taaaacatt

SEQ ID NO: 199014 - DNA, 9 bp, Unknown
  misc_feature (1)..( 9): Result.006 file - promoters50/5668457
ttaagtaaa

SEQ ID NO: 199015 - DNA, 9 bp, Unknown
  misc_feature (1)..( 9): Result.006 file - promoters50/5668457
cagttacta

SEQ ID NO: 199016 - DNA, 9 bp, Unknown
  misc_feature (1)..( 9): Result.006 file - promoters50/5668457
ttgtttcta

SEQ ID NO: 199017 - DNA, 9 bp, Unknown
  misc_feature (1)..( 9): Result.006 file - promoters50/5668457
ttgtttctt

SEQ ID NO: 199018 - DNA, 7 bp, Unknown
  misc_feature (1)..( 7): Result.006 file - promoters50/5668457
tttttgg

SEQ ID NO: 199019 - DNA, 7 bp, Unknown
  misc_feature (1)..( 7): Result.006 file - promoters50/5668457
gttttgg

SEQ ID NO: 199020 - DNA, 8 bp, Unknown
  misc_feature (1)..( 8): Result.006 file - promoters50/5668457
tttattga

SEQ ID NO: 199021 - DNA, 8 bp, Unknown
  misc_feature (1)..( 8): Result.006 file - promoters50/5668457
tttctata

SEQ ID NO: 199022 - DNA, 8 bp, Unknown
  misc_feature (1)..( 8): Result.006 file - promoters50/5668457
tttatata

SEQ ID NO: 199023 - DNA, 8 bp, Unknown
  misc_feature (1)..( 8): Result.006 file - promoters50/5668457
tttctaac

SEQ ID NO: 199024 - DNA, 7 bp, Unknown
  misc_feature (1)..( 7): Result.006 file - promoters50/5668457
aatgcaa

SEQ ID NO: 199025 - DNA, 7 bp, Unknown
  misc_feature (1)..( 7): Result.006 file - promoters50/5668457
gatgcaa

SEQ ID NO: 199026 - DNA, 7 bp, Unknown
  misc_feature (1)..( 7): Result.006 file - promoters50/5668457
aatccaa

SEQ ID NO: 199027 - DNA, 11 bp, Unknown
  misc_feature (1)..( 11): Result.006 file - promoters50/5668457
caatgtttact

SEQ ID NO: 199028 - DNA, 11 bp, Unknown
  misc_feature (1)..( 11): Result.006 file - promoters50/5668457
acatggttact

SEQ ID NO: 199029 - DNA, 11 bp, Unknown
  misc_feature (1)..( 11): Result.006 file - promoters50/5668457
caaagttgcaa

SEQ ID NO: 199030 - DNA, 7 bp, Unknown
  misc_feature (1)..( 7): Result.006 file - promoters50/5668457
gagtttt

SEQ ID NO: 199031 - DNA, 7 bp, Unknown
  misc_feature (1)..( 7): Result.006 file - promoters50/5668457
gagtttt

SEQ ID NO: 199032 - DNA, 7 bp, Unknown
  misc_feature (1)..( 7): Result.006 file - promoters50/5668457
aagtttt

SEQ ID NO: 199033 - DNA, 8 bp, Unknown
  misc_feature (1)..( 8): Result.006 file - promoters50/5668457
ggttgatg

SEQ ID NO: 199034 - DNA, 8 bp, Unknown
  misc_feature (1)..( 8): Result.006 file - promoters50/5668457
ggttgaca

SEQ ID NO: 199035 - DNA, 7 bp, Unknown
  misc_feature (1)..( 7): Result.006 file - promoters50/5668469
gtttatg

SEQ ID NO: 199036 - DNA, 11 bp, Unknown
  misc_feature (1)..( 11): Result.006 file - promoters50/5668469
tttttgttatc

SEQ ID NO: 199037 - DNA, 11 bp, Unknown
  misc_feature (1)..( 11): Result.006 file - promoters50/5668469
tgtttcttacg

SEQ ID NO: 199038 - DNA, 11 bp, Unknown
  misc_feature (1)..( 11): Result.006 file - promoters50/5668469
aatttattaac

SEQ ID NO: 199039 - DNA, 11 bp, Unknown
  misc_feature (1)..( 11): Result.006 file - promoters50/5668469
gatttgttaca

SEQ ID NO: 199040 - DNA, 11 bp, Unknown
  misc_feature (1)..( 11): Result.006 file - promoters50/5668469
tttttgtttgt

SEQ ID NO: 199041 - DNA, 11 bp, Unknown
  misc_feature (1)..( 11): Result.006 file - promoters50/5668485
catttatgaag

SEQ ID NO: 199042 - DNA, 8 bp, Unknown
  misc_feature (1)..( 8): Result.006 file - promoters50/5668485
gatcaaat

SEQ ID NO: 199043 - DNA, 8 bp, Unknown
  misc_feature (1)..( 8): Result.006 file - promoters50/5668485
tttcaaat

SEQ ID NO: 199044 - DNA, 8 bp, Unknown
  misc_feature (1)..( 8): Result.006 file - promoters50/5668485
ttttaaat

SEQ ID NO: 199045 - DNA, 11 bp, Unknown
  misc_feature (1)..( 11): Result.006 file - promoters50/5668485
taccaaagttg

SEQ ID NO: 199046 - DNA, 11 bp, Unknown
  misc_feature (1)..( 11): Result.006 file - promoters50/5668485
atccaaaggat

SEQ ID NO: 199047 - DNA, 11 bp, Unknown
  misc_feature (1)..( 11): Result.006 file - promoters50/5668485
tacgaaaattg

SEQ ID NO: 199048 - DNA, 10 bp, Unknown
  misc_feature (1)..( 10): Result.006 file - promoters50/5668485
atttttaatc

SEQ ID NO: 199049 - DNA, 10 bp, Unknown
  misc_feature (1)..( 10): Result.006 file - promoters50/5668485
atttttaaat

SEQ ID NO: 199050 - DNA, 10 bp, Unknown
  misc_feature (1)..( 10): Result.006 file - promoters50/5668485
agtttcaaat

SEQ ID NO: 199051 - DNA, 7 bp, Unknown
  misc_feature (1)..( 7): Result.006 file - promoters50/5668485
agatgca

SEQ ID NO: 199052 - DNA, 7 bp, Unknown
  misc_feature (1)..( 7): Result.006 file - promoters50/5668485
tgatgca

SEQ ID NO: 199053 - DNA, 7 bp, Unknown
  misc_feature (1)..( 7): Result.006 file - promoters50/5668493
tgatgcc

SEQ ID NO: 199054 - DNA, 12 bp, Unknown
  misc_feature (1)..( 12): Result.006 file - promoters50/5668493
cttgtcttttta

SEQ ID NO: 199055 - DNA, 12 bp, Unknown
  misc_feature (1)..( 12): Result.006 file - promoters50/5668493
cttgtgtttgat

SEQ ID NO: 199056 - DNA, 12 bp, Unknown
  misc_feature (1)..( 12): Result.006 file - promoters50/5668493
attgtatttatt

SEQ ID NO: 199057 - DNA, 12 bp, Unknown
  misc_feature (1)..( 12): Result.006 file - promoters50/5668493
ggcttctttttt

SEQ ID NO: 199058 - DNA, 12 bp, Unknown
  misc_feature (1)..( 12): Result.006 file - promoters50/5668493
ggtttgtttact

SEQ ID NO: 199059 - DNA, 12 bp, Unknown
  misc_feature (1)..( 12): Result.006 file - promoters50/5668493
tgtttctttttt

SEQ ID NO: 199060 - DNA, 11 bp, Unknown
  misc_feature (1)..( 11): Result.006 file - promoters50/5668493
tctttttattt

SEQ ID NO: 199061 - DNA, 11 bp, Unknown
  misc_feature (1)..( 11): Result.006 file - promoters50/5668493
gtgtttgatta

SEQ ID NO: 199062 - DNA, 11 bp, Unknown
  misc_feature (1)..( 11): Result.006 file - promoters50/5668493
tgtatttattt

SEQ ID NO: 199063 - DNA, 11 bp, Unknown
  misc_feature (1)..( 11): Result.006 file - promoters50/5668493
cggtttgttta

SEQ ID NO: 199064 - DNA, 11 bp, Unknown
  misc_feature (1)..( 11): Result.006 file - promoters50/5668493
ttctttttttg

SEQ ID NO: 199065 - DNA, 11 bp, Unknown
  misc_feature (1)..( 11): Result.006 file - promoters50/5668493
ttcttttttca

SEQ ID NO: 199066 - DNA, 17 bp, Unknown
  misc_feature (1)..( 17): Result.006 file - promoters50/5668493
aaaaattatcaccccaa

SEQ ID NO: 199067 - DNA, 17 bp, Unknown
  misc_feature (1)..( 17): Result.006 file - promoters50/5668493
tgtggttatcaaattga

SEQ ID NO: 199068 - DNA, 17 bp, Unknown
  misc_feature (1)..( 17): Result.006 file - promoters50/5668493
aaaaattctcaaatatt

SEQ ID NO: 199069 - DNA, 17 bp, Unknown
  misc_feature (1)..( 17): Result.006 file - promoters50/5668493
tcgaataatctcagaat

SEQ ID NO: 199070 - DNA, 17 bp, Unknown
  misc_feature (1)..( 17): Result.006 file - promoters50/5668493
aagaataaaaattgatt

SEQ ID NO: 199071 - DNA, 17 bp, Unknown
  misc_feature (1)..( 17): Result.006 file - promoters50/5668493
agtttttaccaaaatga

SEQ ID NO: 199072 - DNA, 11 bp, Unknown
  misc_feature (1)..( 11): Result.006 file - promoters50/5668493
caagtaatttt

SEQ ID NO: 199073 - DNA, 11 bp, Unknown
  misc_feature (1)..( 11): Result.006 file - promoters50/5668493
ggcctaatttt

SEQ ID NO: 199074 - DNA, 11 bp, Unknown
  misc_feature (1)..( 11): Result.006 file - promoters50/5668493
caaataatttt

SEQ ID NO: 199075 - DNA, 11 bp, Unknown
  misc_feature (1)..( 11): Result.006 file - promoters50/5668493
caaatattcaa

SEQ ID NO: 199076 - DNA, 11 bp, Unknown
  misc_feature (1)..( 11): Result.006 file - promoters50/5668493
tccataattgt

SEQ ID NO: 199077 - DNA, 11 bp, Unknown
  misc_feature (1)..( 11): Result.006 file - promoters50/5668497
caaagaattat

SEQ ID NO: 199078 - DNA, 12 bp, Unknown
  misc_feature (1)..( 12): Result.006 file - promoters50/5668497
ctctcaaggttt

SEQ ID NO: 199079 - DNA, 12 bp, Unknown
  misc_feature (1)..( 12): Result.006 file - promoters50/5668497
aactcaagattt

SEQ ID NO: 199080 - DNA, 12 bp, Unknown
  misc_feature (1)..( 12): Result.006 file - promoters50/5668497
aacacaaattaa

SEQ ID NO: 199081 - DNA, 7 bp, Unknown
  misc_feature (1)..( 7): Result.006 file - promoters50/5668497
atgtttt

SEQ ID NO: 199082 - DNA, 7 bp, Unknown
  misc_feature (1)..( 7): Result.006 file - promoters50/5668497
ttgtttt

SEQ ID NO: 199083 - DNA, 7 bp, Unknown
  misc_feature (1)..( 7): Result.006 file - promoters50/5668497
ttgattt

SEQ ID NO: 199084 - DNA, 8 bp, Unknown
  misc_feature (1)..( 8): Result.006 file - promoters50/5668497
tttgtctg

SEQ ID NO: 199085 - DNA, 8 bp, Unknown
  misc_feature (1)..( 8): Result.006 file - promoters50/5668497
tttatcta

SEQ ID NO: 199086 - DNA, 8 bp, Unknown
  misc_feature (1)..( 8): Result.006 file - promoters50/5668497
attaacta

SEQ ID NO: 199087 - DNA, 9 bp, Unknown
  misc_feature (1)..( 9): Result.006 file - promoters50/5668497
aaaatttga

SEQ ID NO: 199088 - DNA, 9 bp, Unknown
  misc_feature (1)..( 9): Result.006 file - promoters50/5668497
gaaacttga

SEQ ID NO: 199089 - DNA, 9 bp, Unknown
  misc_feature (1)..( 9): Result.006 file - promoters50/5668509
gaaactgat

SEQ ID NO: 199090 - DNA, 9 bp, Unknown
  misc_feature (1)..( 9): Result.006 file - promoters50/5668509
taaaatttc

SEQ ID NO: 199091 - DNA, 9 bp, Unknown
  misc_feature (1)..( 9): Result.006 file - promoters50/5668509
caaaattaa

SEQ ID NO: 199092 - DNA, 9 bp, Unknown
  misc_feature (1)..( 9): Result.006 file - promoters50/5668509
aaaaattaa

SEQ ID NO: 199093 - DNA, 10 bp, Unknown
  misc_feature (1)..( 10): Result.006 file - promoters50/5668509
taacaattct

SEQ ID NO: 199094 - DNA, 10 bp, Unknown
  misc_feature (1)..( 10): Result.006 file - promoters50/5668509
actaaattag

SEQ ID NO: 199095 - DNA, 10 bp, Unknown
  misc_feature (1)..( 10): Result.006 file - promoters50/5668509
aaaatattaa

SEQ ID NO: 199096 - DNA, 11 bp, Unknown
  misc_feature (1)..( 11): Result.006 file - promoters50/5668509
catataacaaa

SEQ ID NO: 199097 - DNA, 11 bp, Unknown
  misc_feature (1)..( 11): Result.006 file - promoters50/5668509
catttaatcaa

SEQ ID NO: 199098 - DNA, 11 bp, Unknown
  misc_feature (1)..( 11): Result.006 file - promoters50/5668509
gatatatcaaa

SEQ ID NO: 199099 - DNA, 11 bp, Unknown
  misc_feature (1)..( 11): Result.006 file - promoters50/5668509
gctataacgaa

SEQ ID NO: 199100 - DNA, 11 bp, Unknown
  misc_feature (1)..( 11): Result.006 file - promoters50/5668509
attataaaata

SEQ ID NO: 199101 - DNA, 11 bp, Unknown
  misc_feature (1)..( 11): Result.006 file - promoters50/5668509
actatccaacc

SEQ ID NO: 199102 - DNA, 11 bp, Unknown
  misc_feature (1)..( 11): Result.006 file - promoters50/5668509
cctcaaacata

SEQ ID NO: 199103 - DNA, 11 bp, Unknown
  misc_feature (1)..( 11): Result.006 file - promoters50/5668509
aatcaaaaata

SEQ ID NO: 199104 - DNA, 11 bp, Unknown
  misc_feature (1)..( 11): Result.006 file - promoters50/5668509
tatcaaacaat

SEQ ID NO: 199105 - DNA, 11 bp, Unknown
  misc_feature (1)..( 11): Result.006 file - promoters50/5668509
aacgaaaaata

SEQ ID NO: 199106 - DNA, 11 bp, Unknown
  misc_feature (1)..( 11): Result.006 file - promoters50/5668509
tataaaataca

SEQ ID NO: 199107 - DNA, 11 bp, Unknown
  misc_feature (1)..( 11): Result.006 file - promoters50/5668509
aataaaaatat

SEQ ID NO: 199108 - DNA, 11 bp, Unknown
  misc_feature (1)..( 11): Result.006 file - promoters50/5668509
atataacaaag

SEQ ID NO: 199109 - DNA, 11 bp, Unknown
  misc_feature (1)..( 11): Result.006 file - promoters50/5668509
aaataacagat

SEQ ID NO: 199110 - DNA, 11 bp, Unknown
  misc_feature (1)..( 11): Result.006 file - promoters50/5668509
atatatcaaac

SEQ ID NO: 199111 - DNA, 11 bp, Unknown
  misc_feature (1)..( 11): Result.006 file - promoters50/5668509
ctataacgaaa

SEQ ID NO: 199112 - DNA, 11 bp, Unknown
  misc_feature (1)..( 11): Result.006 file - promoters50/5668509
ttataaaatac

SEQ ID NO: 199113 - DNA, 11 bp, Unknown
  misc_feature (1)..( 11): Result.006 file - promoters50/5668509
gactatccaac

SEQ ID NO: 199114 - DNA, 9 bp, Unknown
  misc_feature (1)..( 9): Result.006 file - promoters50/5668509
gaacaaatg

SEQ ID NO: 199115 - DNA, 9 bp, Unknown
  misc_feature (1)..( 9): Result.006 file - promoters50/5668509
gaaaaaacg

SEQ ID NO: 199116 - DNA, 9 bp, Unknown
  misc_feature (1)..( 9): Result.006 file - promoters50/5668509
caactaatt

SEQ ID NO: 199117 - DNA, 9 bp, Unknown
  misc_feature (1)..( 9): Result.006 file - promoters50/5668509
taacaaact

SEQ ID NO: 199118 - DNA, 9 bp, Unknown
  misc_feature (1)..( 9): Result.006 file - promoters50/5668509
taataaaga

SEQ ID NO: 199119 - DNA, 9 bp, Unknown
  misc_feature (1)..( 9): Result.006 file - promoters50/5668509
aaatcaaga

SEQ ID NO: 199120 - DNA, 9 bp, Unknown
  misc_feature (1)..( 9): Result.006 file - promoters50/5668509
aaaccaatg

SEQ ID NO: 199121 - DNA, 14 bp, Unknown
  misc_feature (1)..( 14): Result.006 file - promoters50/5668509
ggaacaaaggagca

SEQ ID NO: 199122 - DNA, 14 bp, Unknown
  misc_feature (1)..( 14): Result.006 file - promoters50/5668509
gtaacaaataatta

SEQ ID NO: 199123 - DNA, 14 bp, Unknown
  misc_feature (1)..( 14): Result.006 file - promoters50/5668509
gtaacaattctaat

SEQ ID NO: 199124 - DNA, 14 bp, Unknown
  misc_feature (1)..( 14): Result.006 file - promoters50/5668509
ttaaaaattaaatg

SEQ ID NO: 199125 - DNA, 14 bp, Unknown
  misc_feature (1)..( 14): Result.006 file - promoters50/5668509
taactaaattagta

SEQ ID NO: 199126 - DNA, 14 bp, Unknown
  misc_feature (1)..( 14): Result.006 file - promoters50/5668529
tctgaaaatattaa

SEQ ID NO: 199127 - DNA, 10 bp, Unknown
  misc_feature (1)..( 10): Result.006 file - promoters50/5668529
tgaataataa

SEQ ID NO: 199128 - DNA, 10 bp, Unknown
  misc_feature (1)..( 10): Result.006 file - promoters50/5668529
aaaattatat

SEQ ID NO: 199129 - DNA, 10 bp, Unknown
  misc_feature (1)..( 10): Result.006 file - promoters50/5668529
tgaaaaatac

SEQ ID NO: 199130 - DNA, 10 bp, Unknown
  misc_feature (1)..( 10): Result.006 file - promoters50/5668529
taaaaattaa

SEQ ID NO: 199131 - DNA, 10 bp, Unknown
  misc_feature (1)..( 10): Result.006 file - promoters50/5668529
caaaaaatag

SEQ ID NO: 199132 - DNA, 10 bp, Unknown
  misc_feature (1)..( 10): Result.006 file - promoters50/5668533
gtggttatat

SEQ ID NO: 199133 - DNA, 10 bp, Unknown
  misc_feature (1)..( 10): Result.006 file - promoters50/5668533
aaaataaaaa

SEQ ID NO: 199134 - DNA, 10 bp, Unknown
  misc_feature (1)..( 10): Result.006 file - promoters50/5668533
tatataaaaa

SEQ ID NO: 199135 - DNA, 10 bp, Unknown
  misc_feature (1)..( 10): Result.006 file - promoters50/5668533
aaaataaatc

SEQ ID NO: 199136 - DNA, 10 bp, Unknown
  misc_feature (1)..( 10): Result.006 file - promoters50/5668533
agaataaaaa

SEQ ID NO: 199137 - DNA, 10 bp, Unknown
  misc_feature (1)..( 10): Result.006 file - promoters50/5668533
tgaacaaatt

SEQ ID NO: 199138 - DNA, 10 bp, Unknown
  misc_feature (1)..( 10): Result.006 file - promoters50/5668537
tgaatgaaac

SEQ ID NO: 199139 - DNA, 9 bp, Unknown
  misc_feature (1)..( 9): Result.006 file - promoters50/5668537
tattttggc

SEQ ID NO: 199140 - DNA, 9 bp, Unknown
  misc_feature (1)..( 9): Result.006 file - promoters50/5668537
tatttttac

SEQ ID NO: 199141 - DNA, 9 bp, Unknown
  misc_feature (1)..( 9): Result.006 file - promoters50/5668537
aattttttt

SEQ ID NO: 199142 - DNA, 13 bp, Unknown
  misc_feature (1)..( 13): Result.006 file - promoters50/5668537
caatgttttctca

SEQ ID NO: 199143 - DNA, 13 bp, Unknown
  misc_feature (1)..( 13): Result.006 file - promoters50/5668537
aattattttctta

SEQ ID NO: 199144 - DNA, 13 bp, Unknown
  misc_feature (1)..( 13): Result.006 file - promoters50/5668537
caatattttatca

SEQ ID NO: 199145 - DNA, 9 bp, Unknown
  misc_feature (1)..( 9): Result.006 file - promoters50/5668537
ataattctt

SEQ ID NO: 199146 - DNA, 9 bp, Unknown
  misc_feature (1)..( 9): Result.006 file - promoters50/5668537
gtaattcat

SEQ ID NO: 199147 - DNA, 9 bp, Unknown
  misc_feature (1)..( 9): Result.006 file - promoters50/5668537
ataatttcc

SEQ ID NO: 199148 - DNA, 9 bp, Unknown
  misc_feature (1)..( 9): Result.006 file - promoters50/5668537
tgaatgcat

SEQ ID NO: 199149 - DNA, 11 bp, Unknown
  misc_feature (1)..( 11): Result.006 file - promoters50/5668537
ggagctaaaat

SEQ ID NO: 199150 - DNA, 11 bp, Unknown
  misc_feature (1)..( 11): Result.006 file - promoters50/5668537
ttttctacaat

SEQ ID NO: 199151 - DNA, 11 bp, Unknown
  misc_feature (1)..( 11): Result.006 file - promoters50/5668537
ttttctaaaat

SEQ ID NO: 199152 - DNA, 11 bp, Unknown
  misc_feature (1)..( 11): Result.006 file - promoters50/5668537
tctcctaaaac

SEQ ID NO: 199153 - DNA, 8 bp, Unknown
  misc_feature (1)..( 8): Result.006 file - promoters50/5668537
taactttc

SEQ ID NO: 199154 - DNA, 8 bp, Unknown
  misc_feature (1)..( 8): Result.006 file - promoters50/5668537
taaatttc

SEQ ID NO: 199155 - DNA, 8 bp, Unknown
  misc_feature (1)..( 8): Result.006 file - promoters50/5668541
aaaaattc

SEQ ID NO: 199156 - DNA, 13 bp, Unknown
  misc_feature (1)..( 13): Result.006 file - promoters50/5668541
aaatgtttaatgt

SEQ ID NO: 199157 - DNA, 13 bp, Unknown
  misc_feature (1)..( 13): Result.006 file - promoters50/5668541
ttttgtttaatgt

SEQ ID NO: 199158 - DNA, 13 bp, Unknown
  misc_feature (1)..( 13): Result.006 file - promoters50/5668541
aaatattttttgt

SEQ ID NO: 199159 - DNA, 13 bp, Unknown
  misc_feature (1)..( 13): Result.006 file - promoters50/5668541
agttgttcaatat

SEQ ID NO: 199160 - DNA, 13 bp, Unknown
  misc_feature (1)..( 13): Result.006 file - promoters50/5668541
acgcatttaataa

SEQ ID NO: 199161 - DNA, 12 bp, Unknown
  misc_feature (1)..( 12): Result.006 file - promoters50/5668541
tttattttatac

SEQ ID NO: 199162 - DNA, 11 bp, Unknown
  misc_feature (1)..( 11): Result.006 file - promoters50/5668541
atataaaatct

SEQ ID NO: 199163 - DNA, 11 bp, Unknown
  misc_feature (1)..( 11): Result.006 file - promoters50/5668541
aaataaaaacc

SEQ ID NO: 199164 - DNA, 11 bp, Unknown
  misc_feature (1)..( 11): Result.006 file - promoters50/5668541
gaataaatttg

SEQ ID NO: 199165 - DNA, 11 bp, Unknown
  misc_feature (1)..( 11): Result.006 file - promoters50/5668541
gaataaacaat

SEQ ID NO: 199166 - DNA, 11 bp, Unknown
  misc_feature (1)..( 11): Result.006 file - promoters50/5668541
gaatatatttg

SEQ ID NO: 199167 - DNA, 11 bp, Unknown
  misc_feature (1)..( 11): Result.006 file - promoters50/5668541
cactatcttta

SEQ ID NO: 199168 - DNA, 14 bp, Unknown
  misc_feature (1)..( 14): Result.006 file - promoters50/5668541
atatttatttaaaa

SEQ ID NO: 199169 - DNA, 14 bp, Unknown
  misc_feature (1)..( 14): Result.006 file - promoters50/5668541
ttttgggtttgaaa

SEQ ID NO: 199170 - DNA, 14 bp, Unknown
  misc_feature (1)..( 14): Result.006 file - promoters50/5668541
gaatatatttgaaa

SEQ ID NO: 199171 - DNA, 14 bp, Unknown
  misc_feature (1)..( 14): Result.006 file - promoters50/5668541
gaataaatttgttg

SEQ ID NO: 199172 - DNA, 14 bp, Unknown
  misc_feature (1)..( 14): Result.006 file - promoters50/5668541
tcttatcttttttt

SEQ ID NO: 199173 - DNA, 14 bp, Unknown
  misc_feature (1)..( 14): Result.006 file - promoters50/5668541
cactatctttagga

SEQ ID NO: 199174 - DNA, 13 bp, Unknown
  misc_feature (1)..( 13): Result.006 file - promoters50/5668541
ttgaatttttttg

SEQ ID NO: 199175 - DNA, 13 bp, Unknown
  misc_feature (1)..( 13): Result.006 file - promoters50/5668541
atctctttgtttc

SEQ ID NO: 199176 - DNA, 13 bp, Unknown
  misc_feature (1)..( 13): Result.006 file - promoters50/5668541
aaatattttttgt

SEQ ID NO: 199177 - DNA, 13 bp, Unknown
  misc_feature (1)..( 13): Result.006 file - promoters50/5668541
atcttttttttga

SEQ ID NO: 199178 - DNA, 13 bp, Unknown
  misc_feature (1)..( 13): Result.006 file - promoters50/5668541
gttgactttttct

SEQ ID NO: 199179 - DNA, 13 bp, Unknown
  misc_feature (1)..( 13): Result.006 file - promoters50/5668541
tctaatttgattc

SEQ ID NO: 199180 - DNA, 14 bp, Unknown
  misc_feature (1)..( 14): Result.006 file - promoters50/5668541
gcgtatatttattt

SEQ ID NO: 199181 - DNA, 14 bp, Unknown
  misc_feature (1)..( 14): Result.006 file - promoters50/5668541
gaatatatttgaaa

SEQ ID NO: 199182 - DNA, 14 bp, Unknown
  misc_feature (1)..( 14): Result.006 file - promoters50/5668541
tcttatcttttttt

SEQ ID NO: 199183 - DNA, 14 bp, Unknown
  misc_feature (1)..( 14): Result.006 file - promoters50/5668541
cactatctttagga

SEQ ID NO: 199184 - DNA, 14 bp, Unknown
  misc_feature (1)..( 14): Result.006 file - promoters50/5668541
aaatttctctagat

SEQ ID NO: 199185 - DNA, 14 bp, Unknown
  misc_feature (1)..( 14): Result.006 file - promoters50/5668547
gaataaatttgttg

SEQ ID NO: 199186 - DNA, 7 bp, Unknown
  misc_feature (1)..( 7): Result.006 file - promoters50/5668547
acgtgga

SEQ ID NO: 199187 - DNA, 7 bp, Unknown
  misc_feature (1)..( 7): Result.006 file - promoters50/5668547
ccgtgga

SEQ ID NO: 199188 - DNA, 7 bp, Unknown
  misc_feature (1)..( 7): Result.006 file - promoters50/5668547
acgtggc

SEQ ID NO: 199189 - DNA, 7 bp, Unknown
  misc_feature (1)..( 7): Result.006 file - promoters50/5668547
gctgaaa

SEQ ID NO: 199190 - DNA, 7 bp, Unknown
  misc_feature (1)..( 7): Result.006 file - promoters50/5668547
gctaaaa

SEQ ID NO: 199191 - DNA, 7 bp, Unknown
  misc_feature (1)..( 7): Result.006 file - promoters50/5668547
tctgaaa

SEQ ID NO: 199192 - DNA, 9 bp, Unknown
  misc_feature (1)..( 9): Result.006 file - promoters50/5668547
ttttccttc

SEQ ID NO: 199193 - DNA, 9 bp, Unknown
  misc_feature (1)..( 9): Result.006 file - promoters50/5668547
tttttcttc

SEQ ID NO: 199194 - DNA, 9 bp, Unknown
  misc_feature (1)..( 9): Result.006 file - promoters50/5668547
cgtttcttt

SEQ ID NO: 199195 - DNA, 8 bp, Unknown
  misc_feature (1)..( 8): Result.006 file - promoters50/5668547
cgttgcta

SEQ ID NO: 199196 - DNA, 8 bp, Unknown
  misc_feature (1)..( 8): Result.006 file - promoters50/5668547
tgtttcta

SEQ ID NO: 199197 - DNA, 8 bp, Unknown
  misc_feature (1)..( 8): Result.006 file - promoters50/5668547
tgtctctc

SEQ ID NO: 199198 - DNA, 9 bp, Unknown
  misc_feature (1)..( 9): Result.006 file - promoters50/5668547
gtgtcctct

SEQ ID NO: 199199 - DNA, 9 bp, Unknown
  misc_feature (1)..( 9): Result.006 file - promoters50/5668547
gtgtgctct

SEQ ID NO: 199200 - DNA, 9 bp, Unknown
  misc_feature (1)..( 9): Result.006 file - promoters50/5668547
tcttcctct

SEQ ID NO: 199201 - DNA, 10 bp, Unknown
  misc_feature (1)..( 10): Result.006 file - promoters50/5668547
ttgtggctga

SEQ ID NO: 199202 - DNA, 10 bp, Unknown
  misc_feature (1)..( 10): Result.006 file - promoters50/5668547
atgtgggtga

SEQ ID NO: 199203 - DNA, 10 bp, Unknown
  misc_feature (1)..( 10): Result.006 file - promoters50/5668566
atgtggtcat

SEQ ID NO: 199204 - DNA, 13 bp, Unknown
  misc_feature (1)..( 13): Result.006 file - promoters50/5668566
gaccttttttaat

SEQ ID NO: 199205 - DNA, 13 bp, Unknown
  misc_feature (1)..( 13): Result.006 file - promoters50/5668566
ttcctttcttaat

SEQ ID NO: 199206 - DNA, 13 bp, Unknown
  misc_feature (1)..( 13): Result.006 file - promoters50/5668592
ttcgtttccttaa

SEQ ID NO: 199207 - DNA, 8 bp, Unknown
  misc_feature (1)..( 8): Result.006 file - promoters50/5668592
attttgag

SEQ ID NO: 199208 - DNA, 8 bp, Unknown
  misc_feature (1)..( 8): Result.006 file - promoters50/5668592
attatgat

SEQ ID NO: 199209 - DNA, 8 bp, Unknown
  misc_feature (1)..( 8): Result.006 file - promoters50/5668592
ttttcgag

SEQ ID NO: 199210 - DNA, 7 bp, Unknown
  misc_feature (1)..( 7): Result.006 file - promoters50/5668592
tgtttcg

SEQ ID NO: 199211 - DNA, 7 bp, Unknown
  misc_feature (1)..( 7): Result.006 file - promoters50/5668592
tgtttca

SEQ ID NO: 199212 - DNA, 7 bp, Unknown
  misc_feature (1)..( 7): Result.006 file - promoters50/5668629
cgtttcg

SEQ ID NO: 199213 - DNA, 17 bp, Unknown
  misc_feature (1)..( 17): Result.006 file - promoters50/5668629
gacaatttgaaacaata

SEQ ID NO: 199214 - DNA, 17 bp, Unknown
  misc_feature (1)..( 17): Result.006 file - promoters50/5668629
tttttttttaaaaccac

SEQ ID NO: 199215 - DNA, 17 bp, Unknown
  misc_feature (1)..( 17): Result.006 file - promoters50/5668629
agggtttttatacgtta

SEQ ID NO: 199216 - DNA, 17 bp, Unknown
  misc_feature (1)..( 17): Result.006 file - promoters50/5668629
ccaaatttcatacaaaa

SEQ ID NO: 199217 - DNA, 17 bp, Unknown
  misc_feature (1)..( 17): Result.006 file - promoters50/5668629
gggatttttgtaacgca

SEQ ID NO: 199218 - DNA, 17 bp, Unknown
  misc_feature (1)..( 17): Result.006 file - promoters50/5668629
aaaaaaagaaaacttca

SEQ ID NO: 199219 - DNA, 12 bp, Unknown
  misc_feature (1)..( 12): Result.006 file - promoters50/5668629
cttaattttcta

SEQ ID NO: 199220 - DNA, 12 bp, Unknown
  misc_feature (1)..( 12): Result.006 file - promoters50/5668629
atcaattttata

SEQ ID NO: 199221 - DNA, 12 bp, Unknown
  misc_feature (1)..( 12): Result.006 file - promoters50/5668629
attaatttttat

SEQ ID NO: 199222 - DNA, 12 bp, Unknown
  misc_feature (1)..( 12): Result.006 file - promoters50/5668629
ttcaatcttatt

SEQ ID NO: 199223 - DNA, 12 bp, Unknown
  misc_feature (1)..( 12): Result.006 file - promoters50/5668629
tctaatttcaca

SEQ ID NO: 199224 - DNA, 12 bp, Unknown
  misc_feature (1)..( 12): Result.006 file - promoters50/5668629
gtaaatcatatt

SEQ ID NO: 199225 - DNA, 14 bp, Unknown
  misc_feature (1)..( 14): Result.006 file - promoters50/5668629
gttttagtttaaag

SEQ ID NO: 199226 - DNA, 14 bp, Unknown
  misc_feature (1)..( 14): Result.006 file - promoters50/5668629
ttaatagtttaaag

SEQ ID NO: 199227 - DNA, 14 bp, Unknown
  misc_feature (1)..( 14): Result.006 file - promoters50/5668629
gtttttgtttttgt

SEQ ID NO: 199228 - DNA, 14 bp, Unknown
  misc_feature (1)..( 14): Result.006 file - promoters50/5668629
aattttgtatctaa

SEQ ID NO: 199229 - DNA, 14 bp, Unknown
  misc_feature (1)..( 14): Result.006 file - promoters50/5668629
aattttgtgtgggc

SEQ ID NO: 199230 - DNA, 14 bp, Unknown
  misc_feature (1)..( 14): Result.006 file - promoters50/5668629
tattgtgtacagtt

SEQ ID NO: 199231 - DNA, 14 bp, Unknown
  misc_feature (1)..( 14): Result.006 file - promoters50/5668629
ccatgtgtctacta

SEQ ID NO: 199232 - DNA, 11 bp, Unknown
  misc_feature (1)..( 11): Result.006 file - promoters50/5668629
aatatcttaaa

SEQ ID NO: 199233 - DNA, 11 bp, Unknown
  misc_feature (1)..( 11): Result.006 file - promoters50/5668629
tcaatcttatt

SEQ ID NO: 199234 - DNA, 11 bp, Unknown
  misc_feature (1)..( 11): Result.006 file - promoters50/5668629
tcaattttata

SEQ ID NO: 199235 - DNA, 11 bp, Unknown
  misc_feature (1)..( 11): Result.006 file - promoters50/5668629
taatttttatt

SEQ ID NO: 199236 - DNA, 11 bp, Unknown
  misc_feature (1)..( 11): Result.006 file - promoters50/5668629
aaattctaatt

SEQ ID NO: 199237 - DNA, 11 bp, Unknown
  misc_feature (1)..( 11): Result.006 file - promoters50/5668629
taaatcatatt

SEQ ID NO: 199238 - DNA, 10 bp, Unknown
  misc_feature (1)..( 10): Result.006 file - promoters50/5668629
gacgaaaaag

SEQ ID NO: 199239 - DNA, 10 bp, Unknown
  misc_feature (1)..( 10): Result.006 file - promoters50/5668629
gaccaaaaaa

SEQ ID NO: 199240 - DNA, 10 bp, Unknown
  misc_feature (1)..( 10): Result.006 file - promoters50/5668629
cgtgaataag

SEQ ID NO: 199241 - DNA, 7 bp, Unknown
  misc_feature (1)..( 7): Result.006 file - promoters50/5668629
taaaaag

SEQ ID NO: 199242 - DNA, 10 bp, Unknown
  misc_feature (1)..( 10): Result.006 file - promoters50/5668629
gaccaagaat

SEQ ID NO: 199243 - DNA, 10 bp, Unknown
  misc_feature (1)..( 10): Result.006 file - promoters50/5668720
aatgaatatt

SEQ ID NO: 199244 - DNA, 11 bp, Unknown
  misc_feature (1)..( 11): Result.006 file - promoters50/5668720
tacaataatac

SEQ ID NO: 199245 - DNA, 11 bp, Unknown
  misc_feature (1)..( 11): Result.006 file - promoters50/5668720
ttcaaaaatac

SEQ ID NO: 199246 - DNA, 11 bp, Unknown
  misc_feature (1)..( 11): Result.006 file - promoters50/5668720
aaaaattatac

SEQ ID NO: 199247 - DNA, 11 bp, Unknown
  misc_feature (1)..( 11): Result.006 file - promoters50/5668720
ttctaaaatct

SEQ ID NO: 199248 - DNA, 11 bp, Unknown
  misc_feature (1)..( 11): Result.006 file - promoters50/5668720
tttaaaaactt

SEQ ID NO: 199249 - DNA, 11 bp, Unknown
  misc_feature (1)..( 11): Result.006 file - promoters50/5668748
aaacaaaacta

SEQ ID NO: 199250 - DNA, 11 bp, Unknown
  misc_feature (1)..( 11): Result.006 file - promoters50/5668748
tttcaaaatat

SEQ ID NO: 199251 - DNA, 11 bp, Unknown
  misc_feature (1)..( 11): Result.006 file - promoters50/5668748
gaaaaaaatac

SEQ ID NO: 199252 - DNA, 11 bp, Unknown
  misc_feature (1)..( 11): Result.006 file - promoters50/5668748
actaaaaatat

SEQ ID NO: 199253 - DNA, 11 bp, Unknown
  misc_feature (1)..( 11): Result.006 file - promoters50/5668748
aaccaaaatga

SEQ ID NO: 199254 - DNA, 11 bp, Unknown
  misc_feature (1)..( 11): Result.006 file - promoters50/5668748
tttcaagatat

SEQ ID NO: 199255 - DNA, 11 bp, Unknown
  misc_feature (1)..( 11): Result.006 file - promoters50/5668748
ataaaaaataa

SEQ ID NO: 199256 - DNA, 12 bp, Unknown
  misc_feature (1)..( 12): Result.006 file - promoters50/5668748
tatttttccttt

SEQ ID NO: 199257 - DNA, 12 bp, Unknown
  misc_feature (1)..( 12): Result.006 file - promoters50/5668748
aatttttcctaa

SEQ ID NO: 199258 - DNA, 12 bp, Unknown
  misc_feature (1)..( 12): Result.006 file - promoters50/5668748
tatatttatttg

SEQ ID NO: 199259 - DNA, 12 bp, Unknown
  misc_feature (1)..( 12): Result.006 file - promoters50/5668748
acattttccttt

SEQ ID NO: 199260 - DNA, 12 bp, Unknown
  misc_feature (1)..( 12): Result.006 file - promoters50/5668748
gattattctttt

SEQ ID NO: 199261 - DNA, 12 bp, Unknown
  misc_feature (1)..( 12): Result.006 file - promoters50/5668748
taattttagggt

SEQ ID NO: 199262 - DNA, 12 bp, Unknown
  misc_feature (1)..( 12): Result.006 file - promoters50/5668748
taattttaattt

SEQ ID NO: 199263 - DNA, 14 bp, Unknown
  misc_feature (1)..( 14): Result.006 file - promoters50/5668748
aagataaaacttta

SEQ ID NO: 199264 - DNA, 14 bp, Unknown
  misc_feature (1)..( 14): Result.006 file - promoters50/5668748
ctgataaaatgcta

SEQ ID NO: 199265 - DNA, 14 bp, Unknown
  misc_feature (1)..( 14): Result.006 file - promoters50/5668748
agtataaaatactt

SEQ ID NO: 199266 - DNA, 14 bp, Unknown
  misc_feature (1)..( 14): Result.006 file - promoters50/5668748
tcgatagaacatta

SEQ ID NO: 199267 - DNA, 14 bp, Unknown
  misc_feature (1)..( 14): Result.006 file - promoters50/5668748
aagataattaaact

SEQ ID NO: 199268 - DNA, 14 bp, Unknown
  misc_feature (1)..( 14): Result.006 file - promoters50/5668748
agtatataatttta

SEQ ID NO: 199269 - DNA, 14 bp, Unknown
  misc_feature (1)..( 14): Result.006 file - promoters50/5668748
acaataatttaggt

SEQ ID NO: 199270 - DNA, 14 bp, Unknown
  misc_feature (1)..( 14): Result.006 file - promoters50/5668748
tacatagaaatcaa

SEQ ID NO: 199271 - DNA, 15 bp, Unknown
  misc_feature (1)..( 15): Result.006 file - promoters50/5668748
aaagaaaaatgacat

SEQ ID NO: 199272 - DNA, 15 bp, Unknown
  misc_feature (1)..( 15): Result.006 file - promoters50/5668748
ctgataaaatgctaa

SEQ ID NO: 199273 - DNA, 15 bp, Unknown
  misc_feature (1)..( 15): Result.006 file - promoters50/5668748
aactaaaaatatatt

SEQ ID NO: 199274 - DNA, 15 bp, Unknown
  misc_feature (1)..( 15): Result.006 file - promoters50/5668748
gaaatcaaatgacca

SEQ ID NO: 199275 - DNA, 15 bp, Unknown
  misc_feature (1)..( 15): Result.006 file - promoters50/5668748
agtataaaatacttt

SEQ ID NO: 199276 - DNA, 15 bp, Unknown
  misc_feature (1)..( 15): Result.006 file - promoters50/5668748
acttttaaatacttt

SEQ ID NO: 199277 - DNA, 15 bp, Unknown
  misc_feature (1)..( 15): Result.006 file - promoters50/5668748
agtatataattttag

SEQ ID NO: 199278 - DNA, 15 bp, Unknown
  misc_feature (1)..( 15): Result.006 file - promoters50/5668748
ccacaataatttagg

SEQ ID NO: 199279 - DNA, 13 bp, Unknown
  misc_feature (1)..( 13): Result.006 file - promoters50/5668748
acgtaattacatg

SEQ ID NO: 199280 - DNA, 13 bp, Unknown
  misc_feature (1)..( 13): Result.006 file - promoters50/5668748
agataagtaccta

SEQ ID NO: 199281 - DNA, 13 bp, Unknown
  misc_feature (1)..( 13): Result.006 file - promoters50/5668748
acggaattcctcc

SEQ ID NO: 199282 - DNA, 13 bp, Unknown
  misc_feature (1)..( 13): Result.006 file - promoters50/5668748
agaaaagtgagtt

SEQ ID NO: 199283 - DNA, 13 bp, Unknown
  misc_feature (1)..( 13): Result.006 file - promoters50/5668748
aaagaatttctcc

SEQ ID NO: 199284 - DNA, 13 bp, Unknown
  misc_feature (1)..( 13): Result.006 file - promoters50/5668748
agaaaaaacactt

SEQ ID NO: 199285 - DNA, 14 bp, Unknown
  misc_feature (1)..( 14): Result.006 file - promoters50/5668748
gataaaactttatc

SEQ ID NO: 199286 - DNA, 14 bp, Unknown
  misc_feature (1)..( 14): Result.006 file - promoters50/5668748
taaaatactttatc

SEQ ID NO: 199287 - DNA, 14 bp, Unknown
  misc_feature (1)..( 14): Result.006 file - promoters50/5668748
gatagaacattaat

SEQ ID NO: 199288 - DNA, 14 bp, Unknown
  misc_feature (1)..( 14): Result.006 file - promoters50/5668748
ttcacaaattttgt

SEQ ID NO: 199289 - DNA, 14 bp, Unknown
  misc_feature (1)..( 14): Result.006 file - promoters50/5668748
aattaaacttttaa

SEQ ID NO: 199290 - DNA, 14 bp, Unknown
  misc_feature (1)..( 14): Result.006 file - promoters50/5668748
gtatataattttag

SEQ ID NO: 199291 - DNA, 14 bp, Unknown
  misc_feature (1)..( 14): Result.006 file - promoters50/5668748
catagaaatcaaat

SEQ ID NO: 199292 - DNA, 16 bp, Unknown
  misc_feature (1)..( 16): Result.006 file - promoters50/5668748
ttaaaaaacatgtcgg

SEQ ID NO: 199293 - DNA, 16 bp, Unknown
  misc_feature (1)..( 16): Result.006 file - promoters50/5668748
ttaaaaagctaaaaca

SEQ ID NO: 199294 - DNA, 16 bp, Unknown
  misc_feature (1)..( 16): Result.006 file - promoters50/5668748
acaaaaaatatctcat

SEQ ID NO: 199295 - DNA, 16 bp, Unknown
  misc_feature (1)..( 16): Result.006 file - promoters50/5668748
ctaaacaacatatttc

SEQ ID NO: 199296 - DNA, 16 bp, Unknown
  misc_feature (1)..( 16): Result.006 file - promoters50/5668748
ctaaaccggaagtttg

SEQ ID NO: 199297 - DNA, 16 bp, Unknown
  misc_feature (1)..( 16): Result.006 file - promoters50/5668748
atacaaagaatttctc

SEQ ID NO: 199298 - DNA, 10 bp, Unknown
  misc_feature (1)..( 10): Result.006 file - promoters50/5668748
tttatatacc

SEQ ID NO: 199299 - DNA, 10 bp, Unknown
  misc_feature (1)..( 10): Result.006 file - promoters50/5668748
tatatataaa

SEQ ID NO: 199300 - DNA, 10 bp, Unknown
  misc_feature (1)..( 10): Result.006 file - promoters50/5668748
tatatatatc

SEQ ID NO: 199301 - DNA, 10 bp, Unknown
  misc_feature (1)..( 10): Result.006 file - promoters50/5668748
tctataaata

SEQ ID NO: 199302 - DNA, 10 bp, Unknown
  misc_feature (1)..( 10): Result.006 file - promoters50/5668748
tctataaaaa

SEQ ID NO: 199303 - DNA, 10 bp, Unknown
  misc_feature (1)..( 10): Result.006 file - promoters50/5668748
actataaata

SEQ ID NO: 199304 - DNA, 10 bp, Unknown
  misc_feature (1)..( 10): Result.006 file - promoters50/5668748
aatataaata

SEQ ID NO: 199305 - DNA, 14 bp, Unknown
  misc_feature (1)..( 14): Result.006 file - promoters50/5668748
catttttaatcaaa

SEQ ID NO: 199306 - DNA, 14 bp, Unknown
  misc_feature (1)..( 14): Result.006 file - promoters50/5668748
tatttgtaatcgat

SEQ ID NO: 199307 - DNA, 14 bp, Unknown
  misc_feature (1)..( 14): Result.006 file - promoters50/5668748
cattttcctttatg

SEQ ID NO: 199308 - DNA, 14 bp, Unknown
  misc_feature (1)..( 14): Result.006 file - promoters50/5668748
aattattaaagtat

SEQ ID NO: 199309 - DNA, 14 bp, Unknown
  misc_feature (1)..( 14): Result.006 file - promoters50/5668748
catgagtactcgat

SEQ ID NO: 199310 - DNA, 14 bp, Unknown
  misc_feature (1)..( 14): Result.006 file - promoters50/5668748
gattattctttttc

SEQ ID NO: 199311 - DNA, 21 bp, Unknown
  misc_feature (1)..( 21): Result.006 file - promoters50/5668748
acagtttacttatcattttca

SEQ ID NO: 199312 - DNA, 21 bp, Unknown
  misc_feature (1)..( 21): Result.006 file - promoters50/5668748
acaatttacgtattattttca

SEQ ID NO: 199313 - DNA, 21 bp, Unknown
  misc_feature (1)..( 21): Result.006 file - promoters50/5668748
atttgttacatatacattttg

SEQ ID NO: 199314 - DNA, 21 bp, Unknown
  misc_feature (1)..( 21): Result.006 file - promoters50/5668748
ggaaccatagtattatctagt

SEQ ID NO: 199315 - DNA, 21 bp, Unknown
  misc_feature (1)..( 21): Result.006 file - promoters50/5668748
aaacacagtatataattttag

SEQ ID NO: 199316 - DNA, 22 bp, Unknown
  misc_feature (1)..( 22): Result.006 file - promoters50/5668788
aaaataatcatatgcatttatg

SEQ ID NO: 199317 - DNA, 10 bp, Unknown
  misc_feature (1)..( 10): Result.006 file - promoters50/5668788
agagaaaaat

SEQ ID NO: 199318 - DNA, 10 bp, Unknown
  misc_feature (1)..( 10): Result.006 file - promoters50/5668788
agagcaaaag

SEQ ID NO: 199319 - DNA, 10 bp, Unknown
  misc_feature (1)..( 10): Result.006 file - promoters50/5668797
aacacaaaag

SEQ ID NO: 199320 - DNA, 12 bp, Unknown
  misc_feature (1)..( 12): Result.006 file - promoters50/5668797
ctatatatgagc

SEQ ID NO: 199321 - DNA, 12 bp, Unknown
  misc_feature (1)..( 12): Result.006 file - promoters50/5668797
ttatataatgaa

SEQ ID NO: 199322 - DNA, 12 bp, Unknown
  misc_feature (1)..( 12): Result.006 file - promoters50/5668797
ctatttattagc

SEQ ID NO: 199323 - DNA, 22 bp, Unknown
  misc_feature (1)..( 22): Result.006 file - promoters50/5668797
caaaaaaaaaacaaattgattt

SEQ ID NO: 199324 - DNA, 22 bp, Unknown
  misc_feature (1)..( 22): Result.006 file - promoters50/5668797
caaagaaaaaataaatttattt

SEQ ID NO: 199325 - DNA, 22 bp, Unknown
  misc_feature (1)..( 22): Result.006 file - promoters50/5668800
atttgaaaaaattcacggactc

SEQ ID NO: 199326 - DNA, 9 bp, Unknown
  misc_feature (1)..( 9): Result.006 file - promoters50/5668800
aaacttttt

SEQ ID NO: 199327 - DNA, 9 bp, Unknown
  misc_feature (1)..( 9): Result.006 file - promoters50/5668800
taacatttt

SEQ ID NO: 199328 - DNA, 9 bp, Unknown
  misc_feature (1)..( 9): Result.006 file - promoters50/5668800
taatattca

SEQ ID NO: 199329 - DNA, 11 bp, Unknown
  misc_feature (1)..( 11): Result.006 file - promoters50/5668800
atataaacaaa

SEQ ID NO: 199330 - DNA, 11 bp, Unknown
  misc_feature (1)..( 11): Result.006 file - promoters50/5668800
atataatcaaa

SEQ ID NO: 199331 - DNA, 11 bp, Unknown
  misc_feature (1)..( 11): Result.006 file - promoters50/5668800
aaaaaaataaa

SEQ ID NO: 199332 - DNA, 8 bp, Unknown
  misc_feature (1)..( 8): Result.006 file - promoters50/5668800
gataaaat

SEQ ID NO: 199333 - DNA, 8 bp, Unknown
  misc_feature (1)..( 8): Result.006 file - promoters50/5668800
aataaaat

SEQ ID NO: 199334 - DNA, 8 bp, Unknown
  misc_feature (1)..( 8): Result.006 file - promoters50/5668800
gataaatt

SEQ ID NO: 199335 - DNA, 8 bp, Unknown
  misc_feature (1)..( 8): Result.006 file - promoters50/5668800
gatgaatc

SEQ ID NO: 199336 - DNA, 11 bp, Unknown
  misc_feature (1)..( 11): Result.006 file - promoters50/5668800
tcttattttga

SEQ ID NO: 199337 - DNA, 11 bp, Unknown
  misc_feature (1)..( 11): Result.006 file - promoters50/5668800
tctgattttgt

SEQ ID NO: 199338 - DNA, 11 bp, Unknown
  misc_feature (1)..( 11): Result.006 file - promoters50/5668800
gattcttttga

SEQ ID NO: 199339 - DNA, 22 bp, Unknown
  misc_feature (1)..( 22): Result.006 file - promoters50/5668800
atcacaattaagatgtatctta

SEQ ID NO: 199340 - DNA, 22 bp, Unknown
  misc_feature (1)..( 22): Result.006 file - promoters50/5668800
tcttttctgattttgtttctca

SEQ ID NO: 199341 - DNA, 22 bp, Unknown
  misc_feature (1)..( 22): Result.006 file - promoters50/5668800
tcttttctgatattgtttctca

SEQ ID NO: 199342 - DNA, 6 bp, Unknown
  misc_feature (1)..( 6): Result.006 file - promoters50/5668800
atagga

SEQ ID NO: 199343 - DNA, 6 bp, Unknown
  misc_feature (1)..( 6): Result.006 file - promoters50/5668800
atagga

SEQ ID NO: 199344 - DNA, 6 bp, Unknown
  misc_feature (1)..( 6): Result.006 file - promoters50/5668800
atagga

SEQ ID NO: 199345 - DNA, 8 bp, Unknown
  misc_feature (1)..( 8): Result.006 file - promoters50/5668800
ataaaatt

SEQ ID NO: 199346 - DNA, 8 bp, Unknown
  misc_feature (1)..( 8): Result.006 file - promoters50/5668800
ataatatt

SEQ ID NO: 199347 - DNA, 8 bp, Unknown
  misc_feature (1)..( 8): Result.006 file - promoters50/5668800
ataaaata

SEQ ID NO: 199348 - DNA, 12 bp, Unknown
  misc_feature (1)..( 12): Result.006 file - promoters50/5668800
aaaaattaaaaa

SEQ ID NO: 199349 - DNA, 12 bp, Unknown
  misc_feature (1)..( 12): Result.006 file - promoters50/5668800
aaaaaataaaaa

SEQ ID NO: 199350 - DNA, 12 bp, Unknown
  misc_feature (1)..( 12): Result.006 file - promoters50/5668800
ctcaaataaaat

SEQ ID NO: 199351 - DNA, 7 bp, Unknown
  misc_feature (1)..( 7): Result.006 file - promoters50/5668800
aaatata

SEQ ID NO: 199352 - DNA, 7 bp, Unknown
  misc_feature (1)..( 7): Result.006 file - promoters50/5668800
aaatata

SEQ ID NO: 199353 - DNA, 7 bp, Unknown
  misc_feature (1)..( 7): Result.006 file - promoters50/5668800
aaatata

SEQ ID NO: 199354 - DNA, 10 bp, Unknown
  misc_feature (1)..( 10): Result.006 file - promoters50/5668800
aaaaaataat

SEQ ID NO: 199355 - DNA, 10 bp, Unknown
  misc_feature (1)..( 10): Result.006 file - promoters50/5668800
aaaaaataaa

SEQ ID NO: 199356 - DNA, 12 bp, Unknown
  misc_feature (1)..( 12): Result.006 file - promoters50/5668800
aatcaaatgaaa

SEQ ID NO: 199357 - DNA, 7 bp, Unknown
  misc_feature (1)..( 7): Result.006 file - promoters50/5668800
agttgct

SEQ ID NO: 199358 - DNA, 7 bp, Unknown
  misc_feature (1)..( 7): Result.006 file - promoters50/5668800
agttgct

SEQ ID NO: 199359 - DNA, 7 bp, Unknown
  misc_feature (1)..( 7): Result.006 file - promoters50/5668800
agttgct

SEQ ID NO: 199360 - DNA, 9 bp, Unknown
  misc_feature (1)..( 9): Result.006 file - promoters50/5668800
tacaaatct

SEQ ID NO: 199361 - DNA, 9 bp, Unknown
  misc_feature (1)..( 9): Result.006 file - promoters50/5668800
ctcaaatct

SEQ ID NO: 199362 - DNA, 9 bp, Unknown
  misc_feature (1)..( 9): Result.006 file - promoters50/5668800
ctcaaataa

SEQ ID NO: 199363 - DNA, 8 bp, Unknown
  misc_feature (1)..( 8): Result.006 file - promoters50/5668800
ttttaata

SEQ ID NO: 199364 - DNA, 8 bp, Unknown
  misc_feature (1)..( 8): Result.006 file - promoters50/5668800
tttcaatg

SEQ ID NO: 199365 - DNA, 8 bp, Unknown
  misc_feature (1)..( 8): Result.006 file - promoters50/5668807
attcaatg

SEQ ID NO: 199366 - DNA, 13 bp, Unknown
  misc_feature (1)..( 13): Result.006 file - promoters50/5668807
aataatttaacat

SEQ ID NO: 199367 - DNA, 13 bp, Unknown
  misc_feature (1)..( 13): Result.006 file - promoters50/5668807
tactatttatcat

SEQ ID NO: 199368 - DNA, 13 bp, Unknown
  misc_feature (1)..( 13): Result.006 file - promoters50/5668807
tattatttttttt

SEQ ID NO: 199369 - DNA, 8 bp, Unknown
  misc_feature (1)..( 8): Result.006 file - promoters50/5668807
ctttaaaa

SEQ ID NO: 199370 - DNA, 8 bp, Unknown
  misc_feature (1)..( 8): Result.006 file - promoters50/5668807
cttcaaaa

SEQ ID NO: 199371 - DNA, 8 bp, Unknown
  misc_feature (1)..( 8): Result.006 file - promoters50/5668807
ctttaatg

SEQ ID NO: 199372 - DNA, 8 bp, Unknown
  misc_feature (1)..( 8): Result.006 file - promoters50/5668807
tttcttaa

SEQ ID NO: 199373 - DNA, 8 bp, Unknown
  misc_feature (1)..( 8): Result.006 file - promoters50/5668807
tttgttaa

SEQ ID NO: 199374 - DNA, 8 bp, Unknown
  misc_feature (1)..( 8): Result.006 file - promoters50/5668814
tttcttac

SEQ ID NO: 199375 - DNA, 7 bp, Unknown
  misc_feature (1)..( 7): Result.006 file - promoters50/5668814
aaacttt

SEQ ID NO: 199376 - DNA, 7 bp, Unknown
  misc_feature (1)..( 7): Result.006 file - promoters50/5668814
gaacttt

SEQ ID NO: 199377 - DNA, 7 bp, Unknown
  misc_feature (1)..( 7): Result.006 file - promoters50/5668814
gaactta

SEQ ID NO: 199378 - DNA, 12 bp, Unknown
  misc_feature (1)..( 12): Result.006 file - promoters50/5668814
tattggaaaata

SEQ ID NO: 199379 - DNA, 12 bp, Unknown
  misc_feature (1)..( 12): Result.006 file - promoters50/5668814
ctttggaataat

SEQ ID NO: 199380 - DNA, 12 bp, Unknown
  misc_feature (1)..( 12): Result.006 file - promoters50/5668818
tataggaagata

SEQ ID NO: 199381 - DNA, 11 bp, Unknown
  misc_feature (1)..( 11): Result.006 file - promoters50/5668818
ttaaggattaa

SEQ ID NO: 199382 - DNA, 11 bp, Unknown
  misc_feature (1)..( 11): Result.006 file - promoters50/5668818
ttaagtattat

SEQ ID NO: 199383 - DNA, 11 bp, Unknown
  misc_feature (1)..( 11): Result.006 file - promoters50/5668818
ttctagattaa

SEQ ID NO: 199384 - DNA, 11 bp, Unknown
  misc_feature (1)..( 11): Result.006 file - promoters50/5668818
ctaaagatttt

SEQ ID NO: 199385 - DNA, 11 bp, Unknown
  misc_feature (1)..( 11): Result.006 file - promoters50/5668818
ataactattta

SEQ ID NO: 199386 - DNA, 12 bp, Unknown
  misc_feature (1)..( 12): Result.006 file - promoters50/5668818
taccctaattaa

SEQ ID NO: 199387 - DNA, 12 bp, Unknown
  misc_feature (1)..( 12): Result.006 file - promoters50/5668818
aacactaaagac

SEQ ID NO: 199388 - DNA, 12 bp, Unknown
  misc_feature (1)..( 12): Result.006 file - promoters50/5668818
aattaaacaaag

SEQ ID NO: 199389 - DNA, 12 bp, Unknown
  misc_feature (1)..( 12): Result.006 file - promoters50/5668818
atttaaacgtaa

SEQ ID NO: 199390 - DNA, 12 bp, Unknown
  misc_feature (1)..( 12): Result.006 file - promoters50/5668818
aatcaaaaaaag

SEQ ID NO: 199391 - DNA, 12 bp, Unknown
  misc_feature (1)..( 12): Result.006 file - promoters50/5668818
aataaaatatgt

SEQ ID NO: 199392 - DNA, 12 bp, Unknown
  misc_feature (1)..( 12): Result.006 file - promoters50/5668818
aataaaaaaaaa

SEQ ID NO: 199393 - DNA, 12 bp, Unknown
  misc_feature (1)..( 12): Result.006 file - promoters50/5668818
gttaaaaattgt

SEQ ID NO: 199394 - DNA, 10 bp, Unknown
  misc_feature (1)..( 10): Result.006 file - promoters50/5668818
taatatttaa

SEQ ID NO: 199395 - DNA, 10 bp, Unknown
  misc_feature (1)..( 10): Result.006 file - promoters50/5668818
caatattttt

SEQ ID NO: 199396 - DNA, 10 bp, Unknown
  misc_feature (1)..( 10): Result.006 file - promoters50/5668818
aattattttc

SEQ ID NO: 199397 - DNA, 10 bp, Unknown
  misc_feature (1)..( 10): Result.006 file - promoters50/5668818
caaaattact

SEQ ID NO: 199398 - DNA, 10 bp, Unknown
  misc_feature (1)..( 10): Result.006 file - promoters50/5668818
ttttatttca

SEQ ID NO: 199399 - DNA, 10 bp, Unknown
  misc_feature (1)..( 10): Result.006 file - promoters50/5668818
aaacataaaa

SEQ ID NO: 199400 - DNA, 9 bp, Unknown
  misc_feature (1)..( 9): Result.006 file - promoters50/5668818
tatttatca

SEQ ID NO: 199401 - DNA, 9 bp, Unknown
  misc_feature (1)..( 9): Result.006 file - promoters50/5668818
tatttaaaa

SEQ ID NO: 199402 - DNA, 9 bp, Unknown
  misc_feature (1)..( 9): Result.006 file - promoters50/5668818
aatttaata

SEQ ID NO: 199403 - DNA, 9 bp, Unknown
  misc_feature (1)..( 9): Result.006 file - promoters50/5668818
attttcata

SEQ ID NO: 199404 - DNA, 9 bp, Unknown
  misc_feature (1)..( 9): Result.006 file - promoters50/5668818
gattaaaaa

SEQ ID NO: 199405 - DNA, 9 bp, Unknown
  misc_feature (1)..( 9): Result.006 file - promoters50/5668828
cttttcagt

SEQ ID NO: 199406 - DNA, 9 bp, Unknown
  misc_feature (1)..( 9): Result.006 file - promoters50/5668828
tatcttttt

SEQ ID NO: 199407 - DNA, 9 bp, Unknown
  misc_feature (1)..( 9): Result.006 file - promoters50/5668828
ctccttttt

SEQ ID NO: 199408 - DNA, 9 bp, Unknown
  misc_feature (1)..( 9): Result.006 file - promoters50/5668828
tccctttca

SEQ ID NO: 199409 - DNA, 8 bp, Unknown
  misc_feature (1)..( 8): Result.006 file - promoters50/5668828
taatatat

SEQ ID NO: 199410 - DNA, 8 bp, Unknown
  misc_feature (1)..( 8): Result.006 file - promoters50/5668828
gaatctat

SEQ ID NO: 199411 - DNA, 8 bp, Unknown
  misc_feature (1)..( 8): Result.006 file - promoters50/5668828
gaatctag

SEQ ID NO: 199412 - DNA, 9 bp, Unknown
  misc_feature (1)..( 9): Result.006 file - promoters50/5668828
tcttgaatc

SEQ ID NO: 199413 - DNA, 9 bp, Unknown
  misc_feature (1)..( 9): Result.006 file - promoters50/5668828
tcttgatcc

SEQ ID NO: 199414 - DNA, 9 bp, Unknown
  misc_feature (1)..( 9): Result.006 file - promoters50/5668832
tcttggatc

SEQ ID NO: 199415 - DNA, 7 bp, Unknown
  misc_feature (1)..( 7): Result.006 file - promoters50/5668832
attataa

SEQ ID NO: 199416 - DNA, 7 bp, Unknown
  misc_feature (1)..( 7): Result.006 file - promoters50/5668832
attttaa

SEQ ID NO: 199417 - DNA, 7 bp, Unknown
  misc_feature (1)..( 7): Result.006 file - promoters50/5668832
tttttaa

SEQ ID NO: 199418 - DNA, 7 bp, Unknown
  misc_feature (1)..( 7): Result.006 file - promoters50/5668832
attttat

SEQ ID NO: 199419 - DNA, 8 bp, Unknown
  misc_feature (1)..( 8): Result.006 file - promoters50/5668832
ttttactt

SEQ ID NO: 199420 - DNA, 8 bp, Unknown
  misc_feature (1)..( 8): Result.006 file - promoters50/5668832
ttttgctt

SEQ ID NO: 199421 - DNA, 8 bp, Unknown
  misc_feature (1)..( 8): Result.006 file - promoters50/5668832
ttttcttt

SEQ ID NO: 199422 - DNA, 10 bp, Unknown
  misc_feature (1)..( 10): Result.006 file - promoters50/5668832
atttagacca

SEQ ID NO: 199423 - DNA, 10 bp, Unknown
  misc_feature (1)..( 10): Result.006 file - promoters50/5668832
tcgtagacca

SEQ ID NO: 199424 - DNA, 10 bp, Unknown
  misc_feature (1)..( 10): Result.006 file - promoters50/5668832
attttgacaa

SEQ ID NO: 199425 - DNA, 11 bp, Unknown
  misc_feature (1)..( 11): Result.006 file - promoters50/5668832
ttcgtttttcc

SEQ ID NO: 199426 - DNA, 11 bp, Unknown
  misc_feature (1)..( 11): Result.006 file - promoters50/5668832
ttcgttttttt

SEQ ID NO: 199427 - DNA, 11 bp, Unknown
  misc_feature (1)..( 11): Result.006 file - promoters50/5668832
acattttatcc

SEQ ID NO: 199428 - DNA, 12 bp, Unknown
  misc_feature (1)..( 12): Result.006 file - promoters50/5668832
tttaagtttttt

SEQ ID NO: 199429 - DNA, 12 bp, Unknown
  misc_feature (1)..( 12): Result.006 file - promoters50/5668832
attagatttttt

SEQ ID NO: 199430 - DNA, 12 bp, Unknown
  misc_feature (1)..( 12): Result.006 file - promoters50/5668832
attcgatctttt

SEQ ID NO: 199431 - DNA, 12 bp, Unknown
  misc_feature (1)..( 12): Result.006 file - promoters50/5668832
taaaaatcaaga

SEQ ID NO: 199432 - DNA, 12 bp, Unknown
  misc_feature (1)..( 12): Result.006 file - promoters50/5668832
taaaaactaaaa

SEQ ID NO: 199433 - DNA, 12 bp, Unknown
  misc_feature (1)..( 12): Result.006 file - promoters50/5668832
taataatcctta

SEQ ID NO: 199434 - DNA, 12 bp, Unknown
  misc_feature (1)..( 12): Result.006 file - promoters50/5668832
tcataatcctta

SEQ ID NO: 199435 - DNA, 6 bp, Unknown
  misc_feature (1)..( 6): Result.006 file - promoters50/5668832
attaga

SEQ ID NO: 199436 - DNA, 6 bp, Unknown
  misc_feature (1)..( 6): Result.006 file - promoters50/5668832
attaga

SEQ ID NO: 199437 - DNA, 6 bp, Unknown
  misc_feature (1)..( 6): Result.006 file - promoters50/5668832
attaga

SEQ ID NO: 199438 - DNA, 9 bp, Unknown
  misc_feature (1)..( 9): Result.006 file - promoters50/5668832
ttaaaaaaa

SEQ ID NO: 199439 - DNA, 9 bp, Unknown
  misc_feature (1)..( 9): Result.006 file - promoters50/5668832
ttataaaat

SEQ ID NO: 199440 - DNA, 9 bp, Unknown
  misc_feature (1)..( 9): Result.006 file - promoters50/5668832
ctaaactcc

SEQ ID NO: 199441 - DNA, 9 bp, Unknown
  misc_feature (1)..( 9): Result.006 file - promoters50/5668832
tttcaaaat

SEQ ID NO: 199442 - DNA, 9 bp, Unknown
  misc_feature (1)..( 9): Result.006 file - promoters50/5668832
tttgaaact

SEQ ID NO: 199443 - DNA, 9 bp, Unknown
  misc_feature (1)..( 9): Result.006 file - promoters50/5668832
ttttaaact

SEQ ID NO: 199444 - DNA, 7 bp, Unknown
  misc_feature (1)..( 7): Result.006 file - promoters50/5668832
aaatcaa

SEQ ID NO: 199445 - DNA, 7 bp, Unknown
  misc_feature (1)..( 7): Result.006 file - promoters50/5668832
aaaacaa

SEQ ID NO: 199446 - DNA, 7 bp, Unknown
  misc_feature (1)..( 7): Result.006 file - promoters50/5668832
aaaacaa

SEQ ID NO: 199447 - DNA, 8 bp, Unknown
  misc_feature (1)..( 8): Result.006 file - promoters50/5668832
acattttc

SEQ ID NO: 199448 - DNA, 8 bp, Unknown
  misc_feature (1)..( 8): Result.006 file - promoters50/5668832
tcattttg

SEQ ID NO: 199449 - DNA, 8 bp, Unknown
  misc_feature (1)..( 8): Result.006 file - promoters50/5668832
tcacttta

SEQ ID NO: 199450 - DNA, 8 bp, Unknown
  misc_feature (1)..( 8): Result.006 file - promoters50/5668836
ctattttg

SEQ ID NO: 199451 - DNA, 9 bp, Unknown
  misc_feature (1)..( 9): Result.006 file - promoters50/5668836
aaatttaag

SEQ ID NO: 199452 - DNA, 9 bp, Unknown
  misc_feature (1)..( 9): Result.006 file - promoters50/5668836
aaatttaag

SEQ ID NO: 199453 - DNA, 9 bp, Unknown
  misc_feature (1)..( 9): Result.006 file - promoters50/5668836
aaatttatt

SEQ ID NO: 199454 - DNA, 7 bp, Unknown
  misc_feature (1)..( 7): Result.006 file - promoters50/5668836
gttttat

SEQ ID NO: 199455 - DNA, 7 bp, Unknown
  misc_feature (1)..( 7): Result.006 file - promoters50/5668836
attttat

SEQ ID NO: 199456 - DNA, 7 bp, Unknown
  misc_feature (1)..( 7): Result.006 file - promoters50/5668836
attttaa

SEQ ID NO: 199457 - DNA, 9 bp, Unknown
  misc_feature (1)..( 9): Result.006 file - promoters50/5668836
aaaattaaa

SEQ ID NO: 199458 - DNA, 9 bp, Unknown
  misc_feature (1)..( 9): Result.006 file - promoters50/5668836
aaaaataag

SEQ ID NO: 199459 - DNA, 9 bp, Unknown
  misc_feature (1)..( 9): Result.006 file - promoters50/5668836
tcgattaaa

SEQ ID NO: 199460 - DNA, 7 bp, Unknown
  misc_feature (1)..( 7): Result.006 file - promoters50/5668836
aaattaa

SEQ ID NO: 199461 - DNA, 7 bp, Unknown
  misc_feature (1)..( 7): Result.006 file - promoters50/5668836
aaactaa

SEQ ID NO: 199462 - DNA, 7 bp, Unknown
  misc_feature (1)..( 7): Result.006 file - promoters50/5668836
gaattaa

SEQ ID NO: 199463 - DNA, 9 bp, Unknown
  misc_feature (1)..( 9): Result.006 file - promoters50/5668836
aaggaacaa

SEQ ID NO: 199464 - DNA, 9 bp, Unknown
  misc_feature (1)..( 9): Result.006 file - promoters50/5668836
aagtaacca

SEQ ID NO: 199465 - DNA, 9 bp, Unknown
  misc_feature (1)..( 9): Result.006 file - promoters50/5668836
gagtagcca

SEQ ID NO: 199466 - DNA, 9 bp, Unknown
  misc_feature (1)..( 9): Result.006 file - promoters50/5668836
taaaatgcc

SEQ ID NO: 199467 - DNA, 9 bp, Unknown
  misc_feature (1)..( 9): Result.006 file - promoters50/5668836
taaaataag

SEQ ID NO: 199468 - DNA, 9 bp, Unknown
  misc_feature (1)..( 9): Result.006 file - promoters50/5668836
aaaactaag

SEQ ID NO: 199469 - DNA, 12 bp, Unknown
  misc_feature (1)..( 12): Result.006 file - promoters50/5668836
aaacatgtaaca

SEQ ID NO: 199470 - DNA, 12 bp, Unknown
  misc_feature (1)..( 12): Result.006 file - promoters50/5668836
aaacatttttta

SEQ ID NO: 199471 - DNA, 12 bp, Unknown
  misc_feature (1)..( 12): Result.006 file - promoters50/5668836
aaacacaataca

SEQ ID NO: 199472 - DNA, 11 bp, Unknown
  misc_feature (1)..( 11): Result.006 file - promoters50/5668836
taataatttaa

SEQ ID NO: 199473 - DNA, 11 bp, Unknown
  misc_feature (1)..( 11): Result.006 file - promoters50/5668836
taaaaatttta

SEQ ID NO: 199474 - DNA, 11 bp, Unknown
  misc_feature (1)..( 11): Result.006 file - promoters50/5668852
atataatttaa

SEQ ID NO: 199475 - DNA, 9 bp, Unknown
  misc_feature (1)..( 9): Result.006 file - promoters50/5668852
ccaaaaatg

SEQ ID NO: 199476 - DNA, 9 bp, Unknown
  misc_feature (1)..( 9): Result.006 file - promoters50/5668852
aataaaatg

SEQ ID NO: 199477 - DNA, 9 bp, Unknown
  misc_feature (1)..( 9): Result.006 file - promoters50/5668852
aatagaata

SEQ ID NO: 199478 - DNA, 14 bp, Unknown
  misc_feature (1)..( 14): Result.006 file - promoters50/5668852
aataagggaacaat

SEQ ID NO: 199479 - DNA, 14 bp, Unknown
  misc_feature (1)..( 14): Result.006 file - promoters50/5668852
aataaaggaaaaat

SEQ ID NO: 199480 - DNA, 14 bp, Unknown
  misc_feature (1)..( 14): Result.006 file - promoters50/5668860
aataaaatgtgggc

SEQ ID NO: 199481 - DNA, 8 bp, Unknown
  misc_feature (1)..( 8): Result.006 file - promoters50/5668860
catcgatt

SEQ ID NO: 199482 - DNA, 8 bp, Unknown
  misc_feature (1)..( 8): Result.006 file - promoters50/5668860
catagatt

SEQ ID NO: 199483 - DNA, 8 bp, Unknown
  misc_feature (1)..( 8): Result.006 file - promoters50/5668860
gatccatt

SEQ ID NO: 199484 - DNA, 7 bp, Unknown
  misc_feature (1)..( 7): Result.006 file - promoters50/5668860
ttaaatt

SEQ ID NO: 199485 - DNA, 7 bp, Unknown
  misc_feature (1)..( 7): Result.006 file - promoters50/5668860
ctaaatt

SEQ ID NO: 199486 - DNA, 7 bp, Unknown
  misc_feature (1)..( 7): Result.006 file - promoters50/5668860
ctaaata

SEQ ID NO: 199487 - DNA, 6 bp, Unknown
  misc_feature (1)..( 6): Result.006 file - promoters50/5668860
aaaaaa

SEQ ID NO: 199488 - DNA, 6 bp, Unknown
  misc_feature (1)..( 6): Result.006 file - promoters50/5668860
aaaaaa

SEQ ID NO: 199489 - DNA, 6 bp, Unknown
  misc_feature (1)..( 6): Result.006 file - promoters50/5668872
aaaaag

SEQ ID NO: 199490 - DNA, 8 bp, Unknown
  misc_feature (1)..( 8): Result.006 file - promoters50/5668872
ttttagtt

SEQ ID NO: 199491 - DNA, 8 bp, Unknown
  misc_feature (1)..( 8): Result.006 file - promoters50/5668872
gtttggtt

SEQ ID NO: 199492 - DNA, 8 bp, Unknown
  misc_feature (1)..( 8): Result.006 file - promoters50/5668872
ttttagaa

SEQ ID NO: 199493 - DNA, 8 bp, Unknown
  misc_feature (1)..( 8): Result.006 file - promoters50/5668872
gtttggtc

SEQ ID NO: 199494 - DNA, 8 bp, Unknown
  misc_feature (1)..( 8): Result.006 file - promoters50/5668872
tttcagac

SEQ ID NO: 199495 - DNA, 9 bp, Unknown
  misc_feature (1)..( 9): Result.006 file - promoters50/5668872
ctaacaaaa

SEQ ID NO: 199496 - DNA, 9 bp, Unknown
  misc_feature (1)..( 9): Result.006 file - promoters50/5668872
ttaacaact

SEQ ID NO: 199497 - DNA, 9 bp, Unknown
  misc_feature (1)..( 9): Result.006 file - promoters50/5668872
ctaagaaat

SEQ ID NO: 199498 - DNA, 9 bp, Unknown
  misc_feature (1)..( 9): Result.006 file - promoters50/5668872
agaagaaat

SEQ ID NO: 199499 - DNA, 9 bp, Unknown
  misc_feature (1)..( 9): Result.006 file - promoters50/5668882
tgaagaaga

SEQ ID NO: 199500 - DNA, 15 bp, Unknown
  misc_feature (1)..( 15): Result.006 file - promoters50/5668882
ttaacaagaaataaa

SEQ ID NO: 199501 - DNA, 15 bp, Unknown
  misc_feature (1)..( 15): Result.006 file - promoters50/5668882
tctataagaaaacat

SEQ ID NO: 199502 - DNA, 15 bp, Unknown
  misc_feature (1)..( 15): Result.006 file - promoters50/5668882
agtaaaagaaagaaa

SEQ ID NO: 199503 - DNA, 15 bp, Unknown
  misc_feature (1)..( 15): Result.006 file - promoters50/5668882
ttagcaaaaaaaata

SEQ ID NO: 199504 - DNA, 15 bp, Unknown
  misc_feature (1)..( 15): Result.006 file - promoters50/5668882
atcatatgaaattat

SEQ ID NO: 199505 - DNA, 15 bp, Unknown
  misc_feature (1)..( 15): Result.006 file - promoters50/5668882
taaatatgaatcgta

SEQ ID NO: 199506 - DNA, 15 bp, Unknown
  misc_feature (1)..( 15): Result.006 file - promoters50/5668882
cccagaaaaaaacta

SEQ ID NO: 199507 - DNA, 14 bp, Unknown
  misc_feature (1)..( 14): Result.006 file - promoters50/5668882
ccatgtttatgcct

SEQ ID NO: 199508 - DNA, 14 bp, Unknown
  misc_feature (1)..( 14): Result.006 file - promoters50/5668882
gtccttttctgcct

SEQ ID NO: 199509 - DNA, 14 bp, Unknown
  misc_feature (1)..( 14): Result.006 file - promoters50/5668882
tcttttttctcatt

SEQ ID NO: 199510 - DNA, 14 bp, Unknown
  misc_feature (1)..( 14): Result.006 file - promoters50/5668882
tagattttctttat

SEQ ID NO: 199511 - DNA, 14 bp, Unknown
  misc_feature (1)..( 14): Result.006 file - promoters50/5668882
tagatattcatatt

SEQ ID NO: 199512 - DNA, 14 bp, Unknown
  misc_feature (1)..( 14): Result.006 file - promoters50/5668893
taatttttctttgc

SEQ ID NO: 199513 - DNA, 12 bp, Unknown
  misc_feature (1)..( 12): Result.006 file - promoters50/5668893
aatcgtttaatt

SEQ ID NO: 199514 - DNA, 12 bp, Unknown
  misc_feature (1)..( 12): Result.006 file - promoters50/5668893
tagtctttaatc

SEQ ID NO: 199515 - DNA, 12 bp, Unknown
  misc_feature (1)..( 12): Result.006 file - promoters50/5668893
aatggttttatt

SEQ ID NO: 199516 - DNA, 8 bp, Unknown
  misc_feature (1)..( 8): Result.006 file - promoters50/5668893
tgttttct

SEQ ID NO: 199517 - DNA, 8 bp, Unknown
  misc_feature (1)..( 8): Result.006 file - promoters50/5668893
ccttttct

SEQ ID NO: 199518 - DNA, 8 bp, Unknown
  misc_feature (1)..( 8): Result.006 file - promoters50/5668903
ttttttca

SEQ ID NO: 199519 - DNA, 13 bp, Unknown
  misc_feature (1)..( 13): Result.006 file - promoters50/5668903
agactttaatttg

SEQ ID NO: 199520 - DNA, 13 bp, Unknown
  misc_feature (1)..( 13): Result.006 file - promoters50/5668903
tgattttcatttg

SEQ ID NO: 199521 - DNA, 13 bp, Unknown
  misc_feature (1)..( 13): Result.006 file - promoters50/5668903
tttgtttgattgt

SEQ ID NO: 199522 - DNA, 13 bp, Unknown
  misc_feature (1)..( 13): Result.006 file - promoters50/5668903
tttgtatgattat

SEQ ID NO: 199523 - DNA, 8 bp, Unknown
  misc_feature (1)..( 8): Result.006 file - promoters50/5668903
agacttta

SEQ ID NO: 199524 - DNA, 8 bp, Unknown
  misc_feature (1)..( 8): Result.006 file - promoters50/5668903
agaatttg

SEQ ID NO: 199525 - DNA, 8 bp, Unknown
  misc_feature (1)..( 8): Result.006 file - promoters50/5668903
cgaatttg

SEQ ID NO: 199526 - DNA, 11 bp, Unknown
  misc_feature (1)..( 11): Result.006 file - promoters50/5668903
ttttactagtc

SEQ ID NO: 199527 - DNA, 11 bp, Unknown
  misc_feature (1)..( 11): Result.006 file - promoters50/5668903
ttttattagtc

SEQ ID NO: 199528 - DNA, 11 bp, Unknown
  misc_feature (1)..( 11): Result.006 file - promoters50/5668903
gtttattataa

SEQ ID NO: 199529 - DNA, 11 bp, Unknown
  misc_feature (1)..( 11): Result.006 file - promoters50/5668903
tttgtatacca

SEQ ID NO: 199530 - DNA, 11 bp, Unknown
  misc_feature (1)..( 11): Result.006 file - promoters50/5668903
tttgtatgatt

SEQ ID NO: 199531 - DNA, 11 bp, Unknown
  misc_feature (1)..( 11): Result.006 file - promoters50/5668919
tttgtttgatt

SEQ ID NO: 199532 - DNA, 7 bp, Unknown
  misc_feature (1)..( 7): Result.006 file - promoters50/5668919
taaattt

SEQ ID NO: 199533 - DNA, 7 bp, Unknown
  misc_feature (1)..( 7): Result.006 file - promoters50/5668919
taaattg

SEQ ID NO: 199534 - DNA, 7 bp, Unknown
  misc_feature (1)..( 7): Result.006 file - promoters50/5668930
caaattg

SEQ ID NO: 199535 - DNA, 7 bp, Unknown
  misc_feature (1)..( 7): Result.006 file - promoters50/5668930
cgagaac

SEQ ID NO: 199536 - DNA, 7 bp, Unknown
  misc_feature (1)..( 7): Result.006 file - promoters50/5668930
cgagaaa

SEQ ID NO: 199537 - DNA, 7 bp, Unknown
  misc_feature (1)..( 7): Result.006 file - promoters50/5668930
ggagaaa

SEQ ID NO: 199538 - DNA, 10 bp, Unknown
  misc_feature (1)..( 10): Result.006 file - promoters50/5668930
taaagtttcc

SEQ ID NO: 199539 - DNA, 10 bp, Unknown
  misc_feature (1)..( 10): Result.006 file - promoters50/5668930
taaattttct

SEQ ID NO: 199540 - DNA, 7 bp, Unknown
  misc_feature (1)..( 7): Result.006 file - promoters50/5668930
attctct

SEQ ID NO: 199541 - DNA, 8 bp, Unknown
  misc_feature (1)..( 8): Result.006 file - promoters50/5668930
cagatcaa

SEQ ID NO: 199542 - DNA, 8 bp, Unknown
  misc_feature (1)..( 8): Result.006 file - promoters50/5668930
aagaccaa

SEQ ID NO: 199543 - DNA, 8 bp, Unknown
  misc_feature (1)..( 8): Result.006 file - promoters50/5668930
cagatctc

SEQ ID NO: 199544 - DNA, 9 bp, Unknown
  misc_feature (1)..( 9): Result.006 file - promoters50/5668930
ccatctcac

SEQ ID NO: 199545 - DNA, 9 bp, Unknown
  misc_feature (1)..( 9): Result.006 file - promoters50/5668930
ctatctcac

SEQ ID NO: 199546 - DNA, 9 bp, Unknown
  misc_feature (1)..( 9): Result.006 file - promoters50/5668930
ctatctctt

SEQ ID NO: 199547 - DNA, 7 bp, Unknown
  misc_feature (1)..( 7): Result.006 file - promoters50/5668930
aacaaat

SEQ ID NO: 199548 - DNA, 7 bp, Unknown
  misc_feature (1)..( 7): Result.006 file - promoters50/5668930
aaccaat

SEQ ID NO: 199549 - DNA, 7 bp, Unknown
  misc_feature (1)..( 7): Result.006 file - promoters50/5668951
aaccaaa

SEQ ID NO: 199550 - DNA, 8 bp, Unknown
  misc_feature (1)..( 8): Result.006 file - promoters50/5668951
ttttaatt

SEQ ID NO: 199551 - DNA, 8 bp, Unknown
  misc_feature (1)..( 8): Result.006 file - promoters50/5668951
tttcaatt

SEQ ID NO: 199552 - DNA, 8 bp, Unknown
  misc_feature (1)..( 8): Result.006 file - promoters50/5668951
attcaatg

SEQ ID NO: 199553 - DNA, 8 bp, Unknown
  misc_feature (1)..( 8): Result.006 file - promoters50/5668951
attcaact

SEQ ID NO: 199554 - DNA, 8 bp, Unknown
  misc_feature (1)..( 8): Result.006 file - promoters50/5668951
taaaccaa

SEQ ID NO: 199555 - DNA, 8 bp, Unknown
  misc_feature (1)..( 8): Result.006 file - promoters50/5668951
caaaacaa

SEQ ID NO: 199556 - DNA, 8 bp, Unknown
  misc_feature (1)..( 8): Result.006 file - promoters50/5668951
caaaccaa

SEQ ID NO: 199557 - DNA, 8 bp, Unknown
  misc_feature (1)..( 8): Result.006 file - promoters50/5668951
aaaaacaa

SEQ ID NO: 199558 - DNA, 8 bp, Unknown
  misc_feature (1)..( 8): Result.006 file - promoters50/5668951
gttatctc

SEQ ID NO: 199559 - DNA, 8 bp, Unknown
  misc_feature (1)..( 8): Result.006 file - promoters50/5668951
cttatcta

SEQ ID NO: 199560 - DNA, 8 bp, Unknown
  misc_feature (1)..( 8): Result.006 file - promoters50/5668951
cttttctt

SEQ ID NO: 199561 - DNA, 8 bp, Unknown
  misc_feature (1)..( 8): Result.006 file - promoters50/5668974
ttttcctt

SEQ ID NO: 199562 - DNA, 10 bp, Unknown
  misc_feature (1)..( 10): Result.006 file - promoters50/5668974
taaattaaac

SEQ ID NO: 199563 - DNA, 10 bp, Unknown
  misc_feature (1)..( 10): Result.006 file - promoters50/5668974
caaactaaac

SEQ ID NO: 199564 - DNA, 10 bp, Unknown
  misc_feature (1)..( 10): Result.006 file - promoters50/5668974
gcaattaaaa

SEQ ID NO: 199565 - DNA, 10 bp, Unknown
  misc_feature (1)..( 10): Result.006 file - promoters50/5668974
ttaattaatt

SEQ ID NO: 199566 - DNA, 10 bp, Unknown
  misc_feature (1)..( 10): Result.006 file - promoters50/5668974
taaataaaaa

SEQ ID NO: 199567 - DNA, 10 bp, Unknown
  misc_feature (1)..( 10): Result.006 file - promoters50/5669002
ccaatgaaac

SEQ ID NO: 199568 - DNA, 10 bp, Unknown
  misc_feature (1)..( 10): Result.006 file - promoters50/5669002
tcaaaaacca

SEQ ID NO: 199569 - DNA, 10 bp, Unknown
  misc_feature (1)..( 10): Result.006 file - promoters50/5669002
gttaaaacca

SEQ ID NO: 199570 - DNA, 11 bp, Unknown
  misc_feature (1)..( 11): Result.006 file - promoters50/5669013
atcaataacag

SEQ ID NO: 199571 - DNA, 11 bp, Unknown
  misc_feature (1)..( 11): Result.006 file - promoters50/5669013
aaaatctttca

SEQ ID NO: 199572 - DNA, 11 bp, Unknown
  misc_feature (1)..( 11): Result.006 file - promoters50/5669013
aaattctctac

SEQ ID NO: 199573 - DNA, 11 bp, Unknown
  misc_feature (1)..( 11): Result.006 file - promoters50/5669013
taaatattttt

SEQ ID NO: 199574 - DNA, 11 bp, Unknown
  misc_feature (1)..( 11): Result.006 file - promoters50/5669013
tcaatatttta

SEQ ID NO: 199575 - DNA, 11 bp, Unknown
  misc_feature (1)..( 11): Result.006 file - promoters50/5669025
tgaatatgtta

SEQ ID NO: 199576 - DNA, 11 bp, Unknown
  misc_feature (1)..( 11): Result.006 file - promoters50/5669025
atgttttgttt

SEQ ID NO: 199577 - DNA, 11 bp, Unknown
  misc_feature (1)..( 11): Result.006 file - promoters50/5669025
gacttttgttc

SEQ ID NO: 199578 - DNA, 11 bp, Unknown
  misc_feature (1)..( 11): Result.006 file - promoters50/5669025
aggttatgtta

SEQ ID NO: 199579 - DNA, 11 bp, Unknown
  misc_feature (1)..( 11): Result.006 file - promoters50/5669025
accctatatta

SEQ ID NO: 199580 - DNA, 11 bp, Unknown
  misc_feature (1)..( 11): Result.006 file - promoters50/5669025
aggatatgtgg

SEQ ID NO: 199581 - DNA, 11 bp, Unknown
  misc_feature (1)..( 11): Result.006 file - promoters50/5669025
aagttatgcgc

SEQ ID NO: 199582 - DNA, 15 bp, Unknown
  misc_feature (1)..( 15): Result.006 file - promoters50/5669025
cttgttttaattttc

SEQ ID NO: 199583 - DNA, 15 bp, Unknown
  misc_feature (1)..( 15): Result.006 file - promoters50/5669025
cgttttttaaaagga

SEQ ID NO: 199584 - DNA, 15 bp, Unknown
  misc_feature (1)..( 15): Result.006 file - promoters50/5669025
cgttttttagttttc

SEQ ID NO: 199585 - DNA, 16 bp, Unknown
  misc_feature (1)..( 16): Result.006 file - promoters50/5669025
tggtttttcaaagaag

SEQ ID NO: 199586 - DNA, 16 bp, Unknown
  misc_feature (1)..( 16): Result.006 file - promoters50/5669025
cgcttttccagtgtgt

SEQ ID NO: 199587 - DNA, 16 bp, Unknown
  misc_feature (1)..( 16): Result.006 file - promoters50/5669236
tagtttaggttaacta

SEQ ID NO: 199588 - DNA, 7 bp, Unknown
  misc_feature (1)..( 7): Result.006 file - promoters50/5669236
taaaaat

SEQ ID NO: 199589 - DNA, 7 bp, Unknown
  misc_feature (1)..( 7): Result.006 file - promoters50/5669236
gaaaaat

SEQ ID NO: 199590 - DNA, 7 bp, Unknown
  misc_feature (1)..( 7): Result.006 file - promoters50/5669236
gaaaaag

SEQ ID NO: 199591 - DNA, 9 bp, Unknown
  misc_feature (1)..( 9): Result.006 file - promoters50/5669236
aattttaaa

SEQ ID NO: 199592 - DNA, 9 bp, Unknown
  misc_feature (1)..( 9): Result.006 file - promoters50/5669236
aattataaa

SEQ ID NO: 199593 - DNA, 9 bp, Unknown
  misc_feature (1)..( 9): Result.006 file - promoters50/5669243
tgctttaaa

SEQ ID NO: 199594 - DNA, 8 bp, Unknown
  misc_feature (1)..( 8): Result.006 file - promoters50/5669243
taacttgt

SEQ ID NO: 199595 - DNA, 8 bp, Unknown
  misc_feature (1)..( 8): Result.006 file - promoters50/5669243
taacttga

SEQ ID NO: 199596 - DNA, 8 bp, Unknown
  misc_feature (1)..( 8): Result.006 file - promoters50/5669243
tcacttgt

SEQ ID NO: 199597 - DNA, 9 bp, Unknown
  misc_feature (1)..( 9): Result.006 file - promoters50/5669243
gcatgagtt

SEQ ID NO: 199598 - DNA, 9 bp, Unknown
  misc_feature (1)..( 9): Result.006 file - promoters50/5669243
gcaagagta

SEQ ID NO: 199599 - DNA, 9 bp, Unknown
  misc_feature (1)..( 9): Result.006 file - promoters50/5669243
agatgtgtt

SEQ ID NO: 199600 - DNA, 13 bp, Unknown
  misc_feature (1)..( 13): Result.006 file - promoters50/5669243
tttgcaaataagg

SEQ ID NO: 199601 - DNA, 13 bp, Unknown
  misc_feature (1)..( 13): Result.006 file - promoters50/5669243
ttttcaattcaga

SEQ ID NO: 199602 - DNA, 13 bp, Unknown
  misc_feature (1)..( 13): Result.006 file - promoters50/5669243
tttggaaaagaaa

SEQ ID NO: 199603 - DNA, 13 bp, Unknown
  misc_feature (1)..( 13): Result.006 file - promoters50/5669243
aagggaaatgaaa

SEQ ID NO: 199604 - DNA, 11 bp, Unknown
  misc_feature (1)..( 11): Result.006 file - promoters50/5669243
tttgcaaataa

SEQ ID NO: 199605 - DNA, 11 bp, Unknown
  misc_feature (1)..( 11): Result.006 file - promoters50/5669243
aaagaaaataa

SEQ ID NO: 199606 - DNA, 11 bp, Unknown
  misc_feature (1)..( 11): Result.006 file - promoters50/5669243
aaatgaaatat

SEQ ID NO: 199607 - DNA, 11 bp, Unknown
  misc_feature (1)..( 11): Result.006 file - promoters50/5669243
aatatattttc

SEQ ID NO: 199608 - DNA, 11 bp, Unknown
  misc_feature (1)..( 11): Result.006 file - promoters50/5669243
aatttatgttc

SEQ ID NO: 199609 - DNA, 11 bp, Unknown
  misc_feature (1)..( 11): Result.006 file - promoters50/5669243
gtgatatgttg

SEQ ID NO: 199610 - DNA, 8 bp, Unknown
  misc_feature (1)..( 8): Result.006 file - promoters50/5669243
ggttttgt

SEQ ID NO: 199611 - DNA, 8 bp, Unknown
  misc_feature (1)..( 8): Result.006 file - promoters50/5669243
ggtgttgg

SEQ ID NO: 199612 - DNA, 8 bp, Unknown
  misc_feature (1)..( 8): Result.006 file - promoters50/5669243
ctcgttgt

SEQ ID NO: 199613 - DNA, 10 bp, Unknown
  misc_feature (1)..( 10): Result.006 file - promoters50/5669243
ctaaattggg

SEQ ID NO: 199614 - DNA, 10 bp, Unknown
  misc_feature (1)..( 10): Result.006 file - promoters50/5669243
tgtaatcggg

SEQ ID NO: 199615 - DNA, 10 bp, Unknown
  misc_feature (1)..( 10): Result.006 file - promoters50/5669250
tgtgatcgaa

SEQ ID NO: 199616 - DNA, 10 bp, Unknown
  misc_feature (1)..( 10): Result.006 file - promoters50/5669250
ggtgataata

SEQ ID NO: 199617 - DNA, 10 bp, Unknown
  misc_feature (1)..( 10): Result.006 file - promoters50/5669250
taaaataata

SEQ ID NO: 199618 - DNA, 10 bp, Unknown
  misc_feature (1)..( 10): Result.006 file - promoters50/5669250
gaaaaaaatt

SEQ ID NO: 199619 - DNA, 10 bp, Unknown
  misc_feature (1)..( 10): Result.006 file - promoters50/5669250
ttaaataaat

SEQ ID NO: 199620 - DNA, 10 bp, Unknown
  misc_feature (1)..( 10): Result.006 file - promoters50/5669250
taaattaatt

SEQ ID NO: 199621 - DNA, 10 bp, Unknown
  misc_feature (1)..( 10): Result.006 file - promoters50/5669250
cagaataaaa

SEQ ID NO: 199622 - DNA, 15 bp, Unknown
  misc_feature (1)..( 15): Result.006 file - promoters50/5669250
taatcaatttataat

SEQ ID NO: 199623 - DNA, 15 bp, Unknown
  misc_feature (1)..( 15): Result.006 file - promoters50/5669250
agtacaaattacaat

SEQ ID NO: 199624 - DNA, 15 bp, Unknown
  misc_feature (1)..( 15): Result.006 file - promoters50/5669250
gtatttatttatatt

SEQ ID NO: 199625 - DNA, 15 bp, Unknown
  misc_feature (1)..( 15): Result.006 file - promoters50/5669250
taataaatttgtgaa

SEQ ID NO: 199626 - DNA, 15 bp, Unknown
  misc_feature (1)..( 15): Result.006 file - promoters50/5669250
gaagcaaattctaac

SEQ ID NO: 199627 - DNA, 15 bp, Unknown
  misc_feature (1)..( 15): Result.006 file - promoters50/5669508
cttcaaaattatatc

SEQ ID NO: 199628 - DNA, 11 bp, Unknown
  misc_feature (1)..( 11): Result.006 file - promoters50/5669508
tttcaaaaata

SEQ ID NO: 199629 - DNA, 11 bp, Unknown
  misc_feature (1)..( 11): Result.006 file - promoters50/5669508
aaacaaaaaga

SEQ ID NO: 199630 - DNA, 11 bp, Unknown
  misc_feature (1)..( 11): Result.006 file - promoters50/5669508
agtcaaaagtg

SEQ ID NO: 199631 - DNA, 11 bp, Unknown
  misc_feature (1)..( 11): Result.006 file - promoters50/5669508
atgtaaaaatt

SEQ ID NO: 199632 - DNA, 11 bp, Unknown
  misc_feature (1)..( 11): Result.006 file - promoters50/5669508
aaacaaaacta

SEQ ID NO: 199633 - DNA, 11 bp, Unknown
  misc_feature (1)..( 11): Result.006 file - promoters50/5669546
aattaataatt

SEQ ID NO: 199634 - DNA, 9 bp, Unknown
  misc_feature (1)..( 9): Result.006 file - promoters50/5669546
ccatacctc

SEQ ID NO: 199635 - DNA, 9 bp, Unknown
  misc_feature (1)..( 9): Result.006 file - promoters50/5669546
tgatatctc

SEQ ID NO: 199636 - DNA, 9 bp, Unknown
  misc_feature (1)..( 9): Result.006 file - promoters50/5669546
tgatgtctt

SEQ ID NO: 199637 - DNA, 9 bp, Unknown
  misc_feature (1)..( 9): Result.006 file - promoters50/5669546
atatgtctc

SEQ ID NO: 199638 - DNA, 8 bp, Unknown
  misc_feature (1)..( 8): Result.006 file - promoters50/5669546
cgacatgt

SEQ ID NO: 199639 - DNA, 8 bp, Unknown
  misc_feature (1)..( 8): Result.006 file - promoters50/5669546
cgacatgt

SEQ ID NO: 199640 - DNA, 8 bp, Unknown
  misc_feature (1)..( 8): Result.006 file - promoters50/5669546
acacatgt

SEQ ID NO: 199641 - DNA, 8 bp, Unknown
  misc_feature (1)..( 8): Result.006 file - promoters50/5669724
cgacatta

SEQ ID NO: 199642 - DNA, 13 bp, Unknown
  misc_feature (1)..( 13): Result.006 file - promoters50/5669724
gaatttactgaaa

SEQ ID NO: 199643 - DNA, 13 bp, Unknown
  misc_feature (1)..( 13): Result.006 file - promoters50/5669724
gccattattgatc

SEQ ID NO: 199644 - DNA, 13 bp, Unknown
  misc_feature (1)..( 13): Result.006 file - promoters50/5669724
ttaatttttgtat

SEQ ID NO: 199645 - DNA, 13 bp, Unknown
  misc_feature (1)..( 13): Result.006 file - promoters50/5669724
taaatgtttcaaa

SEQ ID NO: 199646 - DNA, 13 bp, Unknown
  misc_feature (1)..( 13): Result.006 file - promoters50/5669724
taaatctttgttc

SEQ ID NO: 199647 - DNA, 13 bp, Unknown
  misc_feature (1)..( 13): Result.006 file - promoters50/5669724
attgtgtttgaaa

SEQ ID NO: 199648 - DNA, 13 bp, Unknown
  misc_feature (1)..( 13): Result.006 file - promoters50/5669838
aatttaattctat

SEQ ID NO: 199649 - DNA, 8 bp, Unknown
  misc_feature (1)..( 8): Result.006 file - promoters50/5669838
ttatttca

SEQ ID NO: 199650 - DNA, 8 bp, Unknown
  misc_feature (1)..( 8): Result.006 file - promoters50/5669838
ttatttcc

SEQ ID NO: 199651 - DNA, 8 bp, Unknown
  misc_feature (1)..( 8): Result.006 file - promoters50/5669838
agatttca

SEQ ID NO: 199652 - DNA, 7 bp, Unknown
  misc_feature (1)..( 7): Result.006 file - promoters50/5669838
tttttct

SEQ ID NO: 199653 - DNA, 7 bp, Unknown
  misc_feature (1)..( 7): Result.006 file - promoters50/5669838
tttttct

SEQ ID NO: 199654 - DNA, 7 bp, Unknown
  misc_feature (1)..( 7): Result.006 file - promoters50/5670300
gttttct

SEQ ID NO: 199655 - DNA, 8 bp, Unknown
  misc_feature (1)..( 8): Result.006 file - promoters50/5670300
ttcttgcc

SEQ ID NO: 199656 - DNA, 8 bp, Unknown
  misc_feature (1)..( 8): Result.006 file - promoters50/5670300
ttctggcc

SEQ ID NO: 199657 - DNA, 8 bp, Unknown
  misc_feature (1)..( 8): Result.006 file - promoters50/5670300
gtcttgcg

SEQ ID NO: 199658 - DNA, 31 bp, Unknown; identical to SEQ ID NO: 72331
  misc_feature (1)..( 31): Result.006 file - promoters50/5670300

SEQ ID NO: 199659 - DNA, 31 bp, Unknown; identical to SEQ ID NO: 186078
  misc_feature (1)..( 31): Result.006 file - promoters50/5670300

SEQ ID NO: 199660 - DNA, 31 bp, Unknown; identical to SEQ ID NO: 186077
  misc_feature (1)..( 31): Result.006 file - promoters50/5670300

SEQ ID NO: 199661 - DNA, 30 bp, Unknown; identical to SEQ ID NO: 71939
  misc_feature (1)..( 30): Result.006 file - promoters50/5670300

SEQ ID NO: 199662 - DNA, 30 bp, Unknown; identical to SEQ ID NO: 184369
  misc_feature (1)..( 30): Result.006 file - promoters50/5670300

SEQ ID NO: 199663 - DNA, 30 bp, Unknown; identical to SEQ ID NO: 184367
  misc_feature (1)..( 30): Result.006 file - promoters50/5670300

SEQ ID NO: 199664 - DNA, 15 bp, Unknown
  misc_feature (1)..( 15): Result.006 file - promoters50/5670300
cgccttagctttctc

SEQ ID NO: 199665 - DNA, 15 bp, Unknown
  misc_feature (1)..( 15): Result.006 file - promoters50/5670300
cgccttagctttctc

SEQ ID NO: 199666 - DNA, 15 bp, Unknown
  misc_feature (1)..( 15): Result.006 file - promoters50/5670300
cgccttagctttctc

SEQ ID NO: 199667 - DNA, 22 bp, Unknown
  misc_feature (1)..( 22): Result.006 file - promoters50/5670300
gaccgagtcgtcctcgtctttt

SEQ ID NO: 199668 - DNA, 22 bp, Unknown
  misc_feature (1)..( 22): Result.006 file - promoters50/5670300
gaccgactcgtcctcgtctttt

SEQ ID NO: 199669 - DNA, 22 bp, Unknown
  misc_feature (1)..( 22): Result.006 file - promoters50/5670300
gacctagtcgtcctcgtctttt

SEQ ID NO: 199670 - DNA, 19 bp, Unknown
  misc_feature (1)..( 19): Result.006 file - promoters50/5670300
ttttgcttctataaatcaa

SEQ ID NO: 199671 - DNA, 19 bp, Unknown
  misc_feature (1)..( 19): Result.006 file - promoters50/5670300
ttcttcttctataaaacaa

SEQ ID NO: 199672 - DNA, 19 bp, Unknown
  misc_feature (1)..( 19): Result.006 file - promoters50/5670300
gatctttgccggaaaacaa

SEQ ID NO: 199673 - DNA, 19 bp, Unknown
  misc_feature (1)..( 19): Result.006 file - promoters50/5670300
ttcttcttctataaattaa

SEQ ID NO: 199674 - DNA, 9 bp, Unknown
  misc_feature (1)..( 9): Result.006 file - promoters50/5670300
caataaaac

SEQ ID NO: 199675 - DNA, 9 bp, Unknown
  misc_feature (1)..( 9): Result.006 file - promoters50/5670300
caaaaaaaa

SEQ ID NO: 199676 - DNA, 9 bp, Unknown
  misc_feature (1)..( 9): Result.006 file - promoters50/5670300
gaaaacaac

SEQ ID NO: 199677 - DNA, 6 bp, Unknown
  misc_feature (1)..( 6): Result.006 file - promoters50/5670300
aaaaca

SEQ ID NO: 199678 - DNA, 6 bp, Unknown
  misc_feature (1)..( 6): Result.006 file - promoters50/5670300
aaaaca

SEQ ID NO: 199679 - DNA, 6 bp, Unknown
  misc_feature (1)..( 6): Result.006 file - promoters50/5670546
aaaaca

SEQ ID NO: 199680 - DNA, 7 bp, Unknown
  misc_feature (1)..( 7): Result.006 file - promoters50/5670546
tgttcag

SEQ ID NO: 199681 - DNA, 7 bp, Unknown
  misc_feature (1)..( 7): Result.006 file - promoters50/5670546
tgttcaa

SEQ ID NO: 199682 - DNA, 7 bp, Unknown
  misc_feature (1)..( 7): Result.006 file - promoters50/5670553
ggttcaa

SEQ ID NO: 199683 - DNA, 8 bp, Unknown
  misc_feature (1)..( 8): Result.006 file - promoters50/5670553
atgaacac

SEQ ID NO: 199684 - DNA, 8 bp, Unknown
  misc_feature (1)..( 8): Result.006 file - promoters50/5670553
atgaacaa

SEQ ID NO: 199685 - DNA, 8 bp, Unknown
  misc_feature (1)..( 8): Result.006 file - promoters50/5670553
atgtacaa

SEQ ID NO: 199686 - DNA, 8 bp, Unknown
  misc_feature (1)..( 8): Result.006 file - promoters50/5670553
cggtacaa

SEQ ID NO: 199687 - DNA, 10 bp, Unknown
  misc_feature (1)..( 10): Result.006 file - promoters50/5670553
atcaacacca

SEQ ID NO: 199688 - DNA, 10 bp, Unknown
  misc_feature (1)..( 10): Result.006 file - promoters50/5670553
aaaaacccca

SEQ ID NO: 199689 - DNA, 10 bp, Unknown
  misc_feature (1)..( 10): Result.006 file - promoters50/5670592
aaaaacccaa

SEQ ID NO: 199690 - DNA, 11 bp, Unknown
  misc_feature (1)..( 11): Result.006 file - promoters50/5670592
aatagagaact

SEQ ID NO: 199691 - DNA, 11 bp, Unknown
  misc_feature (1)..( 11): Result.006 file - promoters50/5670592
aatagtgaaat

SEQ ID NO: 199692 - DNA, 11 bp, Unknown
  misc_feature (1)..( 11): Result.006 file - promoters50/5670592
tatacagactt

SEQ ID NO: 199693 - DNA, 11 bp, Unknown
  misc_feature (1)..( 11): Result.006 file - promoters50/5670592
aatacaaactt

SEQ ID NO: 199694 - DNA, 11 bp, Unknown
  misc_feature (1)..( 11): Result.006 file - promoters50/5670592
tataaaaacac

SEQ ID NO: 199695 - DNA, 11 bp, Unknown
  misc_feature (1)..( 11): Result.006 file - promoters50/5670592
ctaccaaactg

SEQ ID NO: 199696 - DNA, 11 bp, Unknown
  misc_feature (1)..( 11): Result.006 file - promoters50/5670680
actgaaaacaa

SEQ ID NO: 199697 - DNA, 8 bp, Unknown
  misc_feature (1)..( 8): Result.006 file - promoters50/5670680
atatgatt

SEQ ID NO: 199698 - DNA, 8 bp, Unknown
  misc_feature (1)..( 8): Result.006 file - promoters50/5670680
ataagata

SEQ ID NO: 199699 - DNA, 8 bp, Unknown
  misc_feature (1)..( 8): Result.006 file - promoters50/5670784
ataatata

SEQ ID NO: 199700 - DNA, 8 bp, Unknown
  misc_feature (1)..( 8): Result.006 file - promoters50/5670784
atttattt

SEQ ID NO: 199701 - DNA, 8 bp, Unknown
  misc_feature (1)..( 8): Result.006 file - promoters50/5670784
attttttt

SEQ ID NO: 199702 - DNA, 8 bp, Unknown
  misc_feature (1)..( 8): Result.006 file - promoters50/5670784
aataatta

SEQ ID NO: 199703 - DNA, 8 bp, Unknown
  misc_feature (1)..( 8): Result.006 file - promoters50/5670784
gtttattc

SEQ ID NO: 199704 - DNA, 10 bp, Unknown
  misc_feature (1)..( 10): Result.006 file - promoters50/5670784
tgaaggatat

SEQ ID NO: 199705 - DNA, 10 bp, Unknown
  misc_feature (1)..( 10): Result.006 file - promoters50/5670784
tgaatgatat

SEQ ID NO: 199706 - DNA, 10 bp, Unknown
  misc_feature (1)..( 10): Result.006 file - promoters50/5670784
aaaattatat

SEQ ID NO: 199707 - DNA, 11 bp, Unknown
  misc_feature (1)..( 11): Result.006 file - promoters50/5670784
caaatgcatgt

SEQ ID NO: 199708 - DNA, 9 bp, Unknown
  misc_feature (1)..( 9): Result.006 file - promoters50/5670784
tttgaaaag

SEQ ID NO: 199709 - DNA, 9 bp, Unknown
  misc_feature (1)..( 9): Result.006 file - promoters50/5670784
ttttaaaaa

SEQ ID NO: 199710 - DNA, 9 bp, Unknown
  misc_feature (1)..( 9): Result.006 file - promoters50/5671204
gaataaaaa

SEQ ID NO: 199711 - DNA, 8 bp, Unknown
  misc_feature (1)..( 8): Result.006 file - promoters50/5671204
tatcaaaa

SEQ ID NO: 199712 - DNA, 8 bp, Unknown
  misc_feature (1)..( 8): Result.006 file - promoters50/5671204
aatcaaat

SEQ ID NO: 199713 - DNA, 8 bp, Unknown
  misc_feature (1)..( 8): Result.006 file - promoters50/5671204
tataaaaa

SEQ ID NO: 199714 - DNA, 8 bp, Unknown
  misc_feature (1)..( 8): Result.006 file - promoters50/5671204
tgtcaaat

SEQ ID NO: 199715 - DNA, 8 bp, Unknown
  misc_feature (1)..( 8): Result.006 file - promoters50/5671204
tgttaaac

SEQ ID NO: 199716 - DNA, 8 bp, Unknown
  misc_feature (1)..( 8): Result.006 file - promoters50/5671262
aataaaaa

SEQ ID NO: 199717 - DNA, 9 bp, Unknown
  misc_feature (1)..( 9): Result.006 file - promoters50/5671262
gaaagctct

SEQ ID NO: 199718 - DNA, 9 bp, Unknown
  misc_feature (1)..( 9): Result.006 file - promoters50/5671262
taaagctaa

SEQ ID NO: 199719 - DNA, 9 bp, Unknown
  misc_feature (1)..( 9): Result.006 file - promoters50/5671262
aaaacctct

SEQ ID NO: 199720 - DNA, 9 bp, Unknown
  misc_feature (1)..( 9): Result.006 file - promoters50/5671262
taaaccttg

SEQ ID NO: 199721 - DNA, 9 bp, Unknown
  misc_feature (1)..( 9): Result.006 file - promoters50/5671262
tgaaccttc

SEQ ID NO: 199722 - DNA, 9 bp, Unknown
  misc_feature (1)..( 9): Result.006 file - promoters50/5671318
tgaatcttg

SEQ ID NO: 199723 - DNA, 16 bp, Unknown
  misc_feature (1)..( 16): Result.006 file - promoters50/5671318
ataaacattgttatta

SEQ ID NO: 199724 - DNA, 16 bp, Unknown
  misc_feature (1)..( 16): Result.006 file - promoters50/5671318
ctacgtattattattc

SEQ ID NO: 199725 - DNA, 16 bp, Unknown
  misc_feature (1)..( 16): Result.006 file - promoters50/5671318
cttaaatttgttctta

SEQ ID NO: 199726 - DNA, 16 bp, Unknown
  misc_feature (1)..( 16): Result.006 file - promoters50/5671318
ctacgtataatttaat

SEQ ID NO: 199727 - DNA, 16 bp, Unknown
  misc_feature (1)..( 16): Result.006 file - promoters50/5671318
tgacggataattccgg

SEQ ID NO: 199728 - DNA, 16 bp, Unknown
  misc_feature (1)..( 16): Result.006 file - promoters50/5671318
gaaagtaatatgtata

SEQ ID NO: 199729 - DNA, 15 bp, Unknown
  misc_feature (1)..( 15): Result.006 file - promoters50/5671318
ttctgcatattttgt

SEQ ID NO: 199730 - DNA, 15 bp, Unknown
  misc_feature (1)..( 15): Result.006 file - promoters50/5671318
ctacgtataatttaa

SEQ ID NO: 199731 - DNA, 15 bp, Unknown
  misc_feature (1)..( 15): Result.006 file - promoters50/5671318
ctacgtattattatt

SEQ ID NO: 199732 - DNA, 15 bp, Unknown
  misc_feature (1)..( 15): Result.006 file - promoters50/5671318
tgacggataattccg

SEQ ID NO: 199733 - DNA, 15 bp, Unknown
  misc_feature (1)..( 15): Result.006 file - promoters50/5671318
gaaagtaatatgtat

SEQ ID NO: 199734 - DNA, 15 bp, Unknown
  misc_feature (1)..( 15): Result.006 file - promoters50/5671338
tcttcttaaatttgt

SEQ ID NO: 199735 - DNA, 8 bp, Unknown
  misc_feature (1)..( 8): Result.006 file - promoters50/5671338
attttgga

SEQ ID NO: 199736 - DNA, 8 bp, Unknown
  misc_feature (1)..( 8): Result.006 file - promoters50/5671338
attttggt

SEQ ID NO: 199737 - DNA, 8 bp, Unknown
  misc_feature (1)..( 8): Result.006 file - promoters50/5671338
ttttcggt

SEQ ID NO: 199738 - DNA, 10 bp, Unknown
  misc_feature (1)..( 10): Result.006 file - promoters50/5671338
gtaaatgtca

SEQ ID NO: 199739 - DNA, 10 bp, Unknown
  misc_feature (1)..( 10): Result.006 file - promoters50/5671338
gtaaatgtaa

SEQ ID NO: 199740 - DNA, 10 bp, Unknown
  misc_feature (1)..( 10): Result.006 file - promoters50/5671338
caaaatttaa

SEQ ID NO: 199741 - DNA, 7 bp, Unknown
  misc_feature (1)..( 7): Result.006 file - promoters50/5671338
gttaaaa

SEQ ID NO: 199742 - DNA, 7 bp, Unknown
  misc_feature (1)..( 7): Result.006 file - promoters50/5671338
tttaaaa

SEQ ID NO: 199743 - DNA, 7 bp, Unknown
  misc_feature (1)..( 7): Result.006 file - promoters50/5671338
gttaaat

SEQ ID NO: 199744 - DNA, 9 bp, Unknown
  misc_feature (1)..( 9): Result.006 file - promoters50/5671338
tgaaacttt

SEQ ID NO: 199745 - DNA, 9 bp, Unknown
  misc_feature (1)..( 9): Result.006 file - promoters50/5671338
tgaaatttt

SEQ ID NO: 199746 - DNA, 9 bp, Unknown
  misc_feature (1)..( 9): Result.006 file - promoters50/5671338
tttaatttt

SEQ ID NO: 199747 - DNA, 10 bp, Unknown
  misc_feature (1)..( 10): Result.006 file - promoters50/5671338
tttaatgaat

SEQ ID NO: 199748 - DNA, 10 bp, Unknown
  misc_feature (1)..( 10): Result.006 file - promoters50/5671338
tttaatgaat

SEQ ID NO: 199749 - DNA, 10 bp, Unknown
  misc_feature (1)..( 10): Result.006 file - promoters50/5671338
tttaattttt

SEQ ID NO: 199750 - DNA, 10 bp, Unknown
  misc_feature (1)..( 10): Result.006 file - promoters50/5671338
aatgatattt

SEQ ID NO: 199751 - DNA, 10 bp, Unknown
  misc_feature (1)..( 10): Result.006 file - promoters50/5671338
tttgattttt

SEQ ID NO: 199752 - DNA, 10 bp, Unknown
  misc_feature (1)..( 10): Result.006 file - promoters50/5671338
tttaattttt

SEQ ID NO: 199753 - DNA, 9 bp, Unknown
  misc_feature (1)..( 9): Result.006 file - promoters50/5671338
aataattct

SEQ ID NO: 199754 - DNA, 9 bp, Unknown
  misc_feature (1)..( 9): Result.006 file - promoters50/5671338
aattattgg

SEQ ID NO: 199755 - DNA, 9 bp, Unknown
  misc_feature (1)..( 9): Result.006 file - promoters50/5671338
attaattct

SEQ ID NO: 199756 - DNA, 8 bp, Unknown
  misc_feature (1)..( 8): Result.006 file - promoters50/5671338
caaaatgt

SEQ ID NO: 199757 - DNA, 8 bp, Unknown
  misc_feature (1)..( 8): Result.006 file - promoters50/5671338
caaaatta

SEQ ID NO: 199758 - DNA, 8 bp, Unknown
  misc_feature (1)..( 8): Result.006 file - promoters50/5671710
caacatta

SEQ ID NO: 199759 - DNA, 8 bp, Unknown
  misc_feature (1)..( 8): Result.006 file - promoters50/5671710
tatgattt

SEQ ID NO: 199760 - DNA, 8 bp, Unknown
  misc_feature (1)..( 8): Result.006 file - promoters50/5671710
gatgcttt

SEQ ID NO: 199761 - DNA, 8 bp, Unknown
  misc_feature (1)..( 8): Result.006 file - promoters50/5671710
gattcttt

SEQ ID NO: 199762 - DNA, 8 bp, Unknown
  misc_feature (1)..( 8): Result.006 file - promoters50/5671710
tcttcttt

SEQ ID NO: 199763 - DNA, 8 bp, Unknown
  misc_feature (1)..( 8): Result.006 file - promoters50/5671710
gattcttt

SEQ ID NO: 199764 - DNA, 8 bp, Unknown
  misc_feature (1)..( 8): Result.006 file - promoters50/5671840
tattctta

SEQ ID NO: 199765 - DNA, 7 bp, Unknown
  misc_feature (1)..( 7): Result.006 file - promoters50/5671840
tatatct

SEQ ID NO: 199766 - DNA, 7 bp, Unknown
  misc_feature (1)..( 7): Result.006 file - promoters50/5671840
tatgtct

SEQ ID NO: 199767 - DNA, 7 bp, Unknown
  misc_feature (1)..( 7): Result.006 file - promoters50/5671840
gatgtct

SEQ ID NO: 199768 - DNA, 12 bp, Unknown
  misc_feature (1)..( 12): Result.006 file - promoters50/5671840
aataaatagttc

SEQ ID NO: 199769 - DNA, 12 bp, Unknown
  misc_feature (1)..( 12): Result.006 file - promoters50/5671840
aataaaatcatt

SEQ ID NO: 199770 - DNA, 12 bp, Unknown
  misc_feature (1)..( 12): Result.006 file - promoters50/5671840
cataaaattaaa

SEQ ID NO: 199771 - DNA, 9 bp, Unknown
  misc_feature (1)..( 9): Result.006 file - promoters50/5671840
aatttttgg

SEQ ID NO: 199772 - DNA, 9 bp, Unknown
  misc_feature (1)..( 9): Result.006 file - promoters50/5671840
tgtttttgt

SEQ ID NO: 199773 - DNA, 9 bp, Unknown
  misc_feature (1)..( 9): Result.006 file - promoters50/5671852
tgttgttgt

SEQ ID NO: 199774 - DNA, 8 bp, Unknown
  misc_feature (1)..( 8): Result.006 file - promoters50/5671852
ttcttgcc

SEQ ID NO: 199775 - DNA, 8 bp, Unknown
  misc_feature (1)..( 8): Result.006 file - promoters50/5671852
ttctggcc

SEQ ID NO: 199776 - DNA, 8 bp, Unknown
  misc_feature (1)..( 8): Result.006 file - promoters50/5671955
gtcttgcg

SEQ ID NO: 199777 - DNA, 9 bp, Unknown
  misc_feature (1)..( 9): Result.006 file - promoters50/5671955
taattttac

SEQ ID NO: 199778 - DNA, 9 bp, Unknown
  misc_feature (1)..( 9): Result.006 file - promoters50/5671955
gaatattac

SEQ ID NO: 199779 - DNA, 9 bp, Unknown
  misc_feature (1)..( 9): Result.006 file - promoters50/5671955
taatttact

SEQ ID NO: 199780 - DNA, 9 bp, Unknown
  misc_feature (1)..( 9): Result.006 file - promoters50/5671955
caaataaaa

SEQ ID NO: 199781 - DNA, 9 bp, Unknown
  misc_feature (1)..( 9): Result.006 file - promoters50/5671955
caattaaaa

SEQ ID NO: 199782 - DNA, 10 bp, Unknown
  misc_feature (1)..( 10): Result.006 file - promoters50/5672281
atattagaaa

SEQ ID NO: 199783 - DNA, 12 bp, Unknown
  misc_feature (1)..( 12): Result.006 file - promoters50/5672281
gatggaaatgtg

SEQ ID NO: 199784 - DNA, 12 bp, Unknown
  misc_feature (1)..( 12): Result.006 file - promoters50/5672281
gttttaaaagtg

SEQ ID NO: 199785 - DNA, 12 bp, Unknown
  misc_feature (1)..( 12): Result.006 file - promoters50/5672281
ttttcaaagcaa

SEQ ID NO: 199786 - DNA, 12 bp, Unknown
  misc_feature (1)..( 12): Result.006 file - promoters50/5672661
gtttcaacaaaa

SEQ ID NO: 199787 - DNA, 6 bp, Unknown
  misc_feature (1)..( 6): Result.006 file - promoters50/5672661
catctc

SEQ ID NO: 199788 - DNA, 6 bp, Unknown
  misc_feature (1)..( 6): Result.006 file - promoters50/5672661
catctc

SEQ ID NO: 199789 - DNA, 6 bp, Unknown
  misc_feature (1)..( 6): Result.006 file - promoters50/5672792
catctc

SEQ ID NO: 199790 - DNA, 7 bp, Unknown
  misc_feature (1)..( 7): Result.006 file - promoters50/5672792
aatgtcg

SEQ ID NO: 199791 - DNA, 7 bp, Unknown
  misc_feature (1)..( 7): Result.006 file - promoters50/5672792
aatgtct

SEQ ID NO: 199792 - DNA, 7 bp, Unknown
  misc_feature (1)..( 7): Result.006 file - promoters50/5672792
aatttcg

SEQ ID NO: 199793 - DNA, 10 bp, Unknown
  misc_feature (1)..( 10): Result.006 file - promoters50/5672792
tcgattttga

SEQ ID NO: 199794 - DNA, 10 bp, Unknown
  misc_feature (1)..( 10): Result.006 file - promoters50/5672792
tgtattttgt

SEQ ID NO: 199795 - DNA, 10 bp, Unknown
  misc_feature (1)..( 10): Result.006 file - promoters50/5672792
tgtcttttgt

SEQ ID NO: 199796 - DNA, 12 bp, Unknown
  misc_feature (1)..( 12): Result.006 file - promoters50/5672792
ttatatctgtat

SEQ ID NO: 199797 - DNA, 12 bp, Unknown
  misc_feature (1)..( 12): Result.006 file - promoters50/5672792
ttagatcgtacc

SEQ ID NO: 199798 - DNA, 12 bp, Unknown
  misc_feature (1)..( 12): Result.006 file - promoters50/5672792
gaatatgtgtat

SEQ ID NO: 199799 - DNA, 12 bp, Unknown
  misc_feature (1)..( 12): Result.006 file - promoters50/5672792
atgaacttgtct

SEQ ID NO: 199800 - DNA, 12 bp, Unknown
  misc_feature (1)..( 12): Result.006 file - promoters50/5672792
acgtgtttgtct

SEQ ID NO: 199801 - DNA, 12 bp, Unknown
  misc_feature (1)..( 12): Result.006 file - promoters50/5672842
tgtattttgtgt

SEQ ID NO: 199802 - DNA, 13 bp, Unknown
  misc_feature (1)..( 13): Result.006 file - promoters50/5672842
gggcctaatgaat

SEQ ID NO: 199803 - DNA, 13 bp, Unknown
  misc_feature (1)..( 13): Result.006 file - promoters50/5672842
aggcccaatacga

SEQ ID NO: 199804 - DNA, 13 bp, Unknown
  misc_feature (1)..( 13): Result.006 file - promoters50/5672842
aagcccaataaat

SEQ ID NO: 199805 - DNA, 13 bp, Unknown
  misc_feature (1)..( 13): Result.006 file - promoters50/5672842
gtaactagtgacg

SEQ ID NO: 199806 - DNA, 13 bp, Unknown
  misc_feature (1)..( 13): Result.006 file - promoters50/5672842
aggcccaatttca

SEQ ID NO: 199807 - DNA, 13 bp, Unknown
  misc_feature (1)..( 13): Result.006 file - promoters50/5672842
gagcccatataaa

SEQ ID NO: 199808 - DNA, 12 bp, Unknown
  misc_feature (1)..( 12): Result.006 file - promoters50/5672842
aaaaagaaaaaa

SEQ ID NO: 199809 - DNA, 12 bp, Unknown
  misc_feature (1)..( 12): Result.006 file - promoters50/5672842
ttaaagaactaa

SEQ ID NO: 199810 - DNA, 12 bp, Unknown
  misc_feature (1)..( 12): Result.006 file - promoters50/5672842
aaaaataaaaaa

SEQ ID NO: 199811 - DNA, 12 bp, Unknown
  misc_feature (1)..( 12): Result.006 file - promoters50/5672842
tttaacaaatgg

SEQ ID NO: 199812 - DNA, 12 bp, Unknown
  misc_feature (1)..( 12): Result.006 file - promoters50/5672842
caaaagaaacga

SEQ ID NO: 199813 - DNA, 12 bp, Unknown
  misc_feature (1)..( 12): Result.006 file - promoters50/5672842
tgaatcaaatac

SEQ ID NO: 199814 - DNA, 10 bp, Unknown
  misc_feature (1)..( 10): Result.006 file - promoters50/5672842
gaatttgtgt

SEQ ID NO: 199815 - DNA, 10 bp, Unknown
  misc_feature (1)..( 10): Result.006 file - promoters50/5672842
aaatatgtca

SEQ ID NO: 199816 - DNA, 10 bp, Unknown
  misc_feature (1)..( 10): Result.006 file - promoters50/5672842
taatttgttt

SEQ ID NO: 199817 - DNA, 10 bp, Unknown
  misc_feature (1)..( 10): Result.006 file - promoters50/5672842
taatttgtct

SEQ ID NO: 199818 - DNA, 10 bp, Unknown
  misc_feature (1)..( 10): Result.006 file - promoters50/5672842
ctttttatct

SEQ ID NO: 199819 - DNA, 10 bp, Unknown
  misc_feature (1)..( 10): Result.006 file - promoters50/5672842
taacttgcaa

SEQ ID NO: 199820 - DNA, 12 bp, Unknown
  misc_feature (1)..( 12): Result.006 file - promoters50/5672842
aaaaaaaacttt

SEQ ID NO: 199821 - DNA, 12 bp, Unknown
  misc_feature (1)..( 12): Result.006 file - promoters50/5672842
atcaaatacttt

SEQ ID NO: 199822 - DNA, 13 bp, Unknown
  misc_feature (1)..( 13): Result.006 file - promoters50/5672842
caaaagaaacgaa

SEQ ID NO: 199823 - DNA, 13 bp, Unknown
  misc_feature (1)..( 13): Result.006 file - promoters50/5672842
aaaataaaaaaga

SEQ ID NO: 199824 - DNA, 13 bp, Unknown
  misc_feature (1)..( 13): Result.006 file - promoters50/5672842
tatttaacaaatg

SEQ ID NO: 199825 - DNA, 13 bp, Unknown
  misc_feature (1)..( 13): Result.006 file - promoters50/5672842
ttaaagaactaat

SEQ ID NO: 199826 - DNA, 13 bp, Unknown
  misc_feature (1)..( 13): Result.006 file - promoters50/5672842
tctaaattacttt

SEQ ID NO: 199827 - DNA, 12 bp, Unknown
  misc_feature (1)..( 12): Result.006 file - promoters50/5672842
gaaaaaaaaaaa

SEQ ID NO: 199828 - DNA, 12 bp, Unknown
  misc_feature (1)..( 12): Result.006 file - promoters50/5672842
caaaagaaacga

SEQ ID NO: 199829 - DNA, 12 bp, Unknown
  misc_feature (1)..( 12): Result.006 file - promoters50/5672842
aaaaataaaaaa

SEQ ID NO: 199830 - DNA, 12 bp, Unknown
  misc_feature (1)..( 12): Result.006 file - promoters50/5672842
tttaacaaatgg

SEQ ID NO: 199831 - DNA, 12 bp, Unknown
  misc_feature (1)..( 12): Result.006 file - promoters50/5672842
ttaaagaactaa

SEQ ID NO: 199832 - DNA, 12 bp, Unknown
  misc_feature (1)..( 12): Result.006 file - promoters50/5672842
tgaatcaaatac

SEQ ID NO: 199833 - DNA, 11 bp, Unknown
  misc_feature (1)..( 11): Result.006 file - promoters50/5672842
acaagaaaaaa

SEQ ID NO: 199834 - DNA, 11 bp, Unknown
  misc_feature (1)..( 11): Result.006 file - promoters50/5672842
acacgaaaaag

SEQ ID NO: 199835 - DNA, 11 bp, Unknown
  misc_feature (1)..( 11): Result.006 file - promoters50/5672842
acaagaagagc

SEQ ID NO: 199836 - DNA, 11 bp, Unknown
  misc_feature (1)..( 11): Result.006 file - promoters50/5672842
ccgagaaaaat

SEQ ID NO: 199837 - DNA, 11 bp, Unknown
  misc_feature (1)..( 11): Result.006 file - promoters50/5672842
atgagaaaata

SEQ ID NO: 199838 - DNA, 11 bp, Unknown
  misc_feature (1)..( 11): Result.006 file - promoters50/5672872
actgcaaaaaa

SEQ ID NO: 199839 - DNA, 8 bp, Unknown
  misc_feature (1)..( 8): Result.006 file - promoters50/5672872
attagaga

SEQ ID NO: 199840 - DNA, 8 bp, Unknown
  misc_feature (1)..( 8): Result.006 file - promoters50/5672872
attagaat

SEQ ID NO: 199841 - DNA, 8 bp, Unknown
  misc_feature (1)..( 8): Result.006 file - promoters50/5672872
attaaaat

SEQ ID NO: 199842 - DNA, 11 bp, Unknown
  misc_feature (1)..( 11): Result.006 file - promoters50/5672872
agaatcacctc

SEQ ID NO: 199843 - DNA, 11 bp, Unknown
  misc_feature (1)..( 11): Result.006 file - promoters50/5672872
agactcatctc

SEQ ID NO: 199844 - DNA, 11 bp, Unknown
  misc_feature (1)..( 11): Result.006 file - promoters50/5672872
aaactcataga

SEQ ID NO: 199845 - DNA, 10 bp, Unknown
  misc_feature (1)..( 10): Result.006 file - promoters50/5672872
ttttattttc

SEQ ID NO: 199846 - DNA, 10 bp, Unknown
  misc_feature (1)..( 10): Result.006 file - promoters50/5672872
ttttataaca

SEQ ID NO: 199847 - DNA, 10 bp, Unknown
  misc_feature (1)..( 10): Result.006 file - promoters50/5672872
ttttattata

SEQ ID NO: 199848 - DNA, 17 bp, Unknown
  misc_feature (1)..( 17): Result.006 file - promoters50/5672872
ttttgttttgtattttt

SEQ ID NO: 199849 - DNA, 17 bp, Unknown
  misc_feature (1)..( 17): Result.006 file - promoters50/5672872
acttgtttgagatagcc

SEQ ID NO: 199850 - DNA, 17 bp, Unknown
  misc_feature (1)..( 17): Result.006 file - promoters50/5672872
ttttattttttttattt

SEQ ID NO: 199851 - DNA, 17 bp, Unknown
  misc_feature (1)..( 17): Result.006 file - promoters50/5672872
ttttaatttagcgttaa

SEQ ID NO: 199852 - DNA, 9 bp, Unknown
  misc_feature (1)..( 9): Result.006 file - promoters50/5672872
tcgcacaga

SEQ ID NO: 199853 - DNA, 9 bp, Unknown
  misc_feature (1)..( 9): Result.006 file - promoters50/5672872
acgcataga

SEQ ID NO: 199854 - DNA, 9 bp, Unknown
  misc_feature (1)..( 9): Result.006 file - promoters50/5672872
acgtataac

SEQ ID NO: 199855 - DNA, 9 bp, Unknown
  misc_feature (1)..( 9): Result.006 file - promoters50/5672872
tgaattatt

SEQ ID NO: 199856 - DNA, 9 bp, Unknown
  misc_feature (1)..( 9): Result.006 file - promoters50/5672872
gaaattatt

SEQ ID NO: 199857 - DNA, 9 bp, Unknown
  misc_feature (1)..( 9): Result.006 file - promoters50/5672872
ttaatttag

SEQ ID NO: 199858 - DNA, 13 bp, Unknown
  misc_feature (1)..( 13): Result.006 file - promoters50/5672872
gccgttttaattt

SEQ ID NO: 199859 - DNA, 13 bp, Unknown
  misc_feature (1)..( 13): Result.006 file - promoters50/5672872
gccgtattaaagt

SEQ ID NO: 199860 - DNA, 13 bp, Unknown
  misc_feature (1)..( 13): Result.006 file - promoters50/5673089
attattttatttt

SEQ ID NO: 199861 - DNA, 7 bp, Unknown
  misc_feature (1)..( 7): Result.006 file - promoters50/5673089
tttctta

SEQ ID NO: 199862 - DNA, 7 bp, Unknown
  misc_feature (1)..( 7): Result.006 file - promoters50/5673089
tttatta

SEQ ID NO: 199863 - DNA, 7 bp, Unknown
  misc_feature (1)..( 7): Result.006 file - promoters50/5673089
attatta

SEQ ID NO: 199864 - DNA, 11 bp, Unknown
  misc_feature (1)..( 11): Result.006 file - promoters50/5673089
cctgcacaaaa

SEQ ID NO: 199865 - DNA, 11 bp, Unknown
  misc_feature (1)..( 11): Result.006 file - promoters50/5673089
ccctcacaaaa

SEQ ID NO: 199866 - DNA, 11 bp, Unknown
  misc_feature (1)..( 11): Result.006 file - promoters50/5673089
cctgctcaagg

SEQ ID NO: 199867 - DNA, 11 bp, Unknown
  misc_feature (1)..( 11): Result.006 file - promoters50/5673089
tatgagtattt

SEQ ID NO: 199868 - DNA, 11 bp, Unknown
  misc_feature (1)..( 11): Result.006 file - promoters50/5673089
tatgattatta

SEQ ID NO: 199869 - DNA, 11 bp, Unknown
  misc_feature (1)..( 11): Result.006 file - promoters50/5673348
tagatttatta

SEQ ID NO: 199870 - DNA, 13 bp, Unknown
  misc_feature (1)..( 13): Result.006 file - promoters50/5673348
aatgttatttttc

SEQ ID NO: 199871 - DNA, 13 bp, Unknown
  misc_feature (1)..( 13): Result.006 file - promoters50/5673348
tttgtcattatgt

SEQ ID NO: 199872 - DNA, 13 bp, Unknown
  misc_feature (1)..( 13): Result.006 file - promoters50/5673348
aatgttgtttata

SEQ ID NO: 199873 - DNA, 13 bp, Unknown
  misc_feature (1)..( 13): Result.006 file - promoters50/5673348
ccatttgtttata

SEQ ID NO: 199874 - DNA, 8 bp, Unknown
  misc_feature (1)..( 8): Result.006 file - promoters50/5673348
aaatattt

SEQ ID NO: 199875 - DNA, 8 bp, Unknown
  misc_feature (1)..( 8): Result.006 file - promoters50/5673348
taatgttt

SEQ ID NO: 199876 - DNA, 8 bp, Unknown
  misc_feature (1)..( 8): Result.006 file - promoters50/5673348
aaatatag

SEQ ID NO: 199877 - DNA, 9 bp, Unknown
  misc_feature (1)..( 9): Result.006 file - promoters50/5673348
atcatcaac

SEQ ID NO: 199878 - DNA, 9 bp, Unknown
  misc_feature (1)..( 9): Result.006 file - promoters50/5673348
taaatcaac

SEQ ID NO: 199879 - DNA, 9 bp, Unknown
  misc_feature (1)..( 9): Result.006 file - promoters50/5673348
taaaacaat

SEQ ID NO: 199880 - DNA, 9 bp, Unknown
  misc_feature (1)..( 9): Result.006 file - promoters50/5673348
ctatagtat

SEQ ID NO: 199881 - DNA, 9 bp, Unknown
  misc_feature (1)..( 9): Result.006 file - promoters50/5673348
ctaaagtat

SEQ ID NO: 199882 - DNA, 9 bp, Unknown
  misc_feature (1)..( 9): Result.006 file - promoters50/5673348
ccataatat

SEQ ID NO: 199883 - DNA, 8 bp, Unknown
  misc_feature (1)..( 8): Result.006 file - promoters50/5673348
caaacaat

SEQ ID NO: 199884 - DNA, 8 bp, Unknown
  misc_feature (1)..( 8): Result.006 file - promoters50/5673348
aaaacaat

SEQ ID NO: 199885 - DNA, 9 bp, Unknown
  misc_feature (1)..( 9): Result.006 file - promoters50/5673348
taaatcaac

SEQ ID NO: 199886 - DNA, 8 bp, Unknown
  misc_feature (1)..( 8): Result.006 file - promoters50/5673348
attcaata

SEQ ID NO: 199887 - DNA, 8 bp, Unknown
  misc_feature (1)..( 8): Result.006 file - promoters50/5673348
tttctata

SEQ ID NO: 199888 - DNA, 8 bp, Unknown
  misc_feature (1)..( 8): Result.006 file - promoters50/5673514
tttatata

SEQ ID NO: 199889 - DNA, 11 bp, Unknown
  misc_feature (1)..( 11): Result.006 file - promoters50/5673514
ataaattaata

SEQ ID NO: 199890 - DNA, 11 bp, Unknown
  misc_feature (1)..( 11): Result.006 file - promoters50/5673514
ccaaattaaat

SEQ ID NO: 199891 - DNA, 11 bp, Unknown
  misc_feature (1)..( 11): Result.006 file - promoters50/5673650
atagattcata

SEQ ID NO: 199892 - DNA, 11 bp, Unknown
  misc_feature (1)..( 11): Result.006 file - promoters50/5673650
aaaatgtgatc

SEQ ID NO: 199893 - DNA, 11 bp, Unknown
  misc_feature (1)..( 11): Result.006 file - promoters50/5673650
aaaatgctact

SEQ ID NO: 199894 - DNA, 11 bp, Unknown
  misc_feature (1)..( 11): Result.006 file - promoters50/5673650
caaatcgaaat

SEQ ID NO: 199895 - DNA, 11 bp, Unknown
  misc_feature (1)..( 11): Result.006 file - promoters50/5673650
tccatcgaatt

SEQ ID NO: 199896 - DNA, 11 bp, Unknown
  misc_feature (1)..( 11): Result.006 file - promoters50/5673650
gcattcgaaaa

SEQ ID NO: 199897 - DNA, 11 bp, Unknown
  misc_feature (1)..( 11): Result.006 file - promoters50/5673674
taaatcctaac

SEQ ID NO: 199898 - DNA, 11 bp, Unknown
  misc_feature (1)..( 11): Result.006 file - promoters50/5673674
aaaacaacaga

SEQ ID NO: 199899 - DNA, 11 bp, Unknown
  misc_feature (1)..( 11): Result.006 file - promoters50/5673674
caaataacaaa

SEQ ID NO: 199900 - DNA, 11 bp, Unknown
  misc_feature (1)..( 11): Result.006 file - promoters50/5673674
taaacaaaagg

SEQ ID NO: 199901 - DNA, 11 bp, Unknown
  misc_feature (1)..( 11): Result.006 file - promoters50/5673674
ataattacaat

SEQ ID NO: 199902 - DNA, 11 bp, Unknown
  misc_feature (1)..( 11): Result.006 file - promoters50/5673674
ggaacaaagaa

SEQ ID NO: 199903 - DNA, 12 bp, Unknown
  misc_feature (1)..( 12): Result.006 file - promoters50/5673674
ggaacgaagaag

SEQ ID NO: 199904 - DNA, 12 bp, Unknown
  misc_feature (1)..( 12): Result.006 file - promoters50/5673674
taaatttacaaa

SEQ ID NO: 199905 - DNA, 12 bp, Unknown
  misc_feature (1)..( 12): Result.006 file - promoters50/5673674
cacttttaaaaa

SEQ ID NO: 199906 - DNA, 10 bp, Unknown
  misc_feature (1)..( 10): Result.006 file - promoters50/5673674
attaattaag

SEQ ID NO: 199907 - DNA, 10 bp, Unknown
  misc_feature (1)..( 10): Result.006 file - promoters50/5673674
tttaagtaaa

SEQ ID NO: 199908 - DNA, 10 bp, Unknown
  misc_feature (1)..( 10): Result.006 file - promoters50/5673674
gtcaatgaat

SEQ ID NO: 199909 - DNA, 10 bp, Unknown
  misc_feature (1)..( 10): Result.006 file - promoters50/5673674
atcaaagaat

SEQ ID NO: 199910 - DNA, 10 bp, Unknown
  misc_feature (1)..( 10): Result.006 file - promoters50/5673674
tagaaagaaa

SEQ ID NO: 199911 - DNA, 10 bp, Unknown
  misc_feature (1)..( 10): Result.006 file - promoters50/5673674
tagaacgaac

SEQ ID NO: 199912 - DNA, 10 bp, Unknown
  misc_feature (1)..( 10): Result.006 file - promoters50/5673674
gacaaaaaaa

SEQ ID NO: 199913 - DNA, 14 bp, Unknown
  misc_feature (1)..( 14): Result.006 file - promoters50/5673674
ttaaacaaaaaaaa

SEQ ID NO: 199914 - DNA, 14 bp, Unknown
  misc_feature (1)..( 14): Result.006 file - promoters50/5673674
gtaaagaaaaaagc

SEQ ID NO: 199915 - DNA, 14 bp, Unknown
  misc_feature (1)..( 14): Result.006 file - promoters50/5673674
agaaataaataatt

SEQ ID NO: 199916 - DNA, 14 bp, Unknown
  misc_feature (1)..( 14): Result.006 file - promoters50/5673674
agaaagaaattaaa

SEQ ID NO: 199917 - DNA, 14 bp, Unknown
  misc_feature (1)..( 14): Result.006 file - promoters50/5673674
gtggacaaaaaaaa

SEQ ID NO: 199918 - DNA, 14 bp, Unknown
  misc_feature (1)..( 14): Result.006 file - promoters50/5673674
tcaaagaatcgttg

SEQ ID NO: 199919 - DNA, 14 bp, Unknown
  misc_feature (1)..( 14): Result.006 file - promoters50/5673773
tagaacgaacaggt

SEQ ID NO: 199920 - DNA, 10 bp, Unknown
  misc_feature (1)..( 10): Result.006 file - promoters50/5673773
ccataaactt

SEQ ID NO: 199921 - DNA, 10 bp, Unknown
  misc_feature (1)..( 10): Result.006 file - promoters50/5673773
acataaactt

SEQ ID NO: 199922 - DNA, 10 bp, Unknown
  misc_feature (1)..( 10): Result.006 file - promoters50/5673796
acaaaaaaac

SEQ ID NO: 199923 - DNA, 11 bp, Unknown
  misc_feature (1)..( 11): Result.006 file - promoters50/5673796
gtaattacaat

SEQ ID NO: 199924 - DNA, 11 bp, Unknown
  misc_feature (1)..( 11): Result.006 file - promoters50/5673796
ttggttagaat

SEQ ID NO: 199925 - DNA, 11 bp, Unknown
  misc_feature (1)..( 11): Result.006 file - promoters50/5673796
ttgggtagatg

SEQ ID NO: 199926 - DNA, 8 bp, Unknown
  misc_feature (1)..( 8): Result.006 file - promoters50/5673796
ttttatat

SEQ ID NO: 199927 - DNA, 8 bp, Unknown
  misc_feature (1)..( 8): Result.006 file - promoters50/5673796
ttttattt

SEQ ID NO: 199928 - DNA, 8 bp, Unknown
  misc_feature (1)..( 8): Result.006 file - promoters50/5674194
ctttcttt

SEQ ID NO: 199929 - DNA, 11 bp, Unknown
  misc_feature (1)..( 11): Result.006 file - promoters50/5674194
cataaaaaatt

SEQ ID NO: 199930 - DNA, 11 bp, Unknown
  misc_feature (1)..( 11): Result.006 file - promoters50/5674194
aagaaaaaaaa

SEQ ID NO: 199931 - DNA, 11 bp, Unknown
  misc_feature (1)..( 11): Result.006 file - promoters50/5674194
aataaaaacag

SEQ ID NO: 199932 - DNA, 11 bp, Unknown
  misc_feature (1)..( 11): Result.006 file - promoters50/5674194
catataaaatg

SEQ ID NO: 199933 - DNA, 11 bp, Unknown
  misc_feature (1)..( 11): Result.006 file - promoters50/5674194
atgaaatattt

SEQ ID NO: 199934 - DNA, 12 bp, Unknown
  misc_feature (1)..( 12): Result.006 file - promoters50/5674194
attaaagaaaag

SEQ ID NO: 199935 - DNA, 12 bp, Unknown
  misc_feature (1)..( 12): Result.006 file - promoters50/5674194
tttataataaca

SEQ ID NO: 199936 - DNA, 17 bp, Unknown
  misc_feature (1)..( 17): Result.006 file - promoters50/5674194
aataattaaagtttaat

SEQ ID NO: 199937 - DNA, 17 bp, Unknown
  misc_feature (1)..( 17): Result.006 file - promoters50/5674194
aacaatgaaagggattc

SEQ ID NO: 199938 - DNA, 17 bp, Unknown
  misc_feature (1)..( 17): Result.006 file - promoters50/5674194
aatcattaatccttgtc

SEQ ID NO: 199939 - DNA, 17 bp, Unknown
  misc_feature (1)..( 17): Result.006 file - promoters50/5674194
gttcttgagagggtttc

SEQ ID NO: 199940 - DNA, 17 bp, Unknown
  misc_feature (1)..( 17): Result.006 file - promoters50/5674194
atacttcagaacaccac

SEQ ID NO: 199941 - DNA, 17 bp, Unknown
  misc_feature (1)..( 17): Result.006 file - promoters50/5674194
accaatcataaaagttt

SEQ ID NO: 199942 - DNA, 17 bp, Unknown
  misc_feature (1)..( 17): Result.006 file - promoters50/5674530
attaatgaatggtgata

SEQ ID NO: 199943 - DNA, 13 bp, Unknown
  misc_feature (1)..( 13): Result.006 file - promoters50/5674530
attaccaaataaa

SEQ ID NO: 199944 - DNA, 13 bp, Unknown
  misc_feature (1)..( 13): Result.006 file - promoters50/5674530
atatccaaataaa

SEQ ID NO: 199945 - DNA, 13 bp, Unknown
  misc_feature (1)..( 13): Result.006 file - promoters50/5674530
aatcaaaaataac

SEQ ID NO: 199946 - DNA, 13 bp, Unknown
  misc_feature (1)..( 13): Result.006 file - promoters50/5674530
tttaacaaaactt

SEQ ID NO: 199947 - DNA, 13 bp, Unknown
  misc_feature (1)..( 13): Result.006 file - promoters50/5674530
tttaaccgattaa

SEQ ID NO: 199948 - DNA, 9 bp, Unknown
  misc_feature (1)..( 9): Result.006 file - promoters50/5674530
agaacaaac

SEQ ID NO: 199949 - DNA, 9 bp, Unknown
  misc_feature (1)..( 9): Result.006 file - promoters50/5674530
agaaaaaaa

SEQ ID NO: 199950 - DNA, 9 bp, Unknown
  misc_feature (1)..( 9): Result.006 file - promoters50/5674530
ttaacaaac

SEQ ID NO: 199951 - DNA, 9 bp, Unknown
  misc_feature (1)..( 9): Result.006 file - promoters50/5674530
agaccaaag

SEQ ID NO: 199952 - DNA, 9 bp, Unknown
  misc_feature (1)..( 9): Result.006 file - promoters50/5674626
tgaacaaac

SEQ ID NO: 199953 - DNA, 9 bp, Unknown
  misc_feature (1)..( 9): Result.006 file - promoters50/5674626
gaatcaata

SEQ ID NO: 199954 - DNA, 9 bp, Unknown
  misc_feature (1)..( 9): Result.006 file - promoters50/5674626
aaataaatt

SEQ ID NO: 199955 - DNA, 9 bp, Unknown
  misc_feature (1)..( 9): Result.006 file - promoters50/5674626
gaatcagag

SEQ ID NO: 199956 - DNA, 9 bp, Unknown
  misc_feature (1)..( 9): Result.006 file - promoters50/5674634
acatagatt

SEQ ID NO: 199957 - DNA, 9 bp, Unknown
  misc_feature (1)..( 9): Result.006 file - promoters50/5674634
aaaatgtga

SEQ ID NO: 199958 - DNA, 9 bp, Unknown
  misc_feature (1)..( 9): Result.006 file - promoters50/5674634
ctaatgtga

SEQ ID NO: 199959 - DNA, 9 bp, Unknown
  misc_feature (1)..( 9): Result.006 file - promoters50/5674634
aaaatttga

SEQ ID NO: 199960 - DNA, 9 bp, Unknown
  misc_feature (1)..( 9): Result.006 file - promoters50/5674634
ttaatgtct

SEQ ID NO: 199961 - DNA, 9 bp, Unknown
  misc_feature (1)..( 9): Result.006 file - promoters50/5674634
taaattttg

SEQ ID NO: 199962 - DNA, 9 bp, Unknown
  misc_feature (1)..( 9): Result.006 file - promoters50/5674634
tatattttg

SEQ ID NO: 199963 - DNA, 11 bp, Unknown
  misc_feature (1)..( 11): Result.006 file - promoters50/5674634
ataaaatgtga

SEQ ID NO: 199964 - DNA, 11 bp, Unknown
  misc_feature (1)..( 11): Result.006 file - promoters50/5674634
gtaacatggcg

SEQ ID NO: 199965 - DNA, 11 bp, Unknown
  misc_feature (1)..( 11): Result.006 file - promoters50/5674634
tcaaaatttga

SEQ ID NO: 199966 - DNA, 11 bp, Unknown
  misc_feature (1)..( 11): Result.006 file - promoters50/5674634
ataaaaacggg

SEQ ID NO: 199967 - DNA, 11 bp, Unknown
  misc_feature (1)..( 11): Result.006 file - promoters50/5674634
attaaattttg

SEQ ID NO: 199968 - DNA, 11 bp, Unknown
  misc_feature (1)..( 11): Result.006 file - promoters50/5674634
tgtatattttg

SEQ ID NO: 199969 - DNA, 12 bp, Unknown
  misc_feature (1)..( 12): Result.006 file - promoters50/5674634
tttagattgaag

SEQ ID NO: 199970 - DNA, 12 bp, Unknown
  misc_feature (1)..( 12): Result.006 file - promoters50/5674634
tttggattttga

SEQ ID NO: 199971 - DNA, 12 bp, Unknown
  misc_feature (1)..( 12): Result.006 file - promoters50/5674634
tttacatttaga

SEQ ID NO: 199972 - DNA, 12 bp, Unknown
  misc_feature (1)..( 12): Result.006 file - promoters50/5674634
attggatttctt

SEQ ID NO: 199973 - DNA, 12 bp, Unknown
  misc_feature (1)..( 12): Result.006 file - promoters50/5674634
tctacctttttt

SEQ ID NO: 199974 - DNA, 12 bp, Unknown
  misc_feature (1)..( 12): Result.006 file - promoters50/5674634
tcacccttcttt

SEQ ID NO: 199975 - DNA, 16 bp, Unknown
  misc_feature (1)..( 16): Result.006 file - promoters50/5674634
tgatttcgtgattgaa

SEQ ID NO: 199976 - DNA, 16 bp, Unknown
  misc_feature (1)..( 16): Result.006 file - promoters50/5674634
taatttcctgaaccct

SEQ ID NO: 199977 - DNA, 16 bp, Unknown
  misc_feature (1)..( 16): Result.006 file - promoters50/5674634
tgaattctttcaaaat

SEQ ID NO: 199978 - DNA, 16 bp, Unknown
  misc_feature (1)..( 16): Result.006 file - promoters50/5674634
tggtctcgagatggaa

SEQ ID NO: 199979 - DNA, 14 bp, Unknown
  misc_feature (1)..( 14): Result.006 file - promoters50/5674634
atttcctagataca

SEQ ID NO: 199980 - DNA, 16 bp, Unknown
  misc_feature (1)..( 16): Result.006 file - promoters50/5674634
aaaaaacgaatggcaa

SEQ ID NO: 199981 - DNA, 16 bp, Unknown
  misc_feature (1)..( 16): Result.006 file - promoters50/5674666
atcaaacaaatcaaat

SEQ ID NO: 199982 - DNA, 10 bp, Unknown
  misc_feature (1)..( 10): Result.006 file - promoters50/5674666
gccaaagaga

SEQ ID NO: 199983 - DNA, 10 bp, Unknown
  misc_feature (1)..( 10): Result.006 file - promoters50/5674666
ctttaagaga

SEQ ID NO: 199984 - DNA, 10 bp, Unknown
  misc_feature (1)..( 10): Result.006 file - promoters50/5674666
aattaaaaga

SEQ ID NO: 199985 - DNA, 10 bp, Unknown
  misc_feature (1)..( 10): Result.006 file - promoters50/5674666
ttttaaaaaa

SEQ ID NO: 199986 - DNA, 10 bp, Unknown
  misc_feature (1)..( 10): Result.006 file - promoters50/5674666
aattaaaatt

SEQ ID NO: 199987 - DNA, 10 bp, Unknown
  misc_feature (1)..( 10): Result.006 file - promoters50/5674666
aattaatcac

SEQ ID NO: 199988 - DNA, 15 bp, Unknown
  misc_feature (1)..( 15): Result.006 file - promoters50/5674666
ttttcatttaattga

SEQ ID NO: 199989 - DNA, 15 bp, Unknown
  misc_feature (1)..( 15): Result.006 file - promoters50/5674666
ggagatttttatttg

SEQ ID NO: 199990 - DNA, 15 bp, Unknown
  misc_feature (1)..( 15): Result.006 file - promoters50/5674666
taaaaattcaatttg

SEQ ID NO: 199991 - DNA, 15 bp, Unknown
  misc_feature (1)..( 15): Result.006 file - promoters50/5674666
tctaccttttttttg

SEQ ID NO: 199992 - DNA, 15 bp, Unknown
  misc_feature (1)..( 15): Result.006 file - promoters50/5674666
tctacgttttttcac

SEQ ID NO: 199993 - DNA, 15 bp, Unknown
  misc_feature (1)..( 15): Result.006 file - promoters50/5674666
actacgtgcttccaa

SEQ ID NO: 199994 - DNA, 8 bp, Unknown
  misc_feature (1)..( 8): Result.006 file - promoters50/5674666
atataaat

SEQ ID NO: 199995 - DNA, 8 bp, Unknown
  misc_feature (1)..( 8): Result.006 file - promoters50/5674666
atataaaa

SEQ ID NO: 199996 - DNA, 8 bp, Unknown
  misc_feature (1)..( 8): Result.006 file - promoters50/5674666
atataaat

SEQ ID NO: 199997 - DNA, 8 bp, Unknown
  misc_feature (1)..( 8): Result.006 file - promoters50/5674666
atataaat

SEQ ID NO: 199998 - DNA, 8 bp, Unknown
  misc_feature (1)..( 8): Result.006 file - promoters50/5674666
atagaaag

SEQ ID NO: 199999 - DNA, 8 bp, Unknown
  misc_feature (1)..( 8): Result.006 file - promoters50/5675330
ctataaaa

SEQ ID NO: 200000 - DNA, 10 bp, Unknown
  misc_feature (1)..( 10): Result.006 file - promoters50/5675330
tttgtggtaa

SEQ ID NO: 200001 - DNA, 10 bp, Unknown
  misc_feature (1)..( 10): Result.006 file - promoters50/5675330
agtgttgtaa

SEQ ID NO: 200002 - DNA, 10 bp, Unknown
  misc_feature (1)..( 10): Result.006 file - promoters50/5675330
tttttggtga

SEQ ID NO: 200003 - DNA, 6 bp, Unknown
  misc_feature (1)..( 6): Result.006 file - promoters50/5675330
catgtt

SEQ ID NO: 200004 - DNA, 6 bp, Unknown
  misc_feature (1)..( 6): Result.006 file - promoters50/5675330
catgtt

SEQ ID NO: 200005 - DNA, 6 bp, Unknown
  misc_feature (1)..( 6): Result.006 file - promoters50/5675583
catgtt

SEQ ID NO: 200006 - DNA, 7 bp, Unknown
  misc_feature (1)..( 7): Result.006 file - promoters50/5675583
aaaaatt

SEQ ID NO: 200007 - DNA, 7 bp, Unknown
  misc_feature (1)..( 7): Result.006 file - promoters50/5675583
aaaaatt

SEQ ID NO: 200008 - DNA, 7 bp, Unknown
  misc_feature (1)..( 7): Result.006 file - promoters50/5675583
aaacatt

SEQ ID NO: 200009 - DNA, 8 bp, Unknown
  misc_feature (1)..( 8): Result.006 file - promoters50/5675583
taatgaac

SEQ ID NO: 200010 - DNA, 8 bp, Unknown
  misc_feature (1)..( 8): Result.006 file - promoters50/5675583
caataaac

SEQ ID NO: 200011 - DNA, 8 bp, Unknown
  misc_feature (1)..( 8): Result.006 file - promoters50/5675583
caaaaaaa

SEQ ID NO: 200012 - DNA, 9 bp, Unknown
  misc_feature (1)..( 9): Result.006 file - promoters50/5675583
atgaattgg

SEQ ID NO: 200013 - DNA, 9 bp, Unknown
  misc_feature (1)..( 9): Result.006 file - promoters50/5675583
atgatttgg

SEQ ID NO: 200014 - DNA, 9 bp, Unknown
  misc_feature (1)..( 9): Result.006 file - promoters50/5675583
atgattgga

SEQ ID NO: 200015 - DNA, 8 bp, Unknown
  misc_feature (1)..( 8): Result.006 file - promoters50/5675583
gaaactgc

SEQ ID NO: 200016 - DNA, 8 bp, Unknown
  misc_feature (1)..( 8): Result.006 file - promoters50/5675583
aaaactgc

SEQ ID NO: 200017 - DNA, 8 bp, Unknown
  misc_feature (1)..( 8): Result.006 file - promoters50/5675628
aaaactct

SEQ ID NO: 200018 - DNA, 8 bp, Unknown
  misc_feature (1)..( 8): Result.006 file - promoters50/5675628
ggctttgt

SEQ ID NO: 200019 - DNA, 8 bp, Unknown
  misc_feature (1)..( 8): Result.006 file - promoters50/5675628
ttctttgt

SEQ ID NO: 200020 - DNA, 8 bp, Unknown
  misc_feature (1)..( 8): Result.006 file - promoters50/5675628
tactttgt

SEQ ID NO: 200021 - DNA, 8 bp, Unknown
  misc_feature (1)..( 8): Result.006 file - promoters50/5675628
gtctctgt

SEQ ID NO: 200022 - DNA, 8 bp, Unknown
  misc_feature (1)..( 8): Result.006 file - promoters50/5675628
taccttga

SEQ ID NO: 200023 - DNA, 8 bp, Unknown
  misc_feature (1)..( 8): Result.006 file - promoters50/5675661
ctccttga

SEQ ID NO: 200024 - DNA, 12 bp, Unknown
  misc_feature (1)..( 12): Result.006 file - promoters50/5675661
atggatttattc

SEQ ID NO: 200025 - DNA, 12 bp, Unknown
  misc_feature (1)..( 12): Result.006 file - promoters50/5675661
ttggattttgaa

SEQ ID NO: 200026 - DNA, 12 bp, Unknown
  misc_feature (1)..( 12): Result.006 file - promoters50/5675661
ttggatttaaca

SEQ ID NO: 200027 - DNA, 13 bp, Unknown
  misc_feature (1)..( 13): Result.006 file - promoters50/5675661
ttggaatttggaa

SEQ ID NO: 200028 - DNA, 13 bp, Unknown
  misc_feature (1)..( 13): Result.006 file - promoters50/5675661
tttacatttagat

SEQ ID NO: 200029 - DNA, 13 bp, Unknown
  misc_feature (1)..( 13): Result.006 file - promoters50/5675661
cagttattttgaa

SEQ ID NO: 200030 - DNA, 13 bp, Unknown
  misc_feature (1)..( 13): Result.006 file - promoters50/5675661
tttgaattttttt

SEQ ID NO: 200031 - DNA, 13 bp, Unknown
  misc_feature (1)..( 13): Result.006 file - promoters50/5675661
acctaaaagattt

SEQ ID NO: 200032 - DNA, 13 bp, Unknown
  misc_feature (1)..( 13): Result.006 file - promoters50/5675661
gaagataagattg

SEQ ID NO: 200033 - DNA, 13 bp, Unknown
  misc_feature (1)..( 13): Result.006 file - promoters50/5675661
acaaaaaagatgt

SEQ ID NO: 200034 - DNA, 13 bp, Unknown
  misc_feature (1)..( 13): Result.006 file - promoters50/5675661
ggttttaaaattt

SEQ ID NO: 200035 - DNA, 13 bp, Unknown
  misc_feature (1)..( 13): Result.006 file - promoters50/5675661
ttttgaaagaagg

SEQ ID NO: 200036 - DNA, 13 bp, Unknown
  misc_feature (1)..( 13): Result.006 file - promoters50/5675661
tgttgaaacttga

SEQ ID NO: 200037 - DNA, 13 bp, Unknown
  misc_feature (1)..( 13): Result.006 file - promoters50/5676027
gtgacaaaggtgt

SEQ ID NO: 200038 - DNA, 11 bp, Unknown
  misc_feature (1)..( 11): Result.006 file - promoters50/5676027
ctaatttccaa

SEQ ID NO: 200039 - DNA, 11 bp, Unknown
  misc_feature (1)..( 11): Result.006 file - promoters50/5676027
aaaatttcaaa

SEQ ID NO: 200040 - DNA, 11 bp, Unknown
  misc_feature (1)..( 11): Result.006 file - promoters50/5676027
ctaatttgtca

SEQ ID NO: 200041 - DNA, 11 bp, Unknown
  misc_feature (1)..( 11): Result.006 file - promoters50/5676027
ctattttccaa

SEQ ID NO: 200042 - DNA, 11 bp, Unknown
  misc_feature (1)..( 11): Result.006 file - promoters50/5676027
ttaatttcaat

SEQ ID NO: 200043 - DNA, 11 bp, Unknown
  misc_feature (1)..( 11): Result.006 file - promoters50/5676027
ttaacttcatc

SEQ ID NO: 200044 - DNA, 17 bp, Unknown
  misc_feature (1)..( 17): Result.006 file - promoters50/5676027
aaacttaatttcaatct

SEQ ID NO: 200045 - DNA, 17 bp, Unknown
  misc_feature (1)..( 17): Result.006 file - promoters50/5676027
aaaattaagttcaaaaa

SEQ ID NO: 200046 - DNA, 17 bp, Unknown
  misc_feature (1)..( 17): Result.006 file - promoters50/5676027
atttaaaatttcaaatg

SEQ ID NO: 200047 - DNA, 17 bp, Unknown
  misc_feature (1)..( 17): Result.006 file - promoters50/5676027
attgttaacttcatcat

SEQ ID NO: 200048 - DNA, 17 bp, Unknown
  misc_feature (1)..( 17): Result.006 file - promoters50/5676027
tgtcagaatgtcaggct

SEQ ID NO: 200049 - DNA, 18 bp, Unknown
  misc_feature (1)..( 18): Result.006 file - promoters50/5676160
aactctattttccaatga

SEQ ID NO: 200050 - DNA, 8 bp, Unknown
  misc_feature (1)..( 8): Result.006 file - promoters50/5676160
atttaact

SEQ ID NO: 200051 - DNA, 8 bp, Unknown
  misc_feature (1)..( 8): Result.006 file - promoters50/5676160
atttaaat

SEQ ID NO: 200052 - DNA, 8 bp, Unknown
  misc_feature (1)..( 8): Result.006 file - promoters50/5676160
atttaatg

SEQ ID NO: 200053 - DNA, 9 bp, Unknown
  misc_feature (1)..( 9): Result.006 file - promoters50/5676160
ttttgaata

SEQ ID NO: 200054 - DNA, 9 bp, Unknown
  misc_feature (1)..( 9): Result.006 file - promoters50/5676160
tttttgata

SEQ ID NO: 200055 - DNA, 9 bp, Unknown
  misc_feature (1)..( 9): Result.006 file - promoters50/5676160
aatttgatt

SEQ ID NO: 200056 - DNA, 11 bp, Unknown
  misc_feature (1)..( 11): Result.006 file - promoters50/5676160
gtgtgatttaa

SEQ ID NO: 200057 - DNA, 11 bp, Unknown
  misc_feature (1)..( 11): Result.006 file - promoters50/5676160
gtgtgttttga

SEQ ID NO: 200058 - DNA, 11 bp, Unknown
  misc_feature (1)..( 11): Result.006 file - promoters50/5676160
ttgtgatactc

SEQ ID NO: 200059 - DNA, 11 bp, Unknown
  misc_feature (1)..( 11): Result.006 file - promoters50/5676160
atttgatttta

SEQ ID NO: 200060 - DNA, 11 bp, Unknown
  misc_feature (1)..( 11): Result.006 file - promoters50/5676160
agctgatataa

SEQ ID NO: 200061 - DNA, 11 bp, Unknown
  misc_feature (1)..( 11): Result.006 file - promoters50/5676160
ttttgatatga

SEQ ID NO: 200062 - DNA, 17 bp, Unknown
  misc_feature (1)..( 17): Result.006 file - promoters50/5676160
tttttttttttttgtct

SEQ ID NO: 200063 - DNA, 17 bp, Unknown
  misc_feature (1)..( 17): Result.006 file - promoters50/5676160
acagtataattttgtta

SEQ ID NO: 200064 - DNA, 17 bp, Unknown
  misc_feature (1)..( 17): Result.006 file - promoters50/5676160
ttaagtaaattttcttg

SEQ ID NO: 200065 - DNA, 17 bp, Unknown
  misc_feature (1)..( 17): Result.006 file - promoters50/5676160
taaagcaaattttcact

SEQ ID NO: 200066 - DNA, 17 bp, Unknown
  misc_feature (1)..( 17): Result.006 file - promoters50/5676160
tataataaattttttcc

SEQ ID NO: 200067 - DNA, 17 bp, Unknown
  misc_feature (1)..( 17): Result.006 file - promoters50/5676160
taaagcaaaacacatac

SEQ ID NO: 200068 - DNA, 15 bp, Unknown
  misc_feature (1)..( 15): Result.006 file - promoters50/5676160
aaagtttatttagta

SEQ ID NO: 200069 - DNA, 15 bp, Unknown
  misc_feature (1)..( 15): Result.006 file - promoters50/5676160
atagtttatggaaaa

SEQ ID NO: 200070 - DNA, 15 bp, Unknown
  misc_feature (1)..( 15): Result.006 file - promoters50/5676160
aaaatttataaatgt

SEQ ID NO: 200071 - DNA, 15 bp, Unknown
  misc_feature (1)..( 15): Result.006 file - promoters50/5676160
aatatttaaaaaatt

SEQ ID NO: 200072 - DNA, 15 bp, Unknown
  misc_feature (1)..( 15): Result.006 file - promoters50/5676160
actgtatataaaaaa

SEQ ID NO: 200073 - DNA, 15 bp, Unknown
  misc_feature (1)..( 15): Result.006 file - promoters50/5676513
ctagttcatgccaag

SEQ ID NO: 200074 - DNA, 12 bp, Unknown
  misc_feature (1)..( 12): Result.006 file - promoters50/5676513
attatttgtttt

SEQ ID NO: 200075 - DNA, 12 bp, Unknown
  misc_feature (1)..( 12): Result.006 file - promoters50/5676513
attattgtatac

SEQ ID NO: 200076 - DNA, 12 bp, Unknown
  misc_feature (1)..( 12): Result.006 file - promoters50/5676513
attgtttgcttt

SEQ ID NO: 200077 - DNA, 12 bp, Unknown
  misc_feature (1)..( 12): Result.006 file - promoters50/5676513
tttgttttattc

SEQ ID NO: 200078 - DNA, 12 bp, Unknown
  misc_feature (1)..( 12): Result.006 file - promoters50/5676513
tatgttctatta

SEQ ID NO: 200079 - DNA, 12 bp, Unknown
  misc_feature (1)..( 12): Result.006 file - promoters50/5676647
attgtttgcttt

SEQ ID NO: 200080 - DNA, 11 bp, Unknown
  misc_feature (1)..( 11): Result.006 file - promoters50/5676647
gaatatctttt

SEQ ID NO: 200081 - DNA, 11 bp, Unknown
  misc_feature (1)..( 11): Result.006 file - promoters50/5676647
gaatatcttta

SEQ ID NO: 200082 - DNA, 11 bp, Unknown
  misc_feature (1)..( 11): Result.006 file - promoters50/5676647
aatcttctttt

SEQ ID NO: 200083 - DNA, 12 bp, Unknown
  misc_feature (1)..( 12): Result.006 file - promoters50/5676647
agaaatctgttt

SEQ ID NO: 200084 - DNA, 12 bp, Unknown
  misc_feature (1)..( 12): Result.006 file - promoters50/5676647
tattttctttat

SEQ ID NO: 200085 - DNA, 10 bp, Unknown
  misc_feature (1)..( 10): Result.006 file - promoters50/5676647
caccaattaa

SEQ ID NO: 200086 - DNA, 10 bp, Unknown
  misc_feature (1)..( 10): Result.006 file - promoters50/5676647
aacctattac

SEQ ID NO: 200087 - DNA, 10 bp, Unknown
  misc_feature (1)..( 10): Result.006 file - promoters50/5676647
tggaaattaa

SEQ ID NO: 200088 - DNA, 10 bp, Unknown
  misc_feature (1)..( 10): Result.006 file - promoters50/5676647
aacctaattt

SEQ ID NO: 200089 - DNA, 10 bp, Unknown
  misc_feature (1)..( 10): Result.006 file - promoters50/5676647
aacttaaaag

SEQ ID NO: 200090 - DNA, 10 bp, Unknown
  misc_feature (1)..( 10): Result.006 file - promoters50/5676647
acaaaacact

SEQ ID NO: 200091 - DNA, 10 bp, Unknown
  misc_feature (1)..( 10): Result.006 file - promoters50/5676647
agaaaacaag

SEQ ID NO: 200092 - DNA, 10 bp, Unknown
  misc_feature (1)..( 10): Result.006 file - promoters50/5676647
aaaaaatact

SEQ ID NO: 200093 - DNA, 10 bp, Unknown
  misc_feature (1)..( 10): Result.006 file - promoters50/5676647
acataacatt

SEQ ID NO: 200094 - DNA, 10 bp, Unknown
  misc_feature (1)..( 10): Result.006 file - promoters50/5677230
acaaaacaaa

SEQ ID NO: 200095 - DNA, 7 bp, Unknown
  misc_feature (1)..( 7): Result.006 file - promoters50/5677230
ttttgaa

SEQ ID NO: 200096 - DNA, 7 bp, Unknown
  misc_feature (1)..( 7): Result.006 file - promoters50/5677230
tttcgaa

SEQ ID NO: 200097 - DNA, 7 bp, Unknown
  misc_feature (1)..( 7): Result.006 file - promoters50/5677230
ttttgaa

SEQ ID NO: 200098 - DNA, 11 bp, Unknown
  misc_feature (1)..( 11): Result.006 file - promoters50/5677230
aaaatatgttt

SEQ ID NO: 200099 - DNA, 11 bp, Unknown
  misc_feature (1)..( 11): Result.006 file - promoters50/5677230
gaaatatctta

SEQ ID NO: 200100 - DNA, 11 bp, Unknown
  misc_feature (1)..( 11): Result.006 file - promoters50/5677230
aaaataaaata

SEQ ID NO: 200101 - DNA, 11 bp, Unknown
  misc_feature (1)..( 11): Result.006 file - promoters50/5677230
tgaatttgttt

SEQ ID NO: 200102 - DNA, 6 bp, Unknown
  misc_feature (1)..( 6): Result.006 file - promoters50/5677230
tgtgga

SEQ ID NO: 200103 - DNA, 6 bp, Unknown
  misc_feature (1)..( 6): Result.006 file - promoters50/5677230
tgtgga

SEQ ID NO: 200104 - DNA, 6 bp, Unknown
  misc_feature (1)..( 6): Result.006 file - promoters50/5677230
tgtgga

SEQ ID NO: 200105 - DNA, 6 bp, Unknown
  misc_feature (1)..( 6): Result.006 file - promoters50/5677230
gacatt

SEQ ID NO: 200106 - DNA, 6 bp, Unknown
  misc_feature (1)..( 6): Result.006 file - promoters50/5677230
gacatt

SEQ ID NO: 200107 - DNA, 6 bp, Unknown
  misc_feature (1)..( 6): Result.006 file - promoters50/5677230
gacatt

SEQ ID NO: 200108 - DNA, 7 bp, Unknown
  misc_feature (1)..( 7): Result.006 file - promoters50/5677230
aaggaaa

SEQ ID NO: 200109 - DNA, 7 bp, Unknown
  misc_feature (1)..( 7): Result.006 file - promoters50/5677230
aagtaaa

SEQ ID NO: 200110 - DNA, 7 bp, Unknown
  misc_feature (1)..( 7): Result.006 file - promoters50/5677230
gagtaaa

SEQ ID NO: 200111 - DNA, 6 bp, Unknown
  misc_feature (1)..( 6): Result.006 file - promoters50/5677230
tttgga

SEQ ID NO: 200112 - DNA, 6 bp, Unknown
  misc_feature (1)..( 6): Result.006 file - promoters50/5677230
tttgga

SEQ ID NO: 200113 - DNA, 6 bp, Unknown
  misc_feature (1)..( 6): Result.006 file - promoters50/5677230
tttgga

SEQ ID NO: 200114 - DNA, 8 bp, Unknown
  misc_feature (1)..( 8): Result.006 file - promoters50/5677230
attcgcaa

SEQ ID NO: 200115 - DNA, 8 bp, Unknown
  misc_feature (1)..( 8): Result.006 file - promoters50/5677230
atttgcag

SEQ ID NO: 200116 - DNA, 8 bp, Unknown
  misc_feature (1)..( 8): Result.006 file - promoters50/5677230
attttcag

SEQ ID NO: 200117 - DNA, 10 bp, Unknown
  misc_feature (1)..( 10): Result.006 file - promoters50/5677230
ggaaatgaaa

SEQ ID NO: 200118 - DNA, 10 bp, Unknown
  misc_feature (1)..( 10): Result.006 file - promoters50/5677230
ggaaaagaaa

SEQ ID NO: 200119 - DNA, 10 bp, Unknown
  misc_feature (1)..( 10): Result.006 file - promoters50/5677240
ggatatgaat

SEQ ID NO: 200120 - DNA, 11 bp, Unknown
  misc_feature (1)..( 11): Result.006 file - promoters50/5677240
cctgttcttgt

SEQ ID NO: 200121 - DNA, 11 bp, Unknown
  misc_feature (1)..( 11): Result.006 file - promoters50/5677240
taagttgttgt

SEQ ID NO: 200122 - DNA, 11 bp, Unknown
  misc_feature (1)..( 11): Result.006 file - promoters50/5677240
taaattgtctt

SEQ ID NO: 200123 - DNA, 9 bp, Unknown
  misc_feature (1)..( 9): Result.006 file - promoters50/5677240
catcatctt

SEQ ID NO: 200124 - DNA, 9 bp, Unknown
  misc_feature (1)..( 9): Result.006 file - promoters50/5677240
cttcatcta

SEQ ID NO: 200125 - DNA, 9 bp, Unknown
  misc_feature (1)..( 9): Result.006 file - promoters50/5677240
cttcttcta

SEQ ID NO: 200126 - DNA, 13 bp, Unknown
  misc_feature (1)..( 13): Result.006 file - promoters50/5677240
tcgtgagttttga

SEQ ID NO: 200127 - DNA, 13 bp, Unknown
  misc_feature (1)..( 13): Result.006 file - promoters50/5677240
atatatgttttgg

SEQ ID NO: 200128 - DNA, 13 bp, Unknown
  misc_feature (1)..( 13): Result.006 file - promoters50/5677240
gagataattttgg

SEQ ID NO: 200129 - DNA, 13 bp, Unknown
  misc_feature (1)..( 13): Result.006 file - promoters50/5677240
atatatatttttt

SEQ ID NO: 200130 - DNA, 9 bp, Unknown
  misc_feature (1)..( 9): Result.006 file - promoters50/5677240
gaattgcta

SEQ ID NO: 200131 - DNA, 9 bp, Unknown
  misc_feature (1)..( 9): Result.006 file - promoters50/5677240
ttattacta

SEQ ID NO: 200132 - DNA, 9 bp, Unknown
  misc_feature (1)..( 9): Result.006 file - promoters50/5677240
ttattacaa

SEQ ID NO: 200133 - DNA, 8 bp, Unknown
  misc_feature (1)..( 8): Result.006 file - promoters50/5677240
agatatat

SEQ ID NO: 200134 - DNA, 8 bp, Unknown
  misc_feature (1)..( 8): Result.006 file - promoters50/5677240
agagataa

SEQ ID NO: 200135 - DNA, 8 bp, Unknown
  misc_feature (1)..( 8): Result.006 file - promoters50/5677240
ctatatat

SEQ ID NO: 200136 - DNA, 7 bp, Unknown
  misc_feature (1)..( 7): Result.006 file - promoters50/5677240
aaaaata

SEQ ID NO: 200137 - DNA, 7 bp, Unknown
  misc_feature (1)..( 7): Result.006 file - promoters50/5677240
aaaaatc

SEQ ID NO: 200138 - DNA, 7 bp, Unknown
  misc_feature (1)..( 7): Result.006 file - promoters50/5677274
aaacata

SEQ ID NO: 200139 - DNA, 10 bp, Unknown
  misc_feature (1)..( 10): Result.006 file - promoters50/5677274
acagttacat

SEQ ID NO: 200140 - DNA, 10 bp, Unknown
  misc_feature (1)..( 10): Result.006 file - promoters50/5677274
acatttagaa

SEQ ID NO: 200141 - DNA, 10 bp, Unknown
  misc_feature (1)..( 10): Result.006 file - promoters50/5677274
tcatatagga

SEQ ID NO: 200142 - DNA, 10 bp, Unknown
  misc_feature (1)..( 10): Result.006 file - promoters50/5677274
acatttctga

SEQ ID NO: 200143 - DNA, 10 bp, Unknown
  misc_feature (1)..( 10): Result.006 file - promoters50/5677274
ccatttctac

SEQ ID NO: 200144 - DNA, 10 bp, Unknown
  misc_feature (1)..( 10): Result.006 file - promoters50/5677274
acatatctac

SEQ ID NO: 200145 - DNA, 20 bp, Unknown
  misc_feature (1)..( 20): Result.006 file - promoters50/5677274
tatatatgacacataacttt

SEQ ID NO: 200146 - DNA, 20 bp, Unknown
  misc_feature (1)..( 20): Result.006 file - promoters50/5677274
gtaatttgaaacataaaaaa

SEQ ID NO: 200147 - DNA, 20 bp, Unknown
  misc_feature (1)..( 20): Result.006 file - promoters50/5677274
tatgtattacaaatatgaaa

SEQ ID NO: 200148 - DNA, 20 bp, Unknown
  misc_feature (1)..( 20): Result.006 file - promoters50/5677274
aacgttttcaacataatgta

SEQ ID NO: 200149 - DNA, 20 bp, Unknown
  misc_feature (1)..( 20): Result.006 file - promoters50/5677274
gcttttcttcccttatctgt

SEQ ID NO: 200150 - DNA, 20 bp, Unknown
  misc_feature (1)..( 20): Result.006 file - promoters50/5677286
taaaatatcaacaaaattaa

SEQ ID NO: 200151 - DNA, 9 bp, Unknown
  misc_feature (1)..( 9): Result.006 file - promoters50/5677286
ggagcaatg

SEQ ID NO: 200152 - DNA, 9 bp, Unknown
  misc_feature (1)..( 9): Result.006 file - promoters50/5677286
agagcaaaa

SEQ ID NO: 200153 - DNA, 9 bp, Unknown
  misc_feature (1)..( 9): Result.006 file - promoters50/5677286
ggagaaaaa

SEQ ID NO: 200154 - DNA, 9 bp, Unknown
  misc_feature (1)..( 9): Result.006 file - promoters50/5677286
ggaaaaaaa

SEQ ID NO: 200155 - DNA, 9 bp, Unknown
  misc_feature (1)..( 9): Result.006 file - promoters50/5677286
tatcatact

SEQ ID NO: 200156 - DNA, 9 bp, Unknown
  misc_feature (1)..( 9): Result.006 file - promoters50/5677286
tctcaaact

SEQ ID NO: 200157 - DNA, 10 bp, Unknown
  misc_feature (1)..( 10): Result.006 file - promoters50/5677286
tttctaaaaa

SEQ ID NO: 200158 - DNA, 10 bp, Unknown
  misc_feature (1)..( 10): Result.006 file - promoters50/5677298
tttttaacaa

SEQ ID NO: 200159 - DNA, 14 bp, Unknown
  misc_feature (1)..( 14): Result.006 file - promoters50/5677298
tcttgaattgttcc

SEQ ID NO: 200160 - DNA, 14 bp, Unknown
  misc_feature (1)..( 14): Result.006 file - promoters50/5677298
ccatgaattggcac

SEQ ID NO: 200161 - DNA, 14 bp, Unknown
  misc_feature (1)..( 14): Result.006 file - promoters50/5677298
tattgatttgttcc

SEQ ID NO: 200162 - DNA, 14 bp, Unknown
  misc_feature (1)..( 14): Result.006 file - promoters50/5677298
tatttattttagat

SEQ ID NO: 200163 - DNA, 14 bp, Unknown
  misc_feature (1)..( 14): Result.006 file - promoters50/5677298
ttgtgatttggtga

SEQ ID NO: 200164 - DNA, 14 bp, Unknown
  misc_feature (1)..( 14): Result.006 file - promoters50/5677333
tataattttgttaa

SEQ ID NO: 200165 - DNA, 11 bp, Unknown
  misc_feature (1)..( 11): Result.006 file - promoters50/5677333
gctggtgctcg

SEQ ID NO: 200166 - DNA, 11 bp, Unknown
  misc_feature (1)..( 11): Result.006 file - promoters50/5677333
tttggttctct

SEQ ID NO: 200167 - DNA, 11 bp, Unknown
  misc_feature (1)..( 11): Result.006 file - promoters50/5677333
tttgtttctct

SEQ ID NO: 200168 - DNA, 11 bp, Unknown
  misc_feature (1)..( 11): Result.006 file - promoters50/5677344
ggagtttcttg

SEQ ID NO: 200169 - DNA, 14 bp, Unknown
  misc_feature (1)..( 14): Result.006 file - promoters50/5677344
gaaaaataaactaa

SEQ ID NO: 200170 - DNA, 14 bp, Unknown
  misc_feature (1)..( 14): Result.006 file - promoters50/5677344
gacaaataaatcgt

SEQ ID NO: 200171 - DNA, 14 bp, Unknown
  misc_feature (1)..( 14): Result.006 file - promoters50/5677344
caaaaataagatta

SEQ ID NO: 200172 - DNA, 14 bp, Unknown
  misc_feature (1)..( 14): Result.006 file - promoters50/5677344
ccaaaataaaataa

SEQ ID NO: 200173 - DNA, 14 bp, Unknown
  misc_feature (1)..( 14): Result.006 file - promoters50/5677344
ccaaaattgaccct

SEQ ID NO: 200174 - DNA, 14 bp, Unknown
  misc_feature (1)..( 14): Result.006 file - promoters50/5677360
tgcaaagaaagaca

SEQ ID NO: 200175 - DNA, 8 bp, Unknown
  misc_feature (1)..( 8): Result.006 file - promoters50/5677360
gcttttat

SEQ ID NO: 200176 - DNA, 8 bp, Unknown
  misc_feature (1)..( 8): Result.006 file - promoters50/5677360
acttttaa

SEQ ID NO: 200177 - DNA, 8 bp, Unknown
  misc_feature (1)..( 8): Result.006 file - promoters50/5677360
aattttaa

SEQ ID NO: 200178 - DNA, 8 bp, Unknown
  misc_feature (1)..( 8): Result.006 file - promoters50/5677360
acttttgg

SEQ ID NO: 200179 - DNA, 8 bp, Unknown
  misc_feature (1)..( 8): Result.006 file - promoters50/5677360
aacatata

SEQ ID NO: 200180 - DNA, 8 bp, Unknown
  misc_feature (1)..( 8): Result.006 file - promoters50/5677360
tacatata

SEQ ID NO: 200181 - DNA, 8 bp, Unknown
  misc_feature (1)..( 8): Result.006 file - promoters50/5677360
aacatata

SEQ ID NO: 200182 - DNA, 9 bp, Unknown
  misc_feature (1)..( 9): Result.006 file - promoters50/5677360
catatatca

SEQ ID NO: 200183 - DNA, 9 bp, Unknown
  misc_feature (1)..( 9): Result.006 file - promoters50/5677360
aatatatca

SEQ ID NO: 200184 - DNA, 9 bp, Unknown
  misc_feature (1)..( 9): Result.006 file - promoters50/5677360
aatgtatag

SEQ ID NO: 200185 - DNA, 10 bp, Unknown
  misc_feature (1)..( 10): Result.006 file - promoters50/5677360
aaagtataaa

SEQ ID NO: 200186 - DNA, 10 bp, Unknown
  misc_feature (1)..( 10): Result.006 file - promoters50/5677360
aaaatattta

SEQ ID NO: 200187 - DNA, 10 bp, Unknown
  misc_feature (1)..( 10): Result.006 file - promoters50/5677360
caagtttaaa

SEQ ID NO: 200188 - DNA, 8 bp, Unknown
  misc_feature (1)..( 8): Result.006 file - promoters50/5677360
atatatca

SEQ ID NO: 200189 - DNA, 8 bp, Unknown
  misc_feature (1)..( 8): Result.006 file - promoters50/5677360
atacatca

SEQ ID NO: 200190 - DNA, 8 bp, Unknown
  misc_feature (1)..( 8): Result.006 file - promoters50/5677360
ctacatcc

SEQ ID NO: 200191 - DNA, 8 bp, Unknown
  misc_feature (1)..( 8): Result.006 file - promoters50/5677360
aaataaaa

SEQ ID NO: 200192 - DNA, 8 bp, Unknown
  misc_feature (1)..( 8): Result.006 file - promoters50/5677360
aaagaaaa

SEQ ID NO: 200193 - DNA, 8 bp, Unknown
  misc_feature (1)..( 8): Result.006 file - promoters50/5677360
aaagaacc

SEQ ID NO: 200194 - DNA, 11 bp, Unknown
  misc_feature (1)..( 11): Result.006 file - promoters50/5677360
caagtctaaaa

SEQ ID NO: 200195 - DNA, 11 bp, Unknown
  misc_feature (1)..( 11): Result.006 file - promoters50/5677360
agagtttaaaa

SEQ ID NO: 200196 - DNA, 11 bp, Unknown
  misc_feature (1)..( 11): Result.006 file - promoters50/5677360
agagattagta

SEQ ID NO: 200197 - DNA, 8 bp, Unknown
  misc_feature (1)..( 8): Result.006 file - promoters50/5677360
aatgtatt

SEQ ID NO: 200198 - DNA, 8 bp, Unknown
  misc_feature (1)..( 8): Result.006 file - promoters50/5677360
aatatata

SEQ ID NO: 200199 - DNA, 8 bp, Unknown
  misc_feature (1)..( 8): Result.006 file - promoters50/5677484
tataaata

SEQ ID NO: 200200 - DNA, 10 bp, Unknown
  misc_feature (1)..( 10): Result.006 file - promoters50/5677484
ttatttaaat

SEQ ID NO: 200201 - DNA, 10 bp, Unknown
  misc_feature (1)..( 10): Result.006 file - promoters50/5677484
ttctttaaaa

SEQ ID NO: 200202 - DNA, 10 bp, Unknown
  misc_feature (1)..( 10): Result.006 file - promoters50/5677484
tgtcttaaat

SEQ ID NO: 200203 - DNA, 11 bp, Unknown
  misc_feature (1)..( 11): Result.006 file - promoters50/5677484
ttctttgaaat

SEQ ID NO: 200204 - DNA, 11 bp, Unknown
  misc_feature (1)..( 11): Result.006 file - promoters50/5677484
tcatttttttc

SEQ ID NO: 200205 - DNA, 11 bp, Unknown
  misc_feature (1)..( 11): Result.006 file - promoters50/5677501
cggtttgtttg

SEQ ID NO: 200206 - DNA, 8 bp, Unknown
  misc_feature (1)..( 8): Result.006 file - promoters50/5677501
atcagaaa

SEQ ID NO: 200207 - DNA, 8 bp, Unknown
  misc_feature (1)..( 8): Result.006 file - promoters50/5677501
ttcataaa

SEQ ID NO: 200208 - DNA, 8 bp, Unknown
  misc_feature (1)..( 8): Result.006 file - promoters50/5680986
atcagatc

SEQ ID NO: 200209 - DNA, 11 bp, Unknown
  misc_feature (1)..( 11): Result.006 file - promoters50/5680986
attctagattg

SEQ ID NO: 200210 - DNA, 11 bp, Unknown
  misc_feature (1)..( 11): Result.006 file - promoters50/5680986
gttcttgataa

SEQ ID NO: 200211 - DNA, 11 bp, Unknown
  misc_feature (1)..( 11): Result.006 file - promoters50/5680986
tatctagaaga

SEQ ID NO: 200212 - DNA, 11 bp, Unknown
  misc_feature (1)..( 11): Result.006 file - promoters50/5680986
acactacatta

SEQ ID NO: 200213 - DNA, 11 bp, Unknown
  misc_feature (1)..( 11): Result.006 file - promoters50/5680986
agtccacatta

SEQ ID NO: 200214 - DNA, 11 bp, Unknown
  misc_feature (1)..( 11): Result.006 file - promoters50/5681002
gttcttcttac

SEQ ID NO: 200215 - DNA, 16 bp, Unknown
  misc_feature (1)..( 16): Result.006 file - promoters50/5681002
gaagtgttgcttatca

SEQ ID NO: 200216 - DNA, 16 bp, Unknown
  misc_feature (1)..( 16): Result.006 file - promoters50/5681002
aaaaagttgattaaat

SEQ ID NO: 200217 - DNA, 16 bp, Unknown
  misc_feature (1)..( 16): Result.006 file - promoters50/5681002
aaaaagatgatttaat

SEQ ID NO: 200218 - DNA, 10 bp, Unknown
  misc_feature (1)..( 10): Result.006 file - promoters50/5681002
tatttaaatt

SEQ ID NO: 200219 - DNA, 10 bp, Unknown
  misc_feature (1)..( 10): Result.006 file - promoters50/5681002
tatataatga

SEQ ID NO: 200220 - DNA, 10 bp, Unknown
  misc_feature (1)..( 10): Result.006 file - promoters50/5681002
tatttaaata

SEQ ID NO: 200221 - DNA, 10 bp, Unknown
  misc_feature (1)..( 10): Result.006 file - promoters50/5681002
taaacttaac

SEQ ID NO: 200222 - DNA, 10 bp, Unknown
  misc_feature (1)..( 10): Result.006 file - promoters50/5681002
taaatttatt

SEQ ID NO: 200223 - DNA, 10 bp, Unknown
  misc_feature (1)..( 10): Result.006 file - promoters50/5681002
gaaaatgaat

SEQ ID NO: 200224 - DNA, 7 bp, Unknown
  misc_feature (1)..( 7): Result.006 file - promoters50/5681002
ttattgt

SEQ ID NO: 200225 - DNA, 7 bp, Unknown
  misc_feature (1)..( 7): Result.006 file - promoters50/5681002
gtattgt

SEQ ID NO: 200226 - DNA, 7 bp, Unknown
  misc_feature (1)..( 7): Result.006 file - promoters50/5681157
gtattgg

SEQ ID NO: 200227 - DNA, 10 bp, Unknown
  misc_feature (1)..( 10): Result.006 file - promoters50/5681157
accttaaaaa

SEQ ID NO: 200228 - DNA, 10 bp, Unknown
  misc_feature (1)..( 10): Result.006 file - promoters50/5681157
accttaaaaa

SEQ ID NO: 200229 - DNA, 10 bp, Unknown
  misc_feature (1)..( 10): Result.006 file - promoters50/5681157
catttaaaat

SEQ ID NO: 200230 - DNA, 6 bp, Unknown
  misc_feature (1)..( 6): Result.006 file - promoters50/5681157
ttaaaa

SEQ ID NO: 200231 - DNA, 6 bp, Unknown
  misc_feature (1)..( 6): Result.006 file - promoters50/5681157
ttaaaa

SEQ ID NO: 200232 - DNA, 6 bp, Unknown
  misc_feature (1)..( 6): Result.006 file - promoters50/5681157
ttaaaa

SEQ ID NO: 200233 - DNA, 10 bp, Unknown
  misc_feature (1)..( 10): Result.006 file - promoters50/5681157
ggaaattaaa

SEQ ID NO: 200234 - DNA, 10 bp, Unknown
  misc_feature (1)..( 10): Result.006 file - promoters50/5681157
acaaaataaa

SEQ ID NO: 200235 - DNA, 10 bp, Unknown
  misc_feature (1)..( 10): Result.006 file - promoters50/5681157
ttaaaatagt

SEQ ID NO: 200236 - DNA, 11 bp, Unknown
  misc_feature (1)..( 11): Result.006 file - promoters50/5681157
ataaacctaaa

SEQ ID NO: 200237 - DNA, 11 bp, Unknown
  misc_feature (1)..( 11): Result.006 file - promoters50/5681157
ataaaccaaaa

SEQ ID NO: 200238 - DNA, 11 bp, Unknown
  misc_feature (1)..( 11): Result.006 file - promoters50/5681157
ttaaaccattc

SEQ ID NO: 200239 - DNA, 9 bp, Unknown
  misc_feature (1)..( 9): Result.006 file - promoters50/5681157
aaaataaac

SEQ ID NO: 200240 - DNA, 9 bp, Unknown
  misc_feature (1)..( 9): Result.006 file - promoters50/5681157
aaaatatga

SEQ ID NO: 200241 - DNA, 9 bp, Unknown
  misc_feature (1)..( 9): Result.006 file - promoters50/5681157
aaattaaac

SEQ ID NO: 200242 - DNA, 10 bp, Unknown
  misc_feature (1)..( 10): Result.006 file - promoters50/5681157
tttgtaatat

SEQ ID NO: 200243 - DNA, 10 bp, Unknown
  misc_feature (1)..( 10): Result.006 file - promoters50/5681157
aatgtattat

SEQ ID NO: 200244 - DNA, 10 bp, Unknown
  misc_feature (1)..( 10): Result.006 file - promoters50/5681157
tttttaaaaa

SEQ ID NO: 200245 - DNA, 9 bp, Unknown
  misc_feature (1)..( 9): Result.006 file - promoters50/5681157
atttaaaaa

SEQ ID NO: 200246 - DNA, 9 bp, Unknown
  misc_feature (1)..( 9): Result.006 file - promoters50/5681157
attcaaaaa

SEQ ID NO: 200247 - DNA, 9 bp, Unknown
  misc_feature (1)..( 9): Result.006 file - promoters50/5681157
atttaaaaa

SEQ ID NO: 200248 - DNA, 10 bp, Unknown
  misc_feature (1)..( 10): Result.006 file - promoters50/5681157
attaccaatt

SEQ ID NO: 200249 - DNA, 10 bp, Unknown
  misc_feature (1)..( 10): Result.006 file - promoters50/5681157
attagcaatg

SEQ ID NO: 200250 - DNA, 10 bp, Unknown
  misc_feature (1)..( 10): Result.006 file - promoters50/5753942
cctagctatg

SEQ ID NO: 200251 - DNA, 8 bp, Unknown
  misc_feature (1)..( 8): Result.006 file - promoters50/5753942
caatcaaa

SEQ ID NO: 200252 - DNA, 8 bp, Unknown
  misc_feature (1)..( 8): Result.006 file - promoters50/5753942
caaacaaa

SEQ ID NO: 200253 - DNA, 8 bp, Unknown
  misc_feature (1)..( 8): Result.006 file - promoters50/5753942
taattaaa

SEQ ID NO: 200254 - DNA, 8 bp, Unknown
  misc_feature (1)..( 8): Result.006 file - promoters50/5753942
caaccaac

SEQ ID NO: 200255 - DNA, 8 bp, Unknown
  misc_feature (1)..( 8): Result.006 file - promoters50/5753942
caatcagt

SEQ ID NO: 200256 - DNA, 8 bp, Unknown
  misc_feature (1)..( 8): Result.006 file - promoters50/5753942
gaaacaaa

SEQ ID NO: 200257 - DNA, 12 bp, Unknown
  misc_feature (1)..( 12): Result.006 file - promoters50/5753942
tttttgtttctc

SEQ ID NO: 200258 - DNA, 12 bp, Unknown
  misc_feature (1)..( 12): Result.006 file - promoters50/5753942
atttagttttat

SEQ ID NO: 200259 - DNA, 12 bp, Unknown
  misc_feature (1)..( 12): Result.006 file - promoters50/5753942
cttttttttttt

SEQ ID NO: 200260 - DNA, 12 bp, Unknown
  misc_feature (1)..( 12): Result.006 file - promoters50/5753942
tttttgttgttg

SEQ ID NO: 200261 - DNA, 12 bp, Unknown
  misc_feature (1)..( 12): Result.006 file - promoters50/5753942
attaagtgtcaa

SEQ ID NO: 200262 - DNA, 12 bp, Unknown
  misc_feature (1)..( 12): Result.006 file - promoters50/5753942
attttgtgaagt

SEQ ID NO: 200263 - DNA, 10 bp, Unknown
  misc_feature (1)..( 10): Result.006 file - promoters50/5753942
attaataaat

SEQ ID NO: 200264 - DNA, 10 bp, Unknown
  misc_feature (1)..( 10): Result.006 file - promoters50/5753942
gaaaataaac

SEQ ID NO: 200265 - DNA, 10 bp, Unknown
  misc_feature (1)..( 10): Result.006 file - promoters50/5753942
aataataact

SEQ ID NO: 200266 - DNA, 10 bp, Unknown
  misc_feature (1)..( 10): Result.006 file - promoters50/5753942
attaatgaat

SEQ ID NO: 200267 - DNA, 10 bp, Unknown
  misc_feature (1)..( 10): Result.006 file - promoters50/5753942
attaattaat

SEQ ID NO: 200268 - DNA, 10 bp, Unknown
  misc_feature (1)..( 10): Result.006 file - promoters50/5753942
taaaacaaaa

SEQ ID NO: 200269 - DNA, 9 bp, Unknown
  misc_feature (1)..( 9): Result.006 file - promoters50/5753942
acaattgta

SEQ ID NO: 200270 - DNA, 9 bp, Unknown
  misc_feature (1)..( 9): Result.006 file - promoters50/5753942
tacattgta

SEQ ID NO: 200271 - DNA, 9 bp, Unknown
  misc_feature (1)..( 9): Result.006 file - promoters50/5753942
caaattgta

SEQ ID NO: 200272 - DNA, 9 bp, Unknown
  misc_feature (1)..( 9): Result.006 file - promoters50/5753942
taccttgtt

SEQ ID NO: 200273 - DNA, 9 bp, Unknown
  misc_feature (1)..( 9): Result.006 file - promoters50/5753942
tccattgtt

SEQ ID NO: 200274 - DNA, 9 bp, Unknown
  misc_feature (1)..( 9): Result.006 file - promoters50/5753942
tcacttgtt

SEQ ID NO: 200275 - DNA, 11 bp, Unknown
  misc_feature (1)..( 11): Result.006 file - promoters50/5753942
gaatttggtgg

SEQ ID NO: 200276 - DNA, 11 bp, Unknown
  misc_feature (1)..( 11): Result.006 file - promoters50/5753942
gaatttaagaa

SEQ ID NO: 200277 - DNA, 11 bp, Unknown
  misc_feature (1)..( 11): Result.006 file - promoters50/5753942
taatttgggct

SEQ ID NO: 200278 - DNA, 11 bp, Unknown
  misc_feature (1)..( 11): Result.006 file - promoters50/5753942
tattttaggcc

SEQ ID NO: 200279 - DNA, 11 bp, Unknown
  misc_feature (1)..( 11): Result.006 file - promoters50/5753942
gtatttgggcc

SEQ ID NO: 200280 - DNA, 11 bp, Unknown
  misc_feature (1)..( 11): Result.006 file - promoters50/5754265
atatttggatt

SEQ ID NO: 200281 - DNA, 12 bp, Unknown
  misc_feature (1)..( 12): Result.006 file - promoters50/5754265
cgatcttgtata

SEQ ID NO: 200282 - DNA, 12 bp, Unknown
  misc_feature (1)..( 12): Result.006 file - promoters50/5754265
tgattttggttt

SEQ ID NO: 200283 - DNA, 12 bp, Unknown
  misc_feature (1)..( 12): Result.006 file - promoters50/5754265
tgatttttctat

SEQ ID NO: 200284 - DNA, 12 bp, Unknown
  misc_feature (1)..( 12): Result.006 file - promoters50/5754265
cacttttgtttt

SEQ ID NO: 200285 - DNA, 12 bp, Unknown
  misc_feature (1)..( 12): Result.006 file - promoters50/5754265
ctctattgtttt

SEQ ID NO: 200286 - DNA, 12 bp, Unknown
  misc_feature (1)..( 12): Result.006 file - promoters50/5754269
aatgtttgttta

SEQ ID NO: 200287 - DNA, 12 bp, Unknown
  misc_feature (1)..( 12): Result.006 file - promoters50/5754269
gattattgttca

SEQ ID NO: 200288 - DNA, 12 bp, Unknown
  misc_feature (1)..( 12): Result.006 file - promoters50/5754269
gattatggacta

SEQ ID NO: 200289 - DNA, 12 bp, Unknown
  misc_feature (1)..( 12): Result.006 file - promoters50/5754269
tattttggaatt

SEQ ID NO: 200290 - DNA, 13 bp, Unknown
  misc_feature (1)..( 13): Result.006 file - promoters50/5754269
aatcttttaaaaa

SEQ ID NO: 200291 - DNA, 13 bp, Unknown
  misc_feature (1)..( 13): Result.006 file - promoters50/5754269
tatatattgcaat

SEQ ID NO: 200292 - DNA, 13 bp, Unknown
  misc_feature (1)..( 13): Result.006 file - promoters50/5754273
cgatggttgcaaa

SEQ ID NO: 200293 - DNA, 10 bp, Unknown
  misc_feature (1)..( 10): Result.006 file - promoters50/5754273
aaataaatta

SEQ ID NO: 200294 - DNA, 10 bp, Unknown
  misc_feature (1)..( 10): Result.006 file - promoters50/5754273
aaacaaattt

SEQ ID NO: 200295 - DNA, 10 bp, Unknown
  misc_feature (1)..( 10): Result.006 file - promoters50/5754273
ttcaaaatta

SEQ ID NO: 200296 - DNA, 10 bp, Unknown
  misc_feature (1)..( 10): Result.006 file - promoters50/5754273
aaaaaaattg

SEQ ID NO: 200297 - DNA, 10 bp, Unknown
  misc_feature (1)..( 10): Result.006 file - promoters50/5754273
gaaaaaatag

SEQ ID NO: 200298 - DNA, 10 bp, Unknown
  misc_feature (1)..( 10): Result.006 file - promoters50/5754276
taaaaaacac

SEQ ID NO: 200299 - DNA, 8 bp, Unknown
  misc_feature (1)..( 8): Result.006 file - promoters50/5754276
aaatcgat

SEQ ID NO: 200300 - DNA, 8 bp, Unknown
  misc_feature (1)..( 8): Result.006 file - promoters50/5754276
aaatcgta

SEQ ID NO: 200301 - DNA, 8 bp, Unknown
  misc_feature (1)..( 8): Result.006 file - promoters50/5754276
caattgat

SEQ ID NO: 200302 - DNA, 9 bp, Unknown
  misc_feature (1)..( 9): Result.006 file - promoters50/5754276
tctgtttgt

SEQ ID NO: 200303 - DNA, 9 bp, Unknown
  misc_feature (1)..( 9): Result.006 file - promoters50/5754276
tctatttgt

SEQ ID NO: 200304 - DNA, 9 bp, Unknown
  misc_feature (1)..( 9): Result.006 file - promoters50/5754280
tttatttga

SEQ ID NO: 200305 - DNA, 13 bp, Unknown
  misc_feature (1)..( 13): Result.006 file - promoters50/5754280
ccaaaagaaacga

SEQ ID NO: 200306 - DNA, 13 bp, Unknown
  misc_feature (1)..( 13): Result.006 file - promoters50/5754280
agaaatgaaatca

SEQ ID NO: 200307 - DNA, 13 bp, Unknown
  misc_feature (1)..( 13): Result.006 file - promoters50/5754280
acaatagagattg

SEQ ID NO: 200308 - DNA, 13 bp, Unknown
  misc_feature (1)..( 13): Result.006 file - promoters50/5754280
ccaaaagtttata

SEQ ID NO: 200309 - DNA, 13 bp, Unknown
  misc_feature (1)..( 13): Result.006 file - promoters50/5754280
agcttagatatga

SEQ ID NO: 200310 - DNA, 13 bp, Unknown
  misc_feature (1)..( 13): Result.006 file - promoters50/5754288
gtgtatgatcaca

SEQ ID NO: 200311 - DNA, 8 bp, Unknown
  misc_feature (1)..( 8): Result.006 file - promoters50/5754288
tacaaaaa

SEQ ID NO: 200312 - DNA, 8 bp, Unknown
  misc_feature (1)..( 8): Result.006 file - promoters50/5754288
tacaaaaa

SEQ ID NO: 200313 - DNA, 8 bp, Unknown
  misc_feature (1)..( 8): Result.006 file - promoters50/5754288
cacaaaat

SEQ ID NO: 200314 - DNA, 10 bp, Unknown
  misc_feature (1)..( 10): Result.006 file - promoters50/5754288
ttattatata

SEQ ID NO: 200315 - DNA, 10 bp, Unknown
  misc_feature (1)..( 10): Result.006 file - promoters50/5754288
ttaatatttt

SEQ ID NO: 200316 - DNA, 10 bp, Unknown
  misc_feature (1)..( 10): Result.006 file - promoters50/5754288
ttattttata

SEQ ID NO: 200317 - DNA, 11 bp, Unknown
  misc_feature (1)..( 11): Result.006 file - promoters50/5754288
ttgaatgtttc

SEQ ID NO: 200318 - DNA, 11 bp, Unknown
  misc_feature (1)..( 11): Result.006 file - promoters50/5754288
ttgaatatttc

SEQ ID NO: 200319 - DNA, 11 bp, Unknown
  misc_feature (1)..( 11): Result.006 file - promoters50/5754419
ttggatagttt

SEQ ID NO: 200320 - DNA, 14 bp, Unknown
  misc_feature (1)..( 14): Result.006 file - promoters50/5754419
atacaatgatattg

SEQ ID NO: 200321 - DNA, 14 bp, Unknown
  misc_feature (1)..( 14): Result.006 file - promoters50/5754419
aaataattatacag

SEQ ID NO: 200322 - DNA, 14 bp, Unknown
  misc_feature (1)..( 14): Result.006 file - promoters50/5754419
tctcagtgattttg

SEQ ID NO: 200323 - DNA, 14 bp, Unknown
  misc_feature (1)..( 14): Result.006 file - promoters50/5754419
ataaaatgttatgc

SEQ ID NO: 200324 - DNA, 14 bp, Unknown
  misc_feature (1)..( 14): Result.006 file - promoters50/5754419
ttgtaataataact

SEQ ID NO: 200325 - DNA, 14 bp, Unknown
  misc_feature (1)..( 14): Result.006 file - promoters50/5754419
cgttattaataaat

SEQ ID NO: 200326 - DNA, 14 bp, Unknown
  misc_feature (1)..( 14): Result.006 file - promoters50/5754419
ctaaattaaaattt

SEQ ID NO: 200327 - DNA, 15 bp, Unknown
  misc_feature (1)..( 15): Result.006 file - promoters50/5754419
atcgagagaagatgt

SEQ ID NO: 200328 - DNA, 15 bp, Unknown
  misc_feature (1)..( 15): Result.006 file - promoters50/5754419
tattagagaaattta

SEQ ID NO: 200329 - DNA, 15 bp, Unknown
  misc_feature (1)..( 15): Result.006 file - promoters50/5754419
tattacagaaaaatc

SEQ ID NO: 200330 - DNA, 15 bp, Unknown
  misc_feature (1)..( 15): Result.006 file - promoters50/5754419
cggaagaaaaattac

SEQ ID NO: 200331 - DNA, 15 bp, Unknown
  misc_feature (1)..( 15): Result.006 file - promoters50/5754419
caacatagaaagtta

SEQ ID NO: 200332 - DNA, 15 bp, Unknown
  misc_feature (1)..( 15): Result.006 file - promoters50/5754419
agtaactaaaattag

SEQ ID NO: 200333 - DNA, 10 bp, Unknown
  misc_feature (1)..( 10): Result.006 file - promoters50/5754419
tttataatat

SEQ ID NO: 200334 - DNA, 10 bp, Unknown
  misc_feature (1)..( 10): Result.006 file - promoters50/5754419
gttataaagg

SEQ ID NO: 200335 - DNA, 11 bp, Unknown
  misc_feature (1)..( 11): Result.006 file - promoters50/5754419
attaataatac

SEQ ID NO: 200336 - DNA, 11 bp, Unknown
  misc_feature (1)..( 11): Result.006 file - promoters50/5754419
tttaaaaactt

SEQ ID NO: 200337 - DNA, 11 bp, Unknown
  misc_feature (1)..( 11): Result.006 file - promoters50/5754419
aaaaatactta

SEQ ID NO: 200338 - DNA, 11 bp, Unknown
  misc_feature (1)..( 11): Result.006 file - promoters50/5754419
tacaataatac

SEQ ID NO: 200339 - DNA, 8 bp, Unknown
  misc_feature (1)..( 8): Result.006 file - promoters50/5754419
taatatat

SEQ ID NO: 200340 - DNA, 8 bp, Unknown
  misc_feature (1)..( 8): Result.006 file - promoters50/5754419
taagatat

SEQ ID NO: 200341 - DNA, 8 bp, Unknown
  misc_feature (1)..( 8): Result.006 file - promoters50/5754419
taatatgg

SEQ ID NO: 200342 - DNA, 8 bp, Unknown
  misc_feature (1)..( 8): Result.006 file - promoters50/5754419
caatatat

SEQ ID NO: 200343 - DNA, 8 bp, Unknown
  misc_feature (1)..( 8): Result.006 file - promoters50/5754419
aaatatag

SEQ ID NO: 200344 - DNA, 8 bp, Unknown
  misc_feature (1)..( 8): Result.006 file - promoters50/5754423
ggagatat

SEQ ID NO: 200345 - DNA, 14 bp, Unknown
  misc_feature (1)..( 14): Result.006 file - promoters50/5754423
ttatgttcctaatt

SEQ ID NO: 200346 - DNA, 14 bp, Unknown
  misc_feature (1)..( 14): Result.006 file - promoters50/5754423
ttatcttccatata

SEQ ID NO: 200347 - DNA, 14 bp, Unknown
  misc_feature (1)..( 14): Result.006 file - promoters50/5754461
cgctctaccaaata

SEQ ID NO: 200348 - DNA, 11 bp, Unknown
  misc_feature (1)..( 11): Result.006 file - promoters50/5754461
attaaatttta

SEQ ID NO: 200349 - DNA, 11 bp, Unknown
  misc_feature (1)..( 11): Result.006 file - promoters50/5754461
tataaattaaa

SEQ ID NO: 200350 - DNA, 11 bp, Unknown
  misc_feature (1)..( 11): Result.006 file - promoters50/5754461
aataaaataaa

SEQ ID NO: 200351 - DNA, 11 bp, Unknown
  misc_feature (1)..( 11): Result.006 file - promoters50/5754461
aaaaaactaat

SEQ ID NO: 200352 - DNA, 11 bp, Unknown
  misc_feature (1)..( 11): Result.006 file - promoters50/5754461
tatgaattatg

SEQ ID NO: 200353 - DNA, 12 bp, Unknown
  misc_feature (1)..( 12): Result.006 file - promoters50/5754461
gaaaaagctaat

SEQ ID NO: 200354 - DNA, 12 bp, Unknown
  misc_feature (1)..( 12): Result.006 file - promoters50/5754461
gcccaaaataat

SEQ ID NO: 200355 - DNA, 10 bp, Unknown
  misc_feature (1)..( 10): Result.006 file - promoters50/5754461
cataacaatt

SEQ ID NO: 200356 - DNA, 10 bp, Unknown
  misc_feature (1)..( 10): Result.006 file - promoters50/5754461
catcacaatt

SEQ ID NO: 200357 - DNA, 10 bp, Unknown
  misc_feature (1)..( 10): Result.006 file - promoters50/5754461
agtaataatg

SEQ ID NO: 200358 - DNA, 10 bp, Unknown
  misc_feature (1)..( 10): Result.006 file - promoters50/5754461
gtcaatgatg

SEQ ID NO: 200359 - DNA, 10 bp, Unknown
  misc_feature (1)..( 10): Result.006 file - promoters50/5754461
cataataacc

SEQ ID NO: 200360 - DNA, 10 bp, Unknown
  misc_feature (1)..( 10): Result.006 file - promoters50/5754461
gctaataacg

SEQ ID NO: 200361 - DNA, 13 bp, Unknown
  misc_feature (1)..( 13): Result.006 file - promoters50/5754461
aaaaaatttatat

SEQ ID NO: 200362 - DNA, 13 bp, Unknown
  misc_feature (1)..( 13): Result.006 file - promoters50/5754461
caaaaatgtatat

SEQ ID NO: 200363 - DNA, 13 bp, Unknown
  misc_feature (1)..( 13): Result.006 file - promoters50/5754461
caataatttgttt

SEQ ID NO: 200364 - DNA, 13 bp, Unknown
  misc_feature (1)..( 13): Result.006 file - promoters50/5754461
gatgaatgtactg

SEQ ID NO: 200365 - DNA, 13 bp, Unknown
  misc_feature (1)..( 13): Result.006 file - promoters50/5754461
tgctaatgtttat

SEQ ID NO: 200366 - DNA, 13 bp, Unknown
  misc_feature (1)..( 13): Result.006 file - promoters50/5755107
ttttaatttatca

SEQ ID NO: 200367 - DNA, 7 bp, Unknown
  misc_feature (1)..( 7): Result.006 file - promoters50/5755107
tgttttg

SEQ ID NO: 200368 - DNA, 7 bp, Unknown
  misc_feature (1)..( 7): Result.006 file - promoters50/5755107
ggttttg

SEQ ID NO: 200369 - DNA, 7 bp, Unknown
  misc_feature (1)..( 7): Result.006 file - promoters50/5755107
ggtttta

SEQ ID NO: 200370 - DNA, 7 bp, Unknown
  misc_feature (1)..( 7): Result.006 file - promoters50/5755107
gtgttta

SEQ ID NO: 200371 - DNA, 7 bp, Unknown
  misc_feature (1)..( 7): Result.006 file - promoters50/5755107
gtgtttc

SEQ ID NO: 200372 - DNA, 7 bp, Unknown
  misc_feature (1)..( 7): Result.006 file - promoters50/5755107
atgtttc

SEQ ID NO: 200373 - DNA, 11 bp, Unknown
  misc_feature (1)..( 11): Result.006 file - promoters50/5755107
ggaatgaagat

SEQ ID NO: 200374 - DNA, 11 bp, Unknown
  misc_feature (1)..( 11): Result.006 file - promoters50/5755107
acaattaagcc

SEQ ID NO: 200375 - DNA, 11 bp, Unknown
  misc_feature (1)..( 11): Result.006 file - promoters50/5755107
acaattcagcc

SEQ ID NO: 200376 - DNA, 6 bp, Unknown
  misc_feature (1)..( 6): Result.006 file - promoters50/5755107
attgga

SEQ ID NO: 200377 - DNA, 6 bp, Unknown
  misc_feature (1)..( 6): Result.006 file - promoters50/5755107
attgga

SEQ ID NO: 200378 - DNA, 6 bp, Unknown
  misc_feature (1)..( 6): Result.006 file - promoters50/5755107
attgga

SEQ ID NO: 200379 - DNA, 7 bp, Unknown
  misc_feature (1)..( 7): Result.006 file - promoters50/5755107
aaagaat

SEQ ID NO: 200380 - DNA, 7 bp, Unknown
  misc_feature (1)..( 7): Result.006 file - promoters50/5755107
aaacaat

SEQ ID NO: 200381 - DNA, 7 bp, Unknown
  misc_feature (1)..( 7): Result.006 file - promoters50/5755107
aaataat

SEQ ID NO: 200382 - DNA, 7 bp, Unknown
  misc_feature (1)..( 7): Result.006 file - promoters50/5755107
tttcatt

SEQ ID NO: 200383 - DNA, 7 bp, Unknown
  misc_feature (1)..( 7): Result.006 file - promoters50/5755107
tttcata

SEQ ID NO: 200384 - DNA, 7 bp, Unknown
  misc_feature (1)..( 7): Result.006 file - promoters50/5755846
tttgata

SEQ ID NO: 200385 - DNA, 15 bp, Unknown
  misc_feature (1)..( 15): Result.006 file - promoters50/5755846
ctctgaaacatatga

SEQ ID NO: 200386 - DNA, 15 bp, Unknown
  misc_feature (1)..( 15): Result.006 file - promoters50/5755846
ctctaaaacaaaata

SEQ ID NO: 200387 - DNA, 15 bp, Unknown
  misc_feature (1)..( 15): Result.006 file - promoters50/5755846
ttcttaaagaataat

SEQ ID NO: 200388 - DNA, 15 bp, Unknown
  misc_feature (1)..( 15): Result.006 file - promoters50/5755846
tgtccaaacaaagtc

SEQ ID NO: 200389 - DNA, 15 bp, Unknown
  misc_feature (1)..( 15): Result.006 file - promoters50/5755846
aacacaaactaagtc

SEQ ID NO: 200390 - DNA, 11 bp, Unknown
  misc_feature (1)..( 11): Result.006 file - promoters50/5755846
attgtatgatt

SEQ ID NO: 200391 - DNA, 11 bp, Unknown
  misc_feature (1)..( 11): Result.006 file - promoters50/5755846
attttatcaat

SEQ ID NO: 200392 - DNA, 11 bp, Unknown
  misc_feature (1)..( 11): Result.006 file - promoters50/5755846
atttgatctct

SEQ ID NO: 200393 - DNA, 11 bp, Unknown
  misc_feature (1)..( 11): Result.006 file - promoters50/5755846
ctttgatcaaa

SEQ ID NO: 200394 - DNA, 11 bp, Unknown
  misc_feature (1)..( 11): Result.006 file - promoters50/5756166
aaatgagctct

SEQ ID NO: 200395 - DNA, 10 bp, Unknown
  misc_feature (1)..( 10): Result.006 file - promoters50/5756166
acctcttaat

SEQ ID NO: 200396 - DNA, 10 bp, Unknown
  misc_feature (1)..( 10): Result.006 file - promoters50/5756166
tcttcttaaa

SEQ ID NO: 200397 - DNA, 10 bp, Unknown
  misc_feature (1)..( 10): Result.006 file - promoters50/5756166
ctctctaaaa

SEQ ID NO: 200398 - DNA, 10 bp, Unknown
  misc_feature (1)..( 10): Result.006 file - promoters50/5756166
tcttgttaat

SEQ ID NO: 200399 - DNA, 10 bp, Unknown
  misc_feature (1)..( 10): Result.006 file - promoters50/5756166
gtttcttatg

SEQ ID NO: 200400 - DNA, 10 bp, Unknown
  misc_feature (1)..( 10): Result.006 file - promoters50/5756166
tttttttatt

SEQ ID NO: 200401 - DNA, 10 bp, Unknown
  misc_feature (1)..( 10): Result.006 file - promoters50/5756166
atatgtcaat

SEQ ID NO: 200402 - DNA, 11 bp, Unknown
  misc_feature (1)..( 11): Result.006 file - promoters50/5756166
attatttcaca

SEQ ID NO: 200403 - DNA, 11 bp, Unknown
  misc_feature (1)..( 11): Result.006 file - promoters50/5756166
tttatttcctc

SEQ ID NO: 200404 - DNA, 11 bp, Unknown
  misc_feature (1)..( 11): Result.006 file - promoters50/5756166
taaatttcaca

SEQ ID NO: 200405 - DNA, 11 bp, Unknown
  misc_feature (1)..( 11): Result.006 file - promoters50/5756166
tatatgtcaat

SEQ ID NO: 200406 - DNA, 11 bp, Unknown
  misc_feature (1)..( 11): Result.006 file - promoters50/5756166
tttgtttttgg

SEQ ID NO: 200407 - DNA, 11 bp, Unknown
  misc_feature (1)..( 11): Result.006 file - promoters50/5756489
cttgttaatat

SEQ ID NO: 200408 - DNA, 8 bp, Unknown
  misc_feature (1)..( 8): Result.006 file - promoters50/5756489
aaaatctc

SEQ ID NO: 200409 - DNA, 8 bp, Unknown
  misc_feature (1)..( 8): Result.006 file - promoters50/5756489
aaactcta

SEQ ID NO: 200410 - DNA, 8 bp, Unknown
  misc_feature (1)..( 8): Result.006 file - promoters50/5756489
aaaataat

SEQ ID NO: 200411 - DNA, 15 bp, Unknown
  misc_feature (1)..( 15): Result.006 file - promoters50/5756489
caaagtgaattattc

SEQ ID NO: 200412 - DNA, 15 bp, Unknown
  misc_feature (1)..( 15): Result.006 file - promoters50/5756489
taatatcttttattc

SEQ ID NO: 200413 - DNA, 15 bp, Unknown
  misc_feature (1)..( 15): Result.006 file - promoters50/5756489
caaaatgaaatattt

SEQ ID NO: 200414 - DNA, 9 bp, Unknown
  misc_feature (1)..( 9): Result.006 file - promoters50/5756489
actaatttt

SEQ ID NO: 200415 - DNA, 9 bp, Unknown
  misc_feature (1)..( 9): Result.006 file - promoters50/5756489
actaataaa

SEQ ID NO: 200416 - DNA, 9 bp, Unknown
  misc_feature (1)..( 9): Result.006 file - promoters50/5756489
tctaacaaa

SEQ ID NO: 200417 - DNA, 8 bp, Unknown
  misc_feature (1)..( 8): Result.006 file - promoters50/5756489
taatttac

SEQ ID NO: 200418 - DNA, 8 bp, Unknown
  misc_feature (1)..( 8): Result.006 file - promoters50/5756489
agatttac

SEQ ID NO: 200419 - DNA, 8 bp, Unknown
  misc_feature (1)..( 8): Result.006 file - promoters50/5756489
taatttat

SEQ ID NO: 200420 - DNA, 10 bp, Unknown
  misc_feature (1)..( 10): Result.006 file - promoters50/5756489
taataattta

SEQ ID NO: 200421 - DNA, 10 bp, Unknown
  misc_feature (1)..( 10): Result.006 file - promoters50/5756489
aaataataaa

SEQ ID NO: 200422 - DNA, 10 bp, Unknown
  misc_feature (1)..( 10): Result.006 file - promoters50/5756489
aaatactaaa

SEQ ID NO: 200423 - DNA, 9 bp, Unknown
  misc_feature (1)..( 9): Result.006 file - promoters50/5756489
atatattta

SEQ ID NO: 200424 - DNA, 9 bp, Unknown
  misc_feature (1)..( 9): Result.006 file - promoters50/5756489
atatattct

SEQ ID NO: 200425 - DNA, 9 bp, Unknown
  misc_feature (1)..( 9): Result.006 file - promoters50/5756489
ctatactct

SEQ ID NO: 200426 - DNA, 8 bp, Unknown
  misc_feature (1)..( 8): Result.006 file - promoters50/5756489
aaatattc

SEQ ID NO: 200427 - DNA, 8 bp, Unknown
  misc_feature (1)..( 8): Result.006 file - promoters50/5756489
taatatta

SEQ ID NO: 200428 - DNA, 8 bp, Unknown
  misc_feature (1)..( 8): Result.006 file - promoters50/5756489
taatatct

SEQ ID NO: 200429 - DNA, 8 bp, Unknown
  misc_feature (1)..( 8): Result.006 file - promoters50/5756489
taatttta

SEQ ID NO: 200430 - DNA, 8 bp, Unknown
  misc_feature (1)..( 8): Result.006 file - promoters50/5756489
gtaacaaa

SEQ ID NO: 200431 - DNA, 8 bp, Unknown
  misc_feature (1)..( 8): Result.006 file - promoters50/5756489
ctaacaaa

SEQ ID NO: 200432 - DNA, 8 bp, Unknown
  misc_feature (1)..( 8): Result.006 file - promoters50/5758021
ctaataaa

SEQ ID NO: 200433 - DNA, 9 bp, Unknown
  misc_feature (1)..( 9): Result.006 file - promoters50/5758021
ttaacgatg

SEQ ID NO: 200434 - DNA, 9 bp, Unknown
  misc_feature (1)..( 9): Result.006 file - promoters50/5758021
ttatcgatt

SEQ ID NO: 200435 - DNA, 9 bp, Unknown
  misc_feature (1)..( 9): Result.006 file - promoters50/5758021
taaacgata

SEQ ID NO: 200436 - DNA, 9 bp, Unknown
  misc_feature (1)..( 9): Result.006 file - promoters50/5758021
aaaaagatg

SEQ ID NO: 200437 - DNA, 9 bp, Unknown
  misc_feature (1)..( 9): Result.006 file - promoters50/5758021
atatctatt

SEQ ID NO: 200438 - DNA, 9 bp, Unknown
  misc_feature (1)..( 9): Result.006 file - promoters50/5759305
acaactata

SEQ ID NO: 200439 - DNA, 12 bp, Unknown
  misc_feature (1)..( 12): Result.006 file - promoters50/5759305
taaggcaaattt

SEQ ID NO: 200440 - DNA, 12 bp, Unknown
  misc_feature (1)..( 12): Result.006 file - promoters50/5759305
taagccaaacgc

SEQ ID NO: 200441 - DNA, 12 bp, Unknown
  misc_feature (1)..( 12): Result.006 file - promoters50/5759305
ttttgcaatttt

SEQ ID NO: 200442 - DNA, 9 bp, Unknown
  misc_feature (1)..( 9): Result.006 file - promoters50/5759305
caaatttag

SEQ ID NO: 200443 - DNA, 9 bp, Unknown
  misc_feature (1)..( 9): Result.006 file - promoters50/5759305
gcaatctag

SEQ ID NO: 200444 - DNA, 9 bp, Unknown
  misc_feature (1)..( 9): Result.006 file - promoters50/5773091
gcaattttt

SEQ ID NO: 200445 - DNA, 15 bp, Unknown
  misc_feature (1)..( 15): Result.006 file - promoters50/5773091
aggactcagaccagt

SEQ ID NO: 200446 - DNA, 15 bp, Unknown
  misc_feature (1)..( 15): Result.006 file - promoters50/5773091
catcttcagacaaat

SEQ ID NO: 200447 - DNA, 15 bp, Unknown
  misc_feature (1)..( 15): Result.006 file - promoters50/5773091
cgtcctccgacgtgt

SEQ ID NO: 200448 - DNA, 15 bp, Unknown
  misc_feature (1)..( 15): Result.006 file - promoters50/5773091
tagattcagattcgg

SEQ ID NO: 200449 - DNA, 15 bp, Unknown
  misc_feature (1)..( 15): Result.006 file - promoters50/5773091
tagattcatattctt

SEQ ID NO: 200450 - DNA, 15 bp, Unknown
  misc_feature (1)..( 15): Result.006 file - promoters50/5773091
tggtgccattttctt

SEQ ID NO: 200451 - DNA, 11 bp, Unknown
  misc_feature (1)..( 11): Result.006 file - promoters50/5773091
tgacttggagc

SEQ ID NO: 200452 - DNA, 11 bp, Unknown
  misc_feature (1)..( 11): Result.006 file - promoters50/5773091
tgatttgattt

SEQ ID NO: 200453 - DNA, 11 bp, Unknown
  misc_feature (1)..( 11): Result.006 file - promoters50/5773091
tgacgtggaat

SEQ ID NO: 200454 - DNA, 11 bp, Unknown
  misc_feature (1)..( 11): Result.006 file - promoters50/5773091
ctattttatta

SEQ ID NO: 200455 - DNA, 11 bp, Unknown
  misc_feature (1)..( 11): Result.006 file - promoters50/5773091
caaatttatta

SEQ ID NO: 200456 - DNA, 11 bp, Unknown
  misc_feature (1)..( 11): Result.006 file - promoters50/5773091
gaaatttttta

SEQ ID NO: 200457 - DNA, 10 bp, Unknown
  misc_feature (1)..( 10): Result.006 file - promoters50/5773091
tgagtttttt

SEQ ID NO: 200458 - DNA, 10 bp, Unknown
  misc_feature (1)..( 10): Result.006 file - promoters50/5773091
tgattttttc

SEQ ID NO: 200459 - DNA, 10 bp, Unknown
  misc_feature (1)..( 10): Result.006 file - promoters50/5773091
aaatttttta

SEQ ID NO: 200460 - DNA, 11 bp, Unknown
  misc_feature (1)..( 11): Result.006 file - promoters50/5773091
ctattttatta

SEQ ID NO: 200461 - DNA, 11 bp, Unknown
  misc_feature (1)..( 11): Result.006 file - promoters50/5773091
caaatttatta

SEQ ID NO: 200462 - DNA, 11 bp, Unknown
  misc_feature (1)..( 11): Result.006 file - promoters50/5773759
ggaatatatta

SEQ ID NO: 200463 - DNA, 12 bp, Unknown
  misc_feature (1)..( 12): Result.006 file - promoters50/5773759
tttagcaaaaag

SEQ ID NO: 200464 - DNA, 12 bp, Unknown
  misc_feature (1)..( 12): Result.006 file - promoters50/5773759
cttagcaataaa

SEQ ID NO: 200465 - DNA, 12 bp, Unknown
  misc_feature (1)..( 12): Result.006 file - promoters50/5773759
tttaacaataag

SEQ ID NO: 200466 - DNA, 8 bp, Unknown
  misc_feature (1)..( 8): Result.006 file - promoters50/5773759
atatttag

SEQ ID NO: 200467 - DNA, 8 bp, Unknown
  misc_feature (1)..( 8): Result.006 file - promoters50/5773759
ttatttag

SEQ ID NO: 200468 - DNA, 8 bp, Unknown
  misc_feature (1)..( 8): Result.006 file - promoters50/5773759
cttttttt

SEQ ID NO: 200469 - DNA, 8 bp, Unknown
  misc_feature (1)..( 8): Result.006 file - promoters50/5773759
aatggcaa

SEQ ID NO: 200470 - DNA, 8 bp, Unknown
  misc_feature (1)..( 8): Result.006 file - promoters50/5773759
aatcgcat

SEQ ID NO: 200471 - DNA, 8 bp, Unknown
  misc_feature (1)..( 8): Result.006 file - promoters50/5773772
tttcgcat

SEQ ID NO: 200472 - DNA, 9 bp, Unknown
  misc_feature (1)..( 9): Result.006 file - promoters50/5773772
tacattact

SEQ ID NO: 200473 - DNA, 10 bp, Unknown
  misc_feature (1)..( 10): Result.006 file - promoters50/5773772
ttacattctt

SEQ ID NO: 200474 - DNA, 10 bp, Unknown
  misc_feature (1)..( 10): Result.006 file - promoters50/5773772
ttatattgtg

SEQ ID NO: 200475 - DNA, 10 bp, Unknown
  misc_feature (1)..( 10): Result.006 file - promoters50/5773772
ctaaatataa

SEQ ID NO: 200476 - DNA, 10 bp, Unknown
  misc_feature (1)..( 10): Result.006 file - promoters50/5773772
tgaaatcata

SEQ ID NO: 200477 - DNA, 10 bp, Unknown
  misc_feature (1)..( 10): Result.006 file - promoters50/5773772
ttatatactg

SEQ ID NO: 200478 - DNA, 7 bp, Unknown
  misc_feature (1)..( 7): Result.006 file - promoters50/5773772
tttgatt

SEQ ID NO: 200479 - DNA, 7 bp, Unknown
  misc_feature (1)..( 7): Result.006 file - promoters50/5773772
gttgatt

SEQ ID NO: 200480 - DNA, 7 bp, Unknown
  misc_feature (1)..( 7): Result.006 file - promoters50/5773772
tttgata

SEQ ID NO: 200481 - DNA, 7 bp, Unknown
  misc_feature (1)..( 7): Result.006 file - promoters50/5773772
tttgatt

SEQ ID NO: 200482 - DNA, 7 bp, Unknown
  misc_feature (1)..( 7): Result.006 file - promoters50/5773772
cttgatt

SEQ ID NO: 200483 - DNA, 7 bp, Unknown
  misc_feature (1)..( 7): Result.006 file - promoters50/5773772
ttttatt

SEQ ID NO: 200484 - DNA, 9 bp, Unknown
  misc_feature (1)..( 9): Result.006 file - promoters50/5773772
cttttttta

SEQ ID NO: 200485 - DNA, 9 bp, Unknown
  misc_feature (1)..( 9): Result.006 file - promoters50/5773772
attttttta

SEQ ID NO: 200486 - DNA, 9 bp, Unknown
  misc_feature (1)..( 9): Result.006 file - promoters50/5773772
ctttgtttg

SEQ ID NO: 200487 - DNA, 9 bp, Unknown
  misc_feature (1)..( 9): Result.006 file - promoters50/5773772
gtttttttt

SEQ ID NO: 200488 - DNA, 9 bp, Unknown
  misc_feature (1)..( 9): Result.006 file - promoters50/5773772
atttttcag

SEQ ID NO: 200489 - DNA, 9 bp, Unknown
  misc_feature (1)..( 9): Result.006 file - promoters50/5774459
attttttgt

SEQ ID NO: 200490 - DNA, 11 bp, Unknown
  misc_feature (1)..( 11): Result.006 file - promoters50/5774459
cgaaatcgatc

SEQ ID NO: 200491 - DNA, 11 bp, Unknown
  misc_feature (1)..( 11): Result.006 file - promoters50/5774459
ataaatcaatc

SEQ ID NO: 200492 - DNA, 11 bp, Unknown
  misc_feature (1)..( 11): Result.006 file - promoters50/5774459
ataactcattt

SEQ ID NO: 200493 - DNA, 8 bp, Unknown
  misc_feature (1)..( 8): Result.006 file - promoters50/5774459
tgcaatgg

SEQ ID NO: 200494 - DNA, 8 bp, Unknown
  misc_feature (1)..( 8): Result.006 file - promoters50/5774459
tgcagtgg

SEQ ID NO: 200495 - DNA, 8 bp, Unknown
  misc_feature (1)..( 8): Result.006 file - promoters50/5774459
tgcagtca

SEQ ID NO: 200496 - DNA, 10 bp, Unknown
  misc_feature (1)..( 10): Result.006 file - promoters50/5774459
tgtgttgtag

SEQ ID NO: 200497 - DNA, 10 bp, Unknown
  misc_feature (1)..( 10): Result.006 file - promoters50/5774459
tgttttgtta

SEQ ID NO: 200498 - DNA, 10 bp, Unknown
  misc_feature (1)..( 10): Result.006 file - promoters50/5774545
gcttttatta

SEQ ID NO: 200499 - DNA, 7 bp, Unknown
  misc_feature (1)..( 7): Result.006 file - promoters50/5774545
ttatatc

SEQ ID NO: 200500 - DNA, 7 bp, Unknown
  misc_feature (1)..( 7): Result.006 file - promoters50/5774545
ttatata

SEQ ID NO: 200501 - DNA, 8 bp, Unknown
  misc_feature (1)..( 8): Result.006 file - promoters50/5774545
ctatgata

SEQ ID NO: 200502 - DNA, 8 bp, Unknown
  misc_feature (1)..( 8): Result.006 file - promoters50/5774545
aatataaa

SEQ ID NO: 200503 - DNA, 8 bp, Unknown
  misc_feature (1)..( 8): Result.006 file - promoters50/5774545
tttataaa

SEQ ID NO: 200504 - DNA, 8 bp, Unknown
  misc_feature (1)..( 8): Result.006 file - promoters50/5774545
tttctaag

SEQ ID NO: 200505 - DNA, 19 bp, Artificial Sequence
  oligo(dT)18 primer
ttttttttttttttttttv

SEQ ID NO: 200506 - DNA, 19 bp, Artificial Sequence
  oligo dTV
  misc_feature (19)..(19)
ttttttttttttttttttn

SEQ ID NO: 200507 - DNA, 50 bp, Artificial Sequence
  Reamplification primer 99G24
cgccagggttttcccagtcacgacacgactcactgatgagtcctgagtaa

SEQ ID NO: 200508 - DNA, 49 bp, Artificial Sequence
  Reamplification primer 99G20
agcggataacaatttcacacaggacacactggtatagactgcgtaccga

SEQ ID NO: 200509 - DNA, 16 bp, Artificial Sequence
  AD2 primer used for TAIL-PCR
  misc_feature (1)..(1): n is a, c, g, or t
  misc_feature (11)..(11): n is a, c, g, or t
ngtcgaswganawgaa

SEQ ID NO: 200510 - DNA, 23 bp, Artificial Sequence
  LB1 primer used for TAIL-PCR
gtttaactgcggctcaactgtct

SEQ ID NO: 200511 - DNA, 25 bp, Artificial Sequence
  LB2 primer used for TAIL-PCR
cccatagacccttaccgctttagtt

SEQ ID NO: 200512 - DNA, 25 bp, Artificial Sequence
  LB3 primer used for TAIL-PCR
gaaagaaaaagaggtataactggta

SEQ ID NO: 200513 - DNA, 90 bp, Arabidopsis thaliana
acaagaacaacaaaacagaggaagaagaagaagaagatgaagcttctggctctgtttccatttctagcgatcgtgatccaactcagctgt

SEQ ID NO: 200514 - protein, 24 aa, Arabidopsis thaliana
TRTTKQRKKKKKMKLLALFPFLAI

SEQ ID NO: 200515 - DNA, 5 bp, Arabidopsis thaliana
ccaat

SEQ ID NO: 200516 - DNA, 5 bp, Arabidopsis thaliana
gggcg

SEQ ID NO: 200517 - DNA, 19 bp, Artificial Sequence
  oligo(dT)18 primer d
ttttttttttttttttttv

SEQ ID NO: 200518 - DNA, 19 bp, Artificial Sequence
  oligo dTV
  misc_feature (19)..(19): n is a, c, t, g, unknown, or other
ttttttttttttttttttn

SEQ ID NO: 200519 - DNA, 50 bp, Artificial Sequence; identical to SEQ ID NO: 200507
  reamplification primer

SEQ ID NO: 200520 - DNA, 49 bp, Artificial Sequence; identical to SEQ ID NO: 200508
  reamplification primer

SEQ ID NO: 200521 - DNA, 16 bp, Artificial Sequence
  misc_feature (1)..(1): n is a, c, g, or t
  misc_feature (11)..(11): n is a, c, g, or t
ngtcgaswganawgaa

SEQ ID NO: 200522 - DNA, 23 bp, Artificial Sequence
  LB1
gtttaactgcggctcaactgtct

SEQ ID NO: 200523 - DNA, 25 bp, Artificial Sequence
  LB2
cccatagacccttaccgctttagtt

SEQ ID NO: 200524 - DNA, 25 bp, Artificial Sequence
  LB3
gaaagaaaaagaggtataactggta
